United States Patent 9,567,581 (SELECTIVE REACTIVATION OF GENES ON THE INACTIVE X CHROMOSOME) - sequence listing, part 32

SEQ ID NO: 3718 - DNA, 110764 bp, human
tgcccgcactccgagcgtgagccgcagcgcgactttttggcgctctttgggagcagtgagagagaggcggaggccagagagtccggggtgggcgcgggagccggggcggcccttggccgcattcccgcccgtcccgcagcggcgcgcggagccaggtgaggttggcggcggcgccgcgctacctggccgggcggggcggggccgggcggccgcgtgcgccgcttccgagtccggcgctccggatgcccgcccgcgctccgctggcccgcggagtttcgcgggagtttccgttttggcgcctaaagcccctcgctggcgccgtttccctccgcgtgccgcgtctgtccggcgcgggacgcacggaggcgcggccccagcccgggctgcctggggtcggcggggctgcgcgaggggacgtctggcgtccggcggagggcactggcccgggaggagggcacgcctttggcaaaggccgggcggggttgggaccggggttgctatggtagctgcgagcccgggcgggagccccacgcccggcctccgcgagggagctggggcgctccgaggtgtgctccgagtggactgaaccaagagcctgggaggagcgggtagggccggcccgtggccttgtcccctcctcccacagcccgccggccggccccgggaaggggcctcgaggagcccagaaaagaaagtattctggcccctggaaccgaaaggagtcttgcaaaaagcacgaaggggtcaagggggccgaagggagagggggaaccgtcgcctccgtccgagagtcagcgtgcgcgtgtctgtagacttgacattttataccccagagcggccgacttggagccgggttgcaagtcccagccctgaagttctggaggtggggcgggctttaatttgcttatatctaatgatttcaggaacctcgctttaaaatggcggcattcagtatgcacccctgctaaaggctctcccggcaccggggccacctcgcgcagcgctgcttttgcttctgccgctaacagatggcatgtgccgctgtcgctgccgctgcccctgctgctgccgctgagagcagggccccttagcctctgggtttgcgctagcagcgtaaggtaaggctggagatgaattgggatttgtaagagaggctgccttcctcggacgccgaggaaataatgccttttaaacttcattttacaaaatagcaaataggaggaaaagtcatcctgcaactttgttgcgattttagagctttgatcattttcctcctcctttcctcctcctcctttttcttcttccttctcttcctcctcttctcttcctcctccccttccttccttctttctttttttctactttcttctttttaatttaaaggaacttcttgcatggcatataatcagcaaatgctttttaacaacgaatttccccattttcacgcgatatcgtgagcagtgccacagcttccttgcagaaccttgtctcttcctgccctgagtcaacacgtttgggcagctcgcttttactactggggtttgaagggcatgagagtagattttaggagactattaaaaagggaactttagtttttaacactcacacaataagcttttatggtaagaaaacgaaattaaacccagacgagtaatgaaagttgacatttaagtgattctttgttgtggtttcataattagggtaatagacctactgtgtgtttttctgagcactcttagatagctagctagctagctagctagctagatgatagataaaacagataaattaattgtggctctaattaaagtaatatgttttaaaggagttattttctcctagatgttcttacatcgtttgtaaattgagctgggatccccacagcctctccgtatttgtgggtagacttcatgggaaagaatcaattaaaacaaaacttgcaagatttaattttgaagtgattggtactttttttattaagcggactccctgctttagtgaataaacgtttgggtgattactgatataatgtttggaaaacagattgttggtatgtgggaatgactaaacatccatgcttgatacaatttatctgaattttgttttgttttgtttccccctccagtgaaaggtaaatagacaatgaggcttatcagacaccttggatttttcctgattatatttccatcttctccttggcccatgaaaatctaatcctgaatgtttaactactttttaaaataatttttaacttttttctaatgtgcgatacttttgggggatgctttcatatttaccaacacttcttcaaatatagactaaaatgggcttctgcccacagctcagctgataatattctatcgctgttcactccttctcccaaagcagtagaaactacttggttggcagacgctctgctactaaatttagcaagtgtgtggaaagggagaaaaatattgttttgcccttattaaagcatggtgcagttttctgcccaggtgctgtagtctacctagaaacaaacaaccaaactgtttacaatggaattactatacaacaaattttcagcagtttttcatattattcttgaaagaagtatgtggggcaattcattgcttcatgtctaaaatgagagttcctgcaggtagagcaataaacacttgcattttggtaaagggaggatgagaaaaagcaacttctcccatttttagtgattatggacttagatcccagttcagtactgtttgcttccggatgtgctaccttgctgctaaaagacttcggaccaaatgcatccttaaaaaaaaagaaaaaaagaaagaaagaaaagtgaaaatactaaaccttgaggccagaatagacaagctaaactggtgtcagagaaattaggaaattttgccagttaacattctgctgcctcatacagtgatgagattggagaccttatatgaaaacataagtgaaggagtttgtaaaaaaaaaatgttttgagagataattgatatagtgctgggctagaggtggtgactgcatgttttgctctacttctaagagctacttcatttctctaatttcctttgctactttaagcaatcgtaatgactcccaggactattataaagtaccttttttttcctcaactgtccacttcaggcatttcacaacagctgctttttatgattatgagctggtagcaaaggacctttggtattctcttgcaccaccctctacctagataatgctttgcacaaactaggtgcttaataaatgttacattaaaaagaagaatagcttataaactcacagtggaatagattttgggtacagcttttaatttaaacggaaggcatttttatgcactcacaagaacctaaacattcaaagaagagtagaatgtacattcccctagttgtctgcattgtatttgcttctaaagggttctcttgcctctcattgtacttccaggcacttgtatacttcatgcttttgaccagtaggtgtattattatctctccagcttcactgtgatacttcccagtatcacagcagcttgggaataaaaaaggttttgtcttttgagtgattgtatagtaccacacatgctggaacagtgacagtctcttgactgttgtgcagatgttgacagtatagtttagtacagttttgttctccacccagctgcctttatgtgtgagggacgaggggagggaatggagtgagaagctctaaaatgatgaagatttctattgataacattttacttttattctgcttatagtacaataaattcaggaaggtggcagaatttttctgttttcaaataaataatgttgcctgataggcttacaaacagggattggggcatagctgacagtacataagttatagtacatttttgacaagtaatttcatcctgtaattaaagttagataatggtcactgccatgttaacattatcaagtgtctgtaagagcatgaaggctacactcacctttacttcatcaaggttcttccatgctggtgagttttcttatgacattgtctactaggcaaaacagatggatttttcctcattcaaatgtatgtgatatcaagaaaatagaaatcagaagttgtgtttgtgggatttttctgcctttctctaggtgtgatatagctctcacttcaaatatagaaagaaacccgagcctcagctaaaatgagatggacacttttcctgaaagagaagaaactgtgtctgggagcaagttgtttaattgtcaattaaccaaccagcaaacaaacataaattataactgaaagaaagcaattagatctttcataatgtgggcttttaggtcttaaggataccagatggttccatgacattctgttcttcctaaatggttatctattgcctcaagatagccaaatgacagtgttggaaaggcaactttgagaattaggataaataaggtatcagttgtcttaatggatgttaataacatccacatgacctgaaagggataagaaaatattttttcagatcattgtagtaaaaatgcattattaactcatcatttagatctgcttggtattagattgagtgacattgtttttaaaagattgatggagaaaacaatacaatctgggaagtaggaccttatcatttttatttgagaaataatgggacttccaaattgcctgggcacacaaacacacacgtacatgagtgtacaaattagtggtcaattcaaaacaatgtatacagatgtgcattgctttctcactggaagattataggaaaatatttttacagtattcctccaattctaagaatgaaataaaaaagttcactgtaaactattataaatatttgatatagtgatgtcactctgaggctcaggaaaagaaccagggctttgaatgttcaactccaggcagttaactttcagaaaaaaataaaaaataaaaagatgctttgctcagaactcaagaggaagcaagaataaaaggaggcttgatttaaatgtgtgtgtgtgtgtgtgtgtgtgtgcgcgtgtgtattctccctttgtatgtgtatggtgattttcaggaagcccaagcataggactcagtttgacatgcttcctaaaatattatgtcaactctcaagttttacttgcatcagtattaagttggctcatgaggaaaaggaattatttgttttctgatttgaggcaggagtttgttttttgcccagacagtgagtgaacttgaagggcttagaaataaagggcctcccatagagaaaaggcaacctggacagaaatgcagggggttggcagtagagactagaggtcatttgatctctttaagccatgggagcatcctggagtctgatagttggctggattttgttttccatttaggatcacaaattagcttaaaattgtccacattggattcttgaatcctgagcttcttggcattgccttcaactggtgtggaaaattgagaaaggtttcctcaggcttactcaggtttccttgaatgtaccagtaactattcattaagcagaggttattgggtctctttacctcatatccctaatgcctggtagatagtaggttctcagtaaaagtttgttaaataaatgaaagactagattaatctttctaacttgtttttgcatgttacgaacattcttccttgtagcattatttctgttttttattgacaaaagaaaaatcaacaccaataagcagactgaacgctagattgaatgactgttctgctagaggccacagtagcaactcaagtccagggagatgcaagcagtgccagctttggggctgagaccttgaggactggcctgaaagccagctgctacttttctttcacctgtagttgcatttagaatacctcccccacatcccagggatatcagtcttcattacaaagaaatgtttacatagaaacagttctttaactgtttcaccagattaaaaatttaaaaaaaaaatcagaaatactgtgactctgatgcctcctgtcatgtatagtttaggaagtgatgaagttacagacaaaatccaaaaaggacactgggagctgtctcattttcagtcagatgttgattgcccatttagaggctggatttgcataggtttttacttaccaagatacaggtatgaatagtgcctctttttattgtgtacagaaagcaaagtccacacagtagaagagacaagagctgtcatttcagatccaccacaatcatcttttgtgcccagaggataatcagtctttaggtttagcgcttgcaatttctccttatgtggcagtacaaagtaaccaaacaagaggttatgttggagagtggcatgggaggggtagtctattagcaaaatgaaagagtgaaagaaccagagagcttacatttcaccttttgttttgtagtactcagcttctacgcaggaaagcaaaacaacacaaaacaaaagcaccctgtagaatattaactggacatgtatctcgtgaaataattccttacttaatttaccaatggggaaaatgggattgtcacaatatataatattaaggtggttgctttaaggttggattcatatactatacactggtttttctgagttccatttaaaatatgtaatgacaaattcaacaagacccatggcacagaggtggggatcacatttaacctcagtacccaagtgaagagtttgtattcgtcctctgaaaagtaggcacttgataatggcccagttgggggtgctgttttgttaaagggtacattgatattttaaaaattgtttgctgtctgtgatccatgaggatcctgaagaaaggatgggggcatttctttcagaagtgattttgagaaaaaattaaactcccaactcctttatgtcagcattttcccctaagtaattggacaacatgaagagaaaccttattagctcacccagatatatgaagtgaaacatagtacatgttatagagttacattttatatttaaggacttcccaataaaatcattagggagggactggggtaccatgcctgtgtaatctgatatgtttcatgaatgcctatagcagcggcctcagctgcagacagaggctgaggctgtgtcaatatgcactctgctcgctttctgaagccagggtcaaggccagactcagattgacaggctcgtcaagggagggccttttttgagaaagaccttggattttggcgggacttttttgtggtgtactttatatgtttacatttattaaattaacattgtaatgcaaatgaaaatgtagggtcaaaatacataacctgatctggagatagtgttaaacatctgcatgtgaggcagtttgtgaatttgaggccttaggtaaatggtcatcacgacatttagacatgacatcagaaccagggaggagaccagtatgagcagtgaagggctccatgtctgcctctaaacttaagttcagggtaggtcccgctcgccatagaagatgagttgaaaatcagtgttacccatctaaatgaggaggaagggctaaagcctgtggattgactagagggagggtctgggagttctttttataaacttatatgtatatttttaattgacaataattgtaatatttacggggtagaatgtgatatttcaatacatgcatacaatgtgtaatgatcaaatcagggtatttagcatatccatcacctcaaacatttgtcatttctttgtgttgggaactttcaaaatcctctcttctagctatttgaaaacataaactaaattgttattatcatcacccaacggtgctgtaaagcactacagtttattcccactatgtggctatagttttgtgtccattaaccagcctttggctattccccaacccccacccttcccaggctctagttaccactgttttactcactgcttctatgagatcaactctttcagcttccacatatgagtgagaacatgcagtatttgtatttctgtgcctggtttatttcatgtaacacaatgtcctccaggtttatccatgttttggtgggacttttgactgactcgcaagttgcccctctaccccatgtttaataacctggttttgctggggaattcatatagatgcgctgagattcagtgcagcaacaataccagggcagaatgcttttgctttctaactgaaactccccctccaaagctcttttgtgattgaaaagtggataggctagaaagatgtgtcctagggcttggcatttcacagtgctgaaaaaaagacaagactacctccatattttgtgaagagtgtgatcatcatcatcatcacatcataaaaggatctaaaatgtgatttgatttagagaactctcatgcacatactttgaacttgcacaagtcattttgtgggatgacaatgatgatgatgatgagagaaactctaagaagctagatttctgggatattgtagtctccagctctgtcatttactaatcaggcacatgaaaattgtggttctgaatatatattctaaattaacaggaaacagctaggcaacctaagatctgattttaaattcttttacaaatgtgggcttttattccaatattcattaaaatgcagtggttcaagtgactgaatctgtaacctgtgttaagtgaatgttttttggataaaagttacatttttcactttcaagcctagatcatataataggcctccttgttgccttgtgtctatccccaaagaaatctctgtaatatttttagccatctaagaaaacagttcagacagaggcactcagaaacggtgacaagcaatgacaggaaatgctggttgcactgggctccctcataacttagtgaggccacagctggctgatttgcttttaacttcctgtttggcggctatttgagtcaaaagtagctgtgttttccatatagagttttttttttctttattctgtaaggccacaataaatctgtcactgggctgcatgttttgtatattttatgaactgtatcatgtggtttgagtttaatttggaaggcagtgcttttacaatcaaggtccctcccccaccacacgtgcagctttgtggtctgggattgcatgggccttcgaaagtttatggctttatttacacaatagtgattgctgaggagggcatttcctgccagctaatgactggttggaaggaccaacagtccaaatccacggagagaggaccattcattaaatgccaggaagcgaccaggctgcttttctcatgaagcagtggggagaaagtgaaaccacattctgccctttgaagagcccagagcaccatgggcagagctgggtatggatgtggtgcctcctcatccatatggacaatggagctacttttcctaacagggacaaactacttctttctcataggttgccaaatcgggcctttgatgggagggcatttcctataggtcgatggtccaatagagactggccaaataaagttgagggccctgaatttgccattaacgtctgccagataattcttaactcagaggtgttacagctacttgaaaacctttaatatcacatgattgagtttcctaattggttgaataactcatcattagtaaagtggacaaaaacttggaaaggaatggaaagaatggtttgttttcagggtcagtttagcaggttacagatattttactttgatctcgtaatataatgaaggtaaataatatacatgaagagtgctttgcctttagtggaagtaccattgagagctgtaatagtaatcatttaacccatgacatttccaggaaacagttttgtcctcagtataattcttgcctgctataaagcagctgaggtgtgaacagtttggcattgatttagagcaaaaacagaataagatcgaggctgggttcacatccaggaatccctgacttcctggcctgcccttcactcccttagcttcctaagccttcaatttgctaaaaagttaaatgtttataaaagacaaacatctgttctgagttctttggtaggtacctccatataaaggaggctatgtgacagcgccccccacccccaactcccctgactccatgacttggcttggtcctttatcttgaaatttaaatttctttcatatcttccaaatttggtggggggatggcaggggtgggctgaatctctgaaatagaggcaatcactgatggccagacacctgcatttcttcatgggattgagtaatctgttacatgcagaacaaaccaaatattaagtttcatttttgagtctggcaaatgtcattacatgctttttaaatattcagtaatccagggattgctggtcattaccagttcacaaaagtgaaagggttttctgaagtttaaaatgttccacaaataaaccgtatactcattactgttgttattattagatgatgcccagagcagatttataaacaaaaaagcggctgatgaacaaaaaaatatatatttcaaaatatgattttaatttttgaacatttttgagtttgaatgttaagatacactaaaattttgaaagctcagatgaaagaccgtattcgatttagaaactggtttggactaagaacaaacaacgttttttgtaagtagattggcctgaatatttacaaacatttataattagcaacacagctgtatgtatgtatgtatgggtttatttatttatttttatttttggagttgaagtctcactctttcgcccaggctagagtgcagtggtacaatctcagctcactgcaacctctgcctcctaggttcaagcgattctcctgcctcagcctcccaagtagctgggattatgggcacccaccaccataccatgctaatttttgtatttttagtagagatggggtttcaccatgttggccaggctggtcttgaactcctgcctcaggtgatctgcctgccttggcctcccaaagtgctgggattacaggcgtgagccaccgtgccgggcccggacattattattttgtttagcaaaacctttctttataggtaatctaaaatacatatttcaagctgattcaggttcagttatcacaatctaaactagtggtgtcaaaattaatataggtttactctactgtatttggagccaacagcattaccttgtggtattagaaaagcctatttattctatcattgtaattttcaagtggtaggcaacaactcattagtgcataatgaaatccatttagtaggttgtgactagcatttctattaaacagaattgcattaaatagacagtaagaaaatatcaacatgtgtcatgtagtaagattagatatattgggtgagactgttatttcaaatccatgcacctgttactgagttaggatgtaaagtgtgtttcttactatttgttgccgtcagaaaggtttaaaagtcagtgttttagtggatgttatttctgtgtcagaaatatttttcctctcttttttgaagggaagatggtcaagggatgctgaaggctttcatgataacatacctagtgctgttggttcagtaccctgatagttatgtgtctgcttttcaaactgaacagtaagatattgctatagatgtgctataagatttaatgtccaaggtattttgcaatcctgaaggcagaaactttatatattatgtatttactaagtgctattgctagaacattgggacactgaaaataaaactatctgggaacaaaagccaaaaacggatgtttaacaacgacaacaacaacaaaatgacaactaaaaaccttgggacaattgggtgtgaggtgcttcgaatggcaaaagaattatccaaaaattttaaatgttggaagaaaatcaagctcattttaataagttaaatataagttaaagggctcaaaaattgtttttgattttcataaatcaaaaatggtcatagcaagagaatgtgtttgcaagaagaaaacaagctgattcataaatataaatgtttatgctgggaaaaaaacctgtgggtgtctattttttctgcggtgaacaaaggcacactttaaaatgaattttaaaattgtagatgaggcataagctgaaagtctgttaaatatacctaaaatattaatgggaaagattacagaaataaagaagaaaatagccacatagtctttccaatcactttttttgtgctaatgagtattgagcctagtagtaggaaaacataagattcactcacatgaacagataagagattaactactgaatgcaacccattaggagaagtctggccttagaagtctggccaatttgtgcatattccttagaattaaataattgtcagggggaggaaaatattgccttccgggggtactattgcatctccagtaggatcatgaggagtttgtcttcaccctcacctctcctgcagttccctcccattgtcattaaatctctttctgcctgggacatattgaattctttcccaaaagtctcttcctgtggacatccttcagagccttaaagcactgttgcttcctcaactttgagacttgacatacaataaggctttatagatatttaaatgttaaactgaagttactgctctgaaaatgtaatgtcagcttcttatgagttagtgactaaactctgtcattgtgagtttgtatctccctcctcagatataatacatttaaagattaagaatagaaaaagacttacagatctactgattgtgtaattagcaatcaatttatgaaatgagatgtaaaacaaattaaggaccataataaagggttacatcatcaccaacaaaacccgttattctgtttatgacgataaaaactaaaaaatgttgaagggtgaaattgcatacatgctctgatcctgagagctaaaggttttaattctttcttattctgatgttaaagctttttagaaagcagtaatacatattttggggggttataggatacctttgcccataagcatctgtttcactgtaaacatgtacagagtagtatagagtcagttgaataaggtgtggggggtttgagtgtgagttattcaggattttcagctgtaacaagcatgtagttgactgttctaggcaaacaaaattagtcattgttttgggtgtcagctacctttttcacgttagccttctgggatttttttgttatgggatgcttgacaaattaatagtgataagcaaaagctctgtgagagggagtgctcaagccaactaaacaccaacttatcattcatttcatgcagcactctaactttcatcaggctgtctgggaaatattgtgacgttttatataatattacatttgaaactttaaggtatacatggaactcaagacctttgacaggtgagtttgttttgtttattgtaagtggaaatttccttcagtaggcaatgagactgtcaaggcaaactttcttgtagaatggaggaggagaaaggaaggagagaaagagctgcatggtttcctaacattttgtttggagaactccttataccgcattcctcattttcatgaaatccaaaagaaggttgaaatgctgtattgctgttagcagagttttccctaaactagtaagtgagggaaaccccttcttcccaagaattgcaaccattagcactctcaggaagcctgcaatgatttggacataaggaaaacaaaatatatacaccttctatgtactcacaacattttttaaaaaataaaaataaatataatcatgttgaaaaaaaaacacttgatcatctcagatccaggagaggagctctggctcatattattcctcatgttggataatcattaaaacagaagaaaataaaaccctcttgaaatggcaggttttttaagtgaaaataagtaaggtttccttggacccctataaggagactcttgtgaagcatgcatccagacttctgagactttatactttttgctttctagagcaggaaagacttaagaaataggaagtcagaaagtacagtaaaaatctatgggttctgtgctgttaagggtccctttctgattggcttggtgtgaataatggtatagaatttaaccatgtaagatgttagaggcctgagacttcccttgacatttccttatgctggcaggcccaggcagtttgactttggctcttgtggcacttgggtggcaggagaaacagtgtttacaaccaccttcacctccaggaatgtattatacttttaaatcaatcttagtatctgtaggcaggagtttatatataggaataaaatttgaacccccattttcacacccaataaaaacgtcctgtaataggtgtttattcagagtcaactgacatttattgaacaattactgtgtgccagatgctctgctaggtactttcattttgttatgacagtttttttaagttatgaaatacagttggttctagctgggcaaatactctctttggcatctaatagatatcaggctaaaaattgcatcctcaagtccctgctcactttttgtataaaacacaccccccaacacacaatcatttcttctctgtcttgcttcatcatttgggaaccatctaatggcccatggcctgcctcttccatccatgaagatatttatttcattataaatcaagccaacactaatctgttacccatcttgatgtaacaaaaggctgctttcactgtttgatggatggtgctacagtaggataggagaaacaggaagaggcttgagaggtggatgaagagtgaggggtcaggagtgtgaaatgatgtggagttaagtgctagtgaaagccatgtagaaaaatctagaacaaaattggattaaacttgtccagaatgcagagaaaataacaaggcaagatgttggaagttaatccctcacccctaggagtggccaggacagcccaagttgagcaacacaggaggatttttttttgttatagaagcaaagggcaaagaaagtctctaaaaggagggagcaatcaacaaataccacaggaattatgtaagttgaggccactggttttggcactgaaaaggttgttggtgatttttgagagccaagaagctggtttccagtgggttgaggagtaagtgaaaagttggaaagtgaaagtggtaatgatgactttttttcagatatatgatgatgaaggatgagatatgttggaacttaaaaaggaaattgcatcaagggaaggaagggttttcttattaggatagagatgacttagatgtgcttactggctgatgagaaggaagcagaagagaatattgaaaatgtctgtcaagcatggaatatgttctgagtggctgccctacttgcgcaacatctctgttaatatgcacagtattaattgtgcagtctgatcaagtaattcatacagaactctggtgagcctgaattttgggtcctctttattctttttgcctttaaggtggaggattaggattgtcataaaagaactgggataggtacaaccaaaaacaaaaaaggaggagggggaaagacagtggaattcagctaaaataacagataggattatttttaaatggcttcagaggcaagacagtgctactgaaatagcgaaaatgtgactgacatctttttacagcacatactcaatgaaaatgaaagagagggttggggaaagctataaaaatgagaattcaaatgtaactatagaggatataggtttactctgatttgcctttacactaggattcagtgtctttcataaatttggaaatttaccatagacattacttcccttatgttgcgtctgacaacttcagtttttcatggattttatatttcaacttgtaaaaataaaaaaaataacaaacctcaggtctggttcaattcccctcattttaatcaccatcccctttctcccatctagaagaatatatttcctcttttcttagaagcttatgattattgatagaaaatatctctaccttctctaccttaagctttgaatttaatgtctaggttgattctagtcaaacaaaaggtgatgctgctctgaggttctgcaaatttctttttactctgaagcggaaaacgatgcgaattttcaatgcaaatacattgaaaaacttaaatctttgaagttatattgtagagatactaatgatctaaaccagcgttttcaaaactgtgtttattttgccacatggtctaggataaaaaagatatactaggtggaatgcctgagaattgaggttgaaacaaataccacattctgagaattaaattgcattaaggctacattcctaaaaatatatataaacatatgtatacatatgggttttttttgtgtgcgtgtgtgtgtgtgcgtgtgtttattcttctaaatttcagcttttagctttttatgctgcatttcaagttactgtgcaaatattacttgttgataagaatttaagaatactctatcaataggaatcaaagtagattaacggcatcttcatgccaagagaacagattgcacaaaatcaacaggactttagattaaaatatttccccaatgctagagaaaaatgtttcttaaatgcatttctaaaatgaatacaggaattttgcttttaattttttgtttatggtttctagtataaattctttatcattttatactggggaaaatagatttttatagtatcctatatagagaagcaaatcaaatggctttacatttagattatggaggatatagttttactttgttgaagtaaaaatattcagcaggtttaaattctgaaataatagcatgaatgagcttattaagcccatgatcaacgatttgcaactgtttgcttgataattggaaggattgcaaaggaaggcaagtttatatggttggtttaaattaaggctattgttttgagggaatcagccagccctgtaatcaagttgtgaactcagtgcatctctgaactaattaatttagtgtgatatcccctcaaagtccgtgttctgtgttaccaattagctacacctcataggaatcttagtccctctttcaggatctgcactctggtttaatattatgatgattatttactggattcagttaagaaattcaatttgcaaacagatcctttttgggtttggatagtatcaataatcaacattctcagaatccttttcctctgtaaaatagtatttttaacaagttttacacaatgaaattaagagaattaaaatgggaaacctatagaaaagatgtattttccccaaaagtctttactgcattatcttttggggggtatgtgtctgtatgattaatattacaataaataccaaagaaatgacgagttgtttgttgagcttaaagtggaaaaattccagcaaggaagacacaagtgagtgatgagagagtatttccaaacatatccctcttaaaatgtcttaagatggcttttcagtaaaaagcttttgcctccatctctgcccagctgcattttagttgagagagagaaacatttactttaggatgctaagtaccttgccttattcaaagatagagaagcctagtgtgaaggacttgtgatcttcgagaggtattcacttcttccaattcaaattccaatcaatttctcttgtgtctgtacatcatcagacctcccttttgtctgaaagtgcaagctcacatttagccctttagccccagttcctggtgcagcatcaatgttcctaaatatccacgttgacatccaaacttttgtatcctcttttcttggcaggaatttgattcttccaatactcaaattgaaaattgtgcccttaacatgtgtagagcagttggcacaaaggggaagggcgctaatttatctgactctagtcaataagcctacacaatttcacatgaaaaaaagcaaatctacaaaatacatggagaaaagttcagtataccagttgtgtgtgatgtctgcagttaaccttctatagcatatcaatgctggcatcctcccaaggcaatcttagcccaggaaatcactatacttataatcttggaaaattgcttcagcaacaaaatatattagatagcaagtcttctttttgtttgcaaagtgtatttacagactacgtatgtattatgactttgtaacagggcatcctaagtgctaaatatcttcccttcccccctgcagcatgtacacacacaaataaacatcggaacatctttaacttatatttaaaccacagttatgtagtatcttgcagttacattgtatttttatttatttttattttatgaaaagggggtctcactctgtggcccaggctgcagtgccagtggcacgatcatagctcactgtagcctcaaactcctgggctgaagcaatcctcccacctcagcctcctgagtagctagctggcaccagaggcatgtgccaccacgcttggctagttaaaaagaattttttttatagacagggtctgctatgttgcgcaggctggtcttgaactcctgggctcaagcgatccttctgcctcagcctcccaaagtgttgggattacaggcgtgagccactgcacctggcccagttatattatagatgtgtagcagttgtgaaaatttttcatttgtgttttcccttgtaataactgacctaaaataaatcatttaatcatatctttttattttaatgtaatattaattgatagccagtttttagtttcagagcgggtctaactgtagaactatccactagggagaaaaaagggaaaataattgatatcatattaagaagtggcgggaagaagtgatgtaattttgtacttttttctaatagtaacagctacttactctgtgctagtctctgtggtaagcactttgcacatgttatctcatctaatcctcacagcaaccctgtgaatttagcgttcttatttatctcctttttacagatggggaacatggggctcagagagaggaagcagcatgccaaaagacattctgctagtaaacagtagcatcaaaacttgaacttgatgctctaacattggtctatgcctataatccccatggttatattatggaaatataaaaaaaggtttgattgggaacttgagtttgctgcttgtcacttccacagtgtattagccatctaggattgggcactggataaagatagtgctgcttgaatgaagtaaacatctggaaccaccagacgcgacagacattacaattcacttccaaattatagaattataaactgttagaagtggaggggggaaagcatcatttgattaataatacatttgtacagaataagactgtttggcacaatattgtcagtaatagcaaccctaaatgtttcagacttttaaaagttgtattatggtgggatttactattatttagcagagctagttcctgatatttttctaggaatgtctcatttaggagactttaatgtaaactgttaaatgtctagaggaactatagcatttttgaaattacagcttgatttttccctgatatttggctccctaggactttcctatttcactctccttttcatccccctttcagtttttttgttttgtgtttttttttgtttttgcatttgttattcattcaacgtactttattgagcacatactatgagtcagccatgtttctaggtgctgaggatataactctgatcatgtaagtaattaattttagtgttaatgtaagtgaattagacatttttctataaattgagcctcacaaaacaccattacctttattgccttagatgtccttctttagcctaatcatgttgttttaaaattgtactgatttagtcacaatagccaaaaagtggaaatagcccaaatgtctgtcaactaatgaacaggtaagcaaaatgtggcatacccatacaatggaataatattcaggaatagaaaggaatggaatacatgctacaacatggacgaaccttaaaaacattgtattaaatgaaaaaaggcagacacaaaaggctacctacgatatgattcaatttatatgaaatgtccagaaaaggcaaattcagggacaagaaagcagattagtgttagtggctgcttagggaagaaggggtgggagcacagcctaagaggaatggggtttctttggtgggggagtaaaagtgttataaaattgactgtagtgatggttgcagatattattaaataatactaaaaatcactgaattaatactttttcaaagggtgaattttatggtatgtgaattatattgcaataaagctgttattaagaattgtactgacttagatatgatatatgttatattattcccattttagaattacaaacttaatcaatagctaaattgaggggattgttgatctatttttaaacagaggcaatggattggaataactttggattccacttattctttgttctttatgggaacagttgatttcttacctgaagacccacatcaactatctctgttcttacagatgccttcctttttggtcccactatttactgggcacttggccgtgctgccttacatgtggaccaaatcattgccttcccaacatctagcacaatgtcttccatatgacagatgtgcacaacttccattggtttagcatgtacttgttgacaacttatttgtatgtagtattgagccagacactagagatgaagatgtgtcctcaaggagctcacagtcagccagacagctaagcaggagttacactacactgtgacaaatgttgaggtggagatgggcagacatgtttgatggggatgctgaaaccctgcgtatagttctgtgtctggatctagttcattcacttatctgatatggataccccatccacggtattcttctctatatttgaacacatccagtaacaagatgctcactttttactaacacagtgaaattaaactgcatttttctaatctaccaaatgcccatgtattttgacatcaaatccatatagtacaattacatagtttgtaaataaaacttaaatagagctgttaacattccttggcacctccagaaatgatactatattgtaatagaactttgagtaatctttattattttatagaaagtacttggatttttaatgtgccaaaatctctggtaacaaacatgtataaattttagattatgtttgtatacttttgtgcccattagaggcagtacagagtggtgattgacagtaagcattttggaacatgcctgaatttgatcctagctcttccactcatctgctgcataatctcgaaccaagttacttagcctctctgtgtctcagtttcctcatctgtgaaatgggtacagtaatggaacctgccttacagggtagttatgagcagtaaatgaattaatatatacgagtgtgctaaaaacagtgccttgcacatggaaaacacatgcatattttctgttgttatattttcaattcaactgaaatgccatgttttattagtctgttcttcataaatcatacacactcaccgttaaatgacattcaagtcattggaaattgaatgttccttttacagggacctatagtttttgagtgttctcacaccaaaagccagctagattttctggtatctgtacttgaaaataagaggtcacggttgacattcctttctgctccttttgcgtggtcacagagttttataatgtcacatgcctatctcctatcagttagcttgataaaatctctatagctcacacatgatttcatgccaaaggatcagtgcttttaaaatgtttgatgcatagttacaaatccacaggaaataaagcataaacagtgttggatttacactttttgactgcattgatgccattctgtttgcgagtcttgtgatttacaagggcattttattttagtcagccagtagcatcattggccagtatgctgtctagggaccacaattcagtggtgacttgcagtctgtcttgctgataaatgtttttggcagtgtttgggagttctgcttggtcaaaaattgacacatacaaagtaatttagaataataacaaattaacattgagattattgcttttgccttagtgcagatgcaggttactaataacctttcatctttcaatattgcttcatatttattatttccagtacagtgatgatatatagtcattttcaagattaagcagaagtataaacattgaaaatggcctaaaagagcgatggagctagtttggcacagaaaaacagaagcctgttgggacaagatgctatactatgtgcgacttagtctggggtttacaggagattcacttttcacttttaaccttttgggaccaagttgttaacaatgtctcattgtacttagatcacaattttatctttgccattaaatgtaaatatattgctgttaaatgtaaacatatgactgttgtatccacaagaaagtttcctcagcaccaataagaaaatgagttaatgatagttcttatgtgtattatcattattaatttttaatcagaacttcccttaaataaaatgcacaagcagttaagttgggtttacaaacttaccaacaaatagtctttataacctgctgtaattatctctagaaattttaatgtgttcagtgactaattctccagagcttttactaagataaataaacagaaacagcaataaccagtttccttgtatttcttaattattggcgtgccttttagtcgtgttttagacttaaggagggctgtgtctctctctaggcatgcaaactatgctttctcctagttggcttcctggaaaatctaatcctccctcttgctcattgactcaagtccaactaagctcttgtatatcgcttcattttgtgcatataatgtcaagggatttgaatgtgtggtagtagtctgatagtatgcatgtgtatggccatatagtattgaatagtattgaatatttattgaaatacttccttactggttagtaaatagatactgcctatagtaccctttccaatgctcactccctgacaaccccccatgattcagcaacaaatatggcaacacttggcagaacaccatcagtattgatttgcctgtgaccatgctataagaattgtttaacattttgagtgtcattcctggctcatggtttactatgaggtcagccccctgcctcaccgaccaggccattggtgctctgtgacattcacagccttttgctgaacagtttttcccagattgcttcctaaacatcagctagacttctgagagaagagctgtatcccataaagaaatggcatactacttccagacctcagcttctaacagacactgtagatctcatgaaggccaggcccttaagcatttaaaacatactcatagggaacctcccaaggccctctctaagatcactcaagagcccatgtcatttatattttaagacccaaatcttaaagactcttgattcaataccttacacaaagcaattgtttgctacactttatttgattgaatgtgactttgcaaaccacagaaatttaatcagtgtgtttgtgggggaattaatagaggcagaggcatagtgaagtcatggccaataaatagctgccagtgaggaagaagatagacaaactgtaaaaagtggaaatgaagacaccaaaaacacaggcatttggggccgtttaacaaagtgcccaatatatccttcaaggcattactgaagtttctttctaatgataacctagaattatcagaaaaagcattacttttttcactgtcttatgtctaagggggaacaacgttttacaaatcacttcagaaatatttccaaagattgattaaaagagacaaatatcaatttataagggttttgttttttgaaattttattcttatggatctccttgcctgacatttttccaataaatgaaatgctgtaataagaactgtatgtgaacttagggacttttgtagtatatgatgggcttgcaatattaatcaaaattatttgtcatagaaattatcacagtgagaaaattattttgggaccagagtcagcatcataaataagtatctgctctcagtgaaaatacttccaaactcatagagtttgtttgtgaggtaaaagaacacataatattaatcttcttagtctcttttttcaaagaaatatgattgaagaattattagatatctcactgataacagtctaagggagcctgttcaggaaatgtctaaaatgaactggtgtcaccattgaatgtttacatgtacaccttttacttttttataaatatgcatttgtatttggagggaaaattatttttctgtcatcaatatcatatatgcttcaaaatacttgtgcattatttaaaaatagaaatgtggactaaaagaagaacgaagatgaagaacactaactttttaaggttcgatttaccagtgtaacttttaaaaaatatcaataatactttgcttatcatatgaggattttcaagtgctgtgtgaatgtgaatgctcacaataccctgtgctataatacagagaagataatattatacagatataaatgttacttgtgtgtgccaacaaccacatgtattgtttccagaatcatagcttttaaagttaagtttagctttgtaccattcatagtgtaatgagcaacaaatattccaatttatttaaaagtattaccactaccataacaaaataaatacatagtagcttacagcttacaagatgtgccctagagttttctatgttcaaatatgcacacacacagtaatttaccagaggtaagctttttgatagcctgtatattagaatcctatatatgctaatatatttttgaaaacctactatgtgcttagcaccaaaaagtctgttttacttccctttttaaaaagtttttattatttatttatttactttgagatggagtcctgctctgtcacccaagctgtagtgcaatggagcaatctcagctcactgcaacctctgcctcccgggttcaagcgattctcctgcctcagcctcccaagtagctgggataacacatgcatgccaccacgcccagctaattttttatttgtatttttagtagagatgagggtttaaccatgttggccaggctggtctcgaactcctgatctcaagtgatccgtgtgccttggcctcccaaagtgcaggattacaggtgtgagccaccgcaccggccagatggtttttaaaacaagctcttcttacctctccttagcatataaaatgtatttggatagtcaatacaataagacttttgtgtggttacatctttagttgatacagcaccattccacttaccactaatggtcttgctgatttttctattggcccgaataagctcgtaaagaaatggcatatggaattaatgtttttttggtgttttaagtttcacttctgagttcccacctagatgtgaaaaccaagagccccttcattctttactgttattttatcaacctttgcaattgtgaggagaagatattcttgattttaacttagcatcatatttatttacattgtatgatcatattatttcttttcactgagggctactgatacattttctcaggtgcattgaaatattaattaagtagaacccaactgtctgaaacccacagtcgacagaagttttatttgtatttgattattaggaaaaatttgaatttaccaaggattcagtgttaagaaaagtataaccacgttctttagtaatgagagaaagttttaattccgtttacgatatgctgtttaccaagacaaaaacaaggacttgtattttgaaatggtttctatcaaaagtggtttttagtaaccatgattaaaaaattaattccgtattttcattaaatgaatctatttcacatttctactgatttccaacaatattgtgctttatcttttcataaaacagaggaagaaaatctatttttctcatacatccattttttatgttcataatctcatgccacattattctcccctaaccccttaaaaattgcagacaaattttttagggacagtgatggcttaaccttttttaactttggcacatatacagatcatgtttgtttgatagattataaatgagaaatttatttatttctaaatcttacacagtgataggaattgctatgcaattgattgagttctaataatctgtatatcttaaataccacagaatgagaaaaagcagtcattgaaaaggcgtggttttagtaatttcttaacattttatgggatacttttttttaaaattgtgtgcgaaactccttatttttaactagccactatgcttgcaattctgttatctgccactaggtggtgcgtggttataagttgtaaccatctgggcttgccgtgtgtggataacaatgagaataggtttatagtacacaactgaattcgattttttaatgaaaattaatgattaaaatggtcaatgtaaatattccttttgtttgtttgttttttgagacggagtttcgctctgtcacccaggctggagtgcagtggtgtgatctcggctcactgcaagctctgccccgcccgggttcaagcgattctcctgcctcagcctccggagtagctgggactacaggcgtgagccaccatgcccaactaatttttgtatttttagtagagacggggtttcaccatgttggtcaggctggtcttgaactcctgacctcaggtgatccacccacctcagcctcccaaagtgctgagattacaggcatgagccacggcgccccgcctcaatataaatattcaatcagcttccaagtatagtcagattggtatgcatttttaaataaatgagagtgcgtaattatgagtacttttctttcaccaaactttaaatgttttaaatcacctcatgtgctttctttagtttttctttaaaggagaacttgattctttacgttattcaaaatttttttgtttattaaaaagctctgggccctatgcttatggacaacttcccgtggctctttgcttatagctttctcttctattgccctagttaattgttttgctactagttctaagtgccctaaataactaaagtctggtttagttgggtttcaggtgaagtgttaagctctagcaattttatataggaaagaactgtgtcacgtattgaatacagtgtgtgagtagttttagctcctttttgaccattagacataagattccacacctatgtccaaaaataacaacacacacacacacacacatgcatgcacacacacacacatagtgcaggtgtactcacccctccacacacactggtttctaacagtatagtatacatatgtggacatgtggctgtgtctttctttggtctctgaaaatgtcctgcagtggtctctcttccaccaactagcttccagcttgtcactcattctaacttatgctttcttgtggactttgatgcttggattggtataaaaactaatttgcatcaaatagtgaaattacctgtgaacttctctagcagattcccagcagttttacagtctgctttgcaaaaggaggccaatagtctatttctactgaatttttgaaaacatttatttcaacttcccattcaaaaaaatagaatggtttttaagtagagacatagttgctttagttctttgaccacatgtattatcatgccatgaaaattgggagtttaactgtaaagagaaacaggagagagagggaggtagagggagagagagattgagattgggaaagagattgagatttaaactttctccaaaatgtagaacaaaatattcaactccagttatcagaactgagctcttgtgttggctctgtcaccctttgtgactgtgtcatttatcctctatcgtcctattgtcttctctgaaaaatgagggagttggcctgtagatcatcactgcccacattgtgagtctgtaactcaggctttcatattaaagcaaaaatgtgggggaatgcatagtttcaggtctgcttgcattcatgattgaactactcaacttcctataaaaagcacagattcttatgtataatagaaatatgtaggttcattatttttatttttatttcttgcattttctgaatcatctgctatcaatgtagtgctttgcacttgggatatcttgttagatataccatattcccattcatgctaaaggaaaataggaaccttgcaatgattatttttttgtttacatagatacagtcattgtgatctacaagaaatactgccattggataagagagtgcattctaagagggcaaagcttgtcattttatattctttttaaataaaaaagcaagtgaaattcagaacttaatcatatgctgcctctgatacttttggggtgtgagattatctccccaactagattataagctcattgagagaagaaactatcttgtatgcattttgtgtcacccaaaagccaaatgcagtgctatgtacctagaatacaggttagaaatgcacttcctctctgatactataataataagttattgactcatggtatcttagccttgtgtggtcgtttgggggtttctagcccaacttcccagccagtgtgacagaaatccagtgaagaggagtgtaccacccagaaaagcatttcaaaacactttcggaaagctcaagctgtgagaaggctcttcactgtgttgagctaaagtgtatctctctgtaccttttacctgtagatctttctggaaaaacagaaagcaaatgaaccacttgtctttatttttttcttgttcatccgtgttcatctccagaatttatcattttgtaagtatttatataaggaccttgatggcttcagagcaaatacataacaaatcattttttaaaaattgagtcattgcagccataaaaaggaacaaaataatgtcttttgaagcaacttggatggagctggaggccatgattctaagtgaagtaactcaagaatgcaaaaccaaataccgtatgttcttacttgtaagtgggagctaagctatgaggacgcaaagacatacagagtgatataatggattttggggactcatggtgggagattgagaggcgagagtgagggataaaagactacatattgggcacatggtacacttctcgggtaatgggtgcaccaaaatctcagaattcaccactatagaattcatccatgtaaccaaaaaccacttgtacctcaaaggttgttgaaataaaaagtaataataatttaaaaaattgagccactataaagtaatggaataaggtttgtcagatttctatttctacactgaatgagataagttcaggtgatttatttcagaagcacttaattagtatttactctgtgccagacagtattctaagtcctttacaaatattaactaatttcaatctacaaaacaaccctaggagatagatactattactgccaccattttatagatgaggaaactgaagtacagattatttaggtaacttgcccagggttttcaattagtcagtaagaagtagaatgatgatcaaggccttctggctccagaatcctattcttaaccactctgctatgctgggataactgttacacgtttcaaaaaattctaggacatttaattttgtttctcttgttctcttaagtaagaacctagttgtttaaagtttccaatttttcatgagaacttatttaaaaattaatcttaaaagatctggaaaagatattgctttcatttgttctgtttgtgccatcttgaagcactctacctttatttattttgattatataaaacttttgcctgtttaattaattgacattgctactgtctgggtaagttttactatagtctctaaggatgctgttacatcagctctgttttctatcccttgggcaactgttaacttttttccgtctaggtcccttgcactctcccacactttatttaaagcttcaccttggctgaagtcaaacctaaaacaccaaataaatactataattggctcatttttaacattttctttgaattcctaacagcccatttaccatatctgtcattaactgggatcttggctttattgagtgcctacctcacaccaagcatttgcacatctgtcatatgacttattcctgctaggaaactgagatactgagtttaaatatctggacagaggttcaaattcaggtctttgtgattctaaaccttattctgtagtgtatacaacaacacactttcttcacttctctgggtctggtcttagtttcctcacctgcaaaagggaaaaaaatatataaaaagtagactgagagcctattaagtgttaggcaccaggctaggttctgctctgaaggggttcacagaaatagacaactttaatttaatgggttcatggtggtgatgtctgtttgaacagtgttttgagtacccattgatcccttttacttggtgtaaatcaaaagctggctctcgcagaataagtaggatttctcccattctaaggaagcacattccataatcctataagacctttaaatatatttttaaaaatcaaatttatgttgtactcttctttctatacacaggtttattaagtatgtggcatggaaattatagtttgttagactattaaagttcatgagaacaggaaccatgtccactgccttgtactaatacttaatacatatttggaaaacaaatgaaagaaaaaatagttttaaatatggagactcttacacaactgacaatttgaagttttaatgagtaactactatatagtgcacactacctttattatttatacaaatttcaactcaactagtatttattgagaatctagtatgccaagtactgtactaggagaggtaatattcaattcaaattaatgttctacttgaatgcagtcattgactctaggggagttttaatagaatgattgatagaagccatattgtagtacatgctggagtgattaagggtgaagaagaggaggtatcaggtagaagaagatatttcaaccatgaaggctttggaagccttcctctagagggaggctgagttgaagtttaggaaagtcacatggatgtttgttggggagacaaaattacagctcaagtgatagtgggaagaggcctgagaaacatggtcaagggatagatgggttctgctgtggtttggatgtggtttgtccctgccaagactcatcttcaaatttaattgccaatgtaatggtattgagaggcagtggggcctttaagaagtgtttatgtcatgggaattccaccctcacaaatagattaatgcagttctagtaagactgggtttgttctcatgagagagtgttgttataaagtgggccaaccactttgtccccctttctttcgcatgtgtctacttgttcttccacttcccactatgagttgaagcagcacaaagcccacgccagaaggactgcctaatcttggactttcctaccttcagaaccatgagccaaaataaatttattttctttataaattacccagtctcagatattcctttatagcaacagaagatggaccagttcctagtgatgatatggtttggcctattcttcagtaaccttgtgggcctacacataagttttttttttttttaatgaagggtatataacatcaggattcctaaaatcatatcacttatccactaagacattttttgaaatttgtttgaaattttgaaaataaaatgtaaacatgagggactgtggcttatccatgtttgtaccttcaacatttagttatgtggccctgagttagttcttactgtgtgtttagtgaataaatttatagaaggttaattatggataactgctattgatatacactgaataaatggatataagccatctaccctaaaaaaagatttagaggcctacatttacctgcctgaaggtaatgagctagacttgatctttcagagttatttccagttctagaattctcaaaattcttaccctttactgaatgaatcttatttgacttttgacaaacctgaaaacatgagttgtgttgtttccgtaattactaatatgaaagctgctttgttgtttgaggcttgagtatcttcagtggaacaattgtttagtagtacatgtaatagataataccatccatattagaccctgggaatttcagcctagttttatgtcagtgtgagttgaagaagtttgtatttgctgagaacctttatgatcttttgtaggattatactgttattttaaatagaatgaaggcattttggttccctttctgtatatggaattatatggctgtcagatttaatagtttaagccattcagtacctagtgacatagatgatacctacatcacatgattcctacctacagtataggaatccatcaactttgatggactttctcttcacttcagtataaatgtaaatgccctctttaaattactatttaagccatgactcctcctcctccatctcctcctttttcacctccttcttttttgcctagccatttaagctgagttgatttttgagatgattcttaatctatagatatcttcttactttccatatatgttggtacttaacaacatatatgtacagacttgcttgcttgtttgacttcagtatttcccttgagttttattttcaaatccctgttttatttgtaggctcttactcagatcttgtcctgaaaacctcttgtggtgaaatctttttttaaaaaattttgccttctttttatgacttgcacactccagattttgatatagtaaatttacaagttagcaacagagttgaatttgtgaaggtactgacaatcttgttgtagtattatagcttcctagttttttcataatttccaaatcttggttcagagatttcactttgatttggatagccatttttttggtagaaaaattttatttttagagcaaggacctaccgtgcccaagggcttttatgcttcccttctgccagctggttgccagatttctggaccacatgttcttttgaatgatgattttaaacccactatgtcaagcagtttctaacttatttgccagatatgtatgaaaacatataccttccaaattataagcaattcaggatgctctggcttccatgggtagggagtagtaagctttcttattgtcatttcaggaatctggggtgggggaaatgagaacttggagattttttattggtgtttatgactcttatgatttctgagaaatttaaatattgaaaaactcaatacaatgatttggtaacaagtctagaattaaaatttgtgaaagactgatttggtttttaaatgaaattttaatgttgccctttaaaagtatgtacctcataggatattggggatgattaaatgagaaaatgaatataaaatgcctagcacagtgtctggcacagaataagagctccatacatgttaactattattaatatctattacttaataatcaatagattgaccttggaagatacaaatacctattagttaataacaaagattggctttagaatgcgtcatatgatatgctcagcaaggcaaatttatcttcctcattgtgttctagtggttatttgtgaatcctaaactcactcttagaattcttacttaatacaattcccagtatcccagttgattagaaattaatatagaaaatattttgtgtagacacagtttatccagaccagaggataacaggagaaatgggctcacagaggtaaacacaggaaaaagagaggacaaaccaaattatttgtttaacagaagaaatgtgccagatctcacgagttttggcttgcaacagactgtggccaggagggtcagatggttacaaacaggtaaactaaatctgattctaacaggttttagaaagtagagaggatcaggtagagtatgatagaaaagctgaatccaaagtttggacaacttgtagtagagaggcaattgaaacaaaaccatgtgtgcaaagaagatgttgttctctgaaactgaacaagggtgtcacggcagttgtgttgaaattaatggaagacacaggcccacagaggtcaatgaatctttataactcagaagcaagcgattgcctttctccagggatttaaagctacagaagatgtccttctggttttcagtagtgtgaaaatgcctccatagccaggaattaagttccaacatgaatatgagctgtcaataaaacaaactaaatgaaccgggacaattgggttaaacttttgggactctgcctacccattctgatcacagattgccaagatatcagataagatgaaattacagcgtgagctcttcatgtgtacactaaaaattttaggtattttgtccaagtaaatgaatccttctgggcctctgttcaaggttgaagtaatcagtaggttactttgtccctcactggctttgataactctattatgagcccattttatttggaatattttcatatttgatgtatacttgattgtccgtatcgctttttgatatccaaaacgtggatttaaatcgcatgccttgcaaaagtcgacacagaagttgcttccccatttattgacgcaaatcagagttgaaaatgatagatttcatagcattgtttttattgaagatgagtattagattatgtgggtaaggtgttgctttccaacctcatggtataattaaaccaatctcctttccagctcccctctactttgggggttctataatctttcttttgagatttgttgagattgatcttggaagatggaagagaactattctatctgggccaagaagatgactttataatgactgtattatatttacacaactttctttagtgttaacaaggacattgactacttggccaacattcaattaaaagatgtttaaaagcaagcctatgttgcagttcctctaaatttttccataaagaaaggcccacaatttccagtgaagcataaatcactttggaatatcaagagaaaaatgaaaatttttattttagaaacttttaaagaaggataccctcaggcctgtgtaaagattgggaaatgtagagcttaagactgtatcctgtctgtgctcccagcatttcactcataactttttactaaagcagccaactttccaatgaactctaggcagttggtttgtagatatgtatttcagtcgtgtgtgatatgaatgtgaaataatgcttctagaaacagtaagttgagacacaaagggttagagctcttgtgtatactttcctagaaaattcactttcccagaaaactcccttcaaggctactggagggtttggcattggtctttgaaatcagggtacatttgggactctcccaacattttcagccacagagattttttctcttataagtgctcctgataaggagaaggtacttagtatggagattgagaatctgaatttattggctataatgccagtgatgaactcaggtaaggaagccctcacaggatgcctattaggtatagtagtgaatccctttacgacattatatcacatggatgctaccttagtttacctctctgccaaataattatccttacgtgaccctcatgtttgactagagaattacttgagctgtttataattaaaggatgaataaacatttagtgatagcttttgatatgtgtgtgtgtgtgtatgtgtgtgtgtgtgtgtgtgttggtatggggaggtgaacagtgaatgttcaaccaaatcttatcaatgaatatcttggccaccaaaatttaatttgattcaattcaatatgtactttgggagaaccatgaacactttcttttttctttttctttttgagacagaatttccctctgttgcccaggctagagtgtaatggcatgatctccattcactgcaacctctgcctcccaggctcaagcgattctcgtgcttcagcctcctgagtagctgggattacaggcatgtgccatcatgcccagataatttttatatttttagtgaagacggggtttcatcatgttggccaggctggtctcgaactcctggcctcaagtgatccgcccgcctcagtctcccaaagtgctaggatgacaggtgtgagccaccatgcccgtccacatgaacactttcagaccactggtttgaaaggggtgctgcttaaagccctatagcaggaatttacaggatgccattatacccaaaaatttattgttcaaatttagttcctggtatgagcttattatttagcaaaatgtaacaaaaaaaccatcctagttgaaagttcaactacatttttaaaggaatttctattatagagataaagattgaaaagtatttgagtcagttcagaaaataggaatgctgctatgtgtccttaatgactggggtcattgataaatgatgggtaggtagcaaaatgcaaagaagaagctataattttctgtttcccaacctttttatgttggccggtcttgaaatactctctatcttgtcctcacggagcctgtgaagtagagaaaaacactctgacctttatctactttcgcttcaccttttgttcttccacagtacgttgagtgcatgaactttactctgactctgtgctgtgggctccttaagtaaaccaattttccaggagcagatcattgttaacattctacatttatggcctgtaagattctgctctgcttcaagtctatgagagaggctccttcttctataacaaatatatactccttaggtcactttccaggttcttcagaaaccacccacacattatttctcttccccagtataaacctaccatcctaaccagcccatgtatgctcaccatcctacacacgccaggtgcccagtctgatcttccagcccttattcatgctgcttcccttttcagaaatactatctgcctctcttgccttcatctagatccttctcattctttaaggcccagctcccctttcttcttgaaaactcctttaactactccagactttagtgatgttctgttctctgaactgtcatcagatttgttgttaatgttaccaaattttgttcttaattgtctgcattgtttgcagacatatcatatatgttgttcttacctccccaactaaattaggggcttcttgagtgcagaggcagttccttaaggttatactaattcccaagaagcacgtgatacagatctgtgcaggtagttggtatacaaaacatgtttgttgattgattggtattttcctatattaatatttttaaaggttttacttgcattgatattaaatatttgttgattggataaaatgaatgatggaatatatttctttgtttattttctgcccctctggccagtcctcacctgctaccactcacttgaatgtacaagtcaaaggacagggcttttgtgttgttcacctttgtttccccaggacctagataagggcctgggccatagtggatgcctgataaatgtctgctgagtgaattgtcagcaaaatcaccccacgtatattaaatggaatcagtcttggaacccatttagtatttcattcatctcaaatgcttgagtattataggattggaagtgccaaatgtgtcaagcttcctgttgtcttcaagttgaaatccagtttttggtgaaagaagaccttttaatggcactgggatttctgtcacatgcacatacgcaagcacttaatgagtgtgatttaataacaactatgtttaggatccaggttttcagctgttttatattaaattgggctagtttaacatatttaagtggtggattctgggtgtagagcaagatggtagaataggaacagctttggactgcagctcccagcgagatcaacttagaagacaggtgatttctgcatttccaactgaggtacccagctcatctcactgggactggttagacagtgcgtgcagcccatggagggcaagctgaagcagggtggggcgttgtctcactcgggaagcacaaagggtcagggaactccctcccctagccaagggaagctgtgagggactgtgctgtgaggcacagtgcattcaggcccagatactatgctttttccacggtctttgcaacccacagaccaggagattcccctgggtgcctaccccaccagggccctgggtttcaagcacaaaactgggcagccgtttggggagacactgagctagctgcaggagtttttttcataccccagtggcacctggaataccagtgagacagaactgttcacttctctggaaagggggctgaagccagggagccaagtggtctagctcagcggacccccacccccacagagcccagcaaggtaatatacactggcctgaaattctcgctgcaggcacagcagtctgaagtcgacctgggatgctccagctttgtgaggggaggggtgtccaccattactgaggcttgagtaggcagtttttccccacagcgtaaacaaagccacctcaaagttcgaactgtgtggagcccaccatggcttagcaaagccactgtacccaggctgcctctctagattcctcctctctgggcagggcatctctgaaagaaaggcagcagccccagtcaggggcttatagatgaaactcccatctccctgggacagagcacctggcagaaggggaggctataggcacagcttcaacagacttaaacgttcctgcctgctggctctgaagagagcggcagatctcccagcacagtgcttgagctctgctaagggacagactgcctcctcaagtggggccctgacccccatgcctcctgactgggagaaacctcccagcaggggttgacagacacctcatacaagagagctctggctggcatctggtgggtgtcactccgggacaaagcttccagaggaaggagtaggcagcaatctttggtgttctgcagtctctgctggtgatacccaggcaaacagggactgaactggacctccagtaaactccaacagacatgcagcagagaggcctgactgttagaaggaaaactaacaaacagaaaaaaatagcatcaacatcaacaaaaaggacatccacacaaaaactccatccaaaggtcaccagcatcaaacaccaaaggtagataaatccatgaagatgaagaaaaaccagcacacaaaggctgaaaattccaaaaactagaatgcctcttctcctccaaaggatcacaactcctcgccagcaaggaaacaaaactggacgaagaatgagtttgatgaattgacagaagtaggcttcagaaggtgggtaataacaaactcctccaagctaacggagcatgttctaacccaatgcaaggaagctaagaaccttgaaaaaaggttagaggtattgctaactagaataaccagtttagagaagaacataaatgatctgatggagctgaaaaacacagcacgagaactttgtgaagcatacaaaagtatcaatagctgaattgatcaggcagaagaaaggatatcagagattgaagatcaacttaatgaaataaagcgtgaagacaagattagagaaaaaagaataaaaaggaacgaacaaagcccccaaagaaatatgggactatgtgaaaagaccaaacctaagtttgatttgtgtaactgaaagtgatggggagaatggaaccaagctggaaaacactgttcaggatattatccaggagaacttcctcaacctagcaagacaggccaacattcaaattcaggaaatacagagaacaccacaaagatactccttgagaagactaaccccaacacaaataaccgtcagattctccaaggttgaaatgaaggaaaaaatgttaagggcagccaaagagaaaggtcgggttacccgcaaagggaagcccatcagactaacagcagatctctctgcagaaaccctacaagccagaagtggcggggggggggggggggcaatattcagcattcttaaagaaaataatttacaaccaagaatttcatatccagccaaactaagcttcataaatgaaggagaaataaaatcctttacagacaagcaaatgctgagagattttgtcaccacctggcctcccttacaagagctcctgaaggaagcactaaaatatggaaaggaaaaaccggtaccagccactgcaacaacataccaaattgtaaagaccatcgacactatgaagaaactacatcaactaacgggcaaaataaccagctagcatcataatgatagtataaaattcatacataacaatattaaccttaaatgtaaatgggctaaatgccctaaacaaaagacacagactggcaaattggataaagagtcaggacccatcagtgtgctgtattcaggagacccatctcatgtgcagagacacacataggatcaaaataaaggaatggaggaatatttaccaagcaaatggaaagcaaaaaaaaaaaaaaaaaaaaaaagcaggggttgcaatcctagtctctgataaaacagattttaaaccaacaaagatcaaaagagacaaagaagggcattacatactggtaaagggatcaatgcaacaagaagagctaactatcctaaatatatataaacccaataaaggagcacccagattcataaagcaagttcttagagacctacaaagagacttagactctgacacaataatagtgggagactttaacaccccactgtcaatattagacagatcaatgagacagaaaattaacaaggatattcaggacttgaactcagctctggaccaaatggacctaataaacatctacagaactctccgtcccaaaccaacagaatatacattcttctcagaaacacatcgcacttattctaaaattgaccacataattggaagtaaaacactcctcagcaaatgcaaaagaaaggaaatcataacagtctctcagaccacaatgcaatcaaatgagaactcaggattaagaaactcactcaaaactgcacaactacatggaaactgagcaacctcctccagaatgactacaggataaataatgaaattaaagcagacataaataagttctttgaaaccaatgagaacaaagacacaatgtgccagaatctctgggacacagctaaagcagtgtttagagggaaatttatagcactaaatgcccacaggagaaagcgggaaagatctaaaattgacaccctaacatcacaattacaagaacgcgagatgcaagagcaaacaaactcaaaagctagcagaagacaagtaataactaagatcagagcagaactaaaggagctagagacacgaaaaacccttcaaaaaaatcaatgaatctaggagctggattttgaaaagattaacaaaagagaccactagccggactaataaagaagaaaagggagaagaatcaaatacacacaataaaaaatgataagggggatatcaccactgatcccacagaaatgcaaactaccatcagagaatactataaacaccgctatgcaaatcaactagaaaatctagaagaaatggataaattcctggacacatgcaccctcccaagactaaaccaggaagaagtcgaatccctgaatagaccaataacaaattctgaaaatgaggcagtaattaatagcctgcccaccccgaaaagcccaggaccagatgaattcacagccaatattctaccaggggtacaaagaggagctggtcccattccttctgaaactattccaaacaaaagaaaaagagggactaatattctcagtaaaatactggcaaacctaatccagcagcacatcaaaaagcttatccaccatgatcaagtcggcttcatccctgggatgcaaggctatttcaacatacataaatcaataaacataatccataacataaacagaaccaatgacaaaaaccacatgattatctcaatagatgcagaaaaggcctttgataaaattcaacagcacttcatgctaaaaactctcaataacctaggtattcatggaacatatctcaaaataataagagttatttatgagaaacccacagccaatatcatactgaatggtcaaaaactggaagcattccttttgaaaaccagcacaagacaaggatgccctctctcatcactcctattcaacatagtattggaagttctggccagggcaatcaggcaagagaaagaaataaattgtattcagataggaagagaggaagttaaattgtctctttgcagatgacatgattgtatatttagaaaatcccatcgtctcagcccaaaatctccttaagctgataagcaacttcagcagagtctcaggatacaaaatcaatgtgcaaaaatcacaagcattcctatccatcaataacagacaaacagaggcaaatcatgagtgaactcccattcacaattgctacaaagagaataaaatacctaggaatcgaactcacaagggatgtgaaggacctcttcaaggagaagtacaaaccaatgctcaaggaaataagagaggacacaaacaaatggaaaaacattccatgcccatggatgggatgaatcaatatcgtgaaaatggccatactgcccaaagtaatttatagattcaatgctatccccatcaagctaccactgactttcttcacagaattggaaaaaactactttaaatttcatatggaaccaaaaaagaacccgcatagccaagacaatcctcaacaaaaagaacaaggctggaggcatcacgctacctgacttcaaactatactacaaggttacagtaaccaaaacagcatggtactggtaccaaaacaaatatatagaccaatggaacagaacagaacagaggcctcagaaataacaccatacatctacaaacatctgatctttgacaaacctgacaaaaacaagcaatggggaaaggattccctatttaataaatggtattgagaaaactggctagccatatgcagaaaactgaaactggaccccttccttacaccttatacaaaaaataactcaagatggattaaagacttaaacataagacctataaaacccctagaagaaaacctaggcaataccattcaggacataggcatgggcaaagacttcatgactaaaacaccaaaagcaatggtgacgaaagccaaaaattgacaaatgggatctaattaaactaaagagcttctgcacagcaaaagaaactctcatcagagtgaacaggcgaccttcagaatgggagaaaatttttgcaatttatccatctgacaaagggctaatatccagaatctacaaggaacttaaacaaatttacaagaaaaaacaaacaaccccatcaaaagtgggtgaaggatatgaacagacacttctcaaaagaagacatttctgtgatcaacaaacatatgaaaaaaagctcatcttcactggtcattagacaaatgcaaatcgaaaccacaatgagataccatctccagacactggagaggatgtggagaaataggaatgctttttcactgttggtggatgtgtaaattagttcaaccattgtgggagacagtgtgacgattcctcaaggatctagaaccagaaataccatttgacccagcaatcccattactaggtatatacccaaagtattataaatctttctgctataaagacacatgcacatgtatgtttattgtagcacgattcacaatagcaaagacttggaaccaacccaaatgctcatcaatgatagattggataaagaaaatgtggcacatatacaccatggaatactatgcagccataaaaaaggatgagttcacgtcctttgcagggacatggatgaagatggaaaccatcattctcagcaaactaacacaggaacagaaaactaaacactgcatattttcactcataagtgggagttgaacaatgagaacatatggacacagggaggggaacattacacaccacggcctgttggagggtggggagctaagggagggatagcattaggagaaatacctaatgtagatgatgggttgatgggtgcagcaaaccaccatggcacgtgtatacctatgtaacaaacctgcacgttccgcacatgtatcccagaacttaaagtacaattaaaaaataataatgataataaaactttaaatggcatttattagcaagttcttgtactatttaaaaatggacacatctttttaaaaaagatgtgccagtaacattattttatccattgctaaagtgattttcaaaagagacactgttgcacctattttttccttttatgattatatgtatgaactgagttggggtgtttaattgttttgcaaaatagaataagttgacttacctgctttttgaaaaaagacatatggaatttactatcccaggagtattatgaaaaaatgcagcaaagctttaaaaaaaagttaatgaaaaagttctgtaggcaaaatatccttattttttacgacaattttttttttctggacagaagacttggttttccataggatgcctatgaaatcatggtttccatctgctgtgctgagcacctcttatattccttacagaacgtgtggtggtggaccactaacgaaaacacgtgagggaaatagaacttgaagcaaatttgaaaacttgaaggcttttaaatcttgtcagccatccaattcaagcagtgtatggcaggtgtgtcatatatttgtagagccaaaataaatgaccacaagaaattcagaagtaatacagatgtaaggaaagcttaaaatggaaacaaagaaaacattgttttcattgtttattcaggggttgataaatgcatttaaaggaagacctctttagtgattggtttaggtgccaaatatctttgtgatcttctggaccaggcactggcagtgttcttgttatgtgctggtttgtggaggggaggcaaaagaaagtaggagacaaggaaagtataggaaaactggggcaaaagtagctgatggcagtggccttgcaaacagctctaggacaagttactgtttccattagattagaagaaaacatgtctttcttctcttgttttactttcaagataacttccatgagaatgtgaattcttaaaaataataaaatctgcagttcttttttttcaaaggttgcacttaatagagaatctattatgtatgtaattttaaaatataagtttctacattttccttatattgtgtcttgtctaggactcttatagatgagcatcaattcaaagtcaaaattaactattttattttcatggaagaatacttatgaaaggtttcttcctgtggatcagagagaaatctcccccacccttactcccaccaccagttcagtttcatcatacctattattgagcaaaaacattccaaagatgaacatactatccaaagacacaaacagaaatcatctgggaatttcatatttttatacgatcttgttgctatcaaatggacaggaataggtcattctttgtggagaatgaatgcactgtatatgaagaatcctagatattgtcatcccaatttgaaggctaggattgtgagaaaatattcaacttcacaggtccaatcgattcaaaactaacagaggtggccaaagctcagctagcctagaggatgcccaactgacaaaactcttttctagtgtgatacaacagaagggttaatgttaaattactatttaatctttatagttttcaaaacaaaaaacctggggaatgctactgtaacccccagtgacaagatagagccagcaatgctgagcaagacatgatctctatgctcaagcagtttaaatctaataagggagaaaaggttaaggggcccagtcagcaagcatgaggaagaatatgatagatgccataagagtaacacagtattgtggtatggttaagtaggtggggggggggggggggggcggactctggagtcaggctgcttgagtttgaaccatggcttgatgacctgctagcttcatgaagttgtgcaagttaaattactcaacctttctccaccctcatttccccatctgtaaaatgagaacagtagtttccctctccaagagaaatatggggagcaataagtctcaatgtaattccaaggtattcctcttgatgacttaacttctatgcagtagtgtttgagtgtgcgtttaagagtattcttaaatcatagtgcttggtgtatcattcatggtgagttagaagtttgtactgaagtcagaattcctagtgtttacttccagctcttcataaattctaatactcatttcatttccttgtacatcaagttacttctctatttaaatgagcatagcatgttccacgggagcaaggaccttatcaagtcttgttcagtaactagaacaatgcctggcacatagtagatgctagataaatgttggttgagcacaacttacggagattatgaaaatgttgatacatcaggcatgaatgtaattctgagaatgaaccataagtactctacaaaaatgacaggtttctcttgtttaagattcccaggagagataagcaatgctatctatgacatttctcagctagaatctgtgcatgagatttggagtcagaagatcttgcctggagtcatggctctaccaccaggctttgtaacttcgaataagtaatttaacctctatgagcttcatttcagtcatcagtgttttgggttatcacttatgctttagaatatttttgagagatcgaaacatcaatgaaatacaagcacttgtaaacctgcaagtacaataaagtacaaatgcactaagaaatggtaacttttcatgttctgctttagaggactataaatcttaagaagcagaactgtattcctattacttaagtctaaggaagtgaagataaagctgtattatccccaaaacaaaactgatcttaagaatacagagacaactgacacttctccctgtcttttatacatagacaaacagagctgcatgagagaacttctccccatctttgcgccagctcccttgagtgttgcacttagtttcttctgagtcagccgctaaaatagttccagtctgaaggaagacatgtggtggctagaaatgctttgaagaattggccagggcttcatcataggttacaggccaaaatttttaaaaagaaaaagaaaaaagaaaattccttcttcccctatctctgaataaaatgcatggccagaagccaattcttttttgcagttttcatttgtaaaagttcagaattcacatgtatcatttattatgtttctatacttgatggacctctgtagaaaaagtctccagaccctcactgtttatgttttgagcagatcttgtatagatagatagatcttttttgtcattttccttccaaatgtgttcaggcagactatataattgggttgtgggattaggttggaatatcatactctttcagagtacttttcataatacattaagtcagttacagtgtggaaatgaatttactcttgaaattcaacttagtaacactactgagaaaaatctctggctaaggagaaactcagaaagcttgggatagctaatcccatcactagtcaggctgtttttgattgtcatgtctctttagactttttaaaaaatacataacagctttattgggatgtaattcacatattacccaattcatctatttaaagtgtacaattcagtgactgggttatggtatttcaaaaatcatgcaatcatcaccactatctaattccaaaacattttcatcaccccctaaaggagactctgtacccattaagcagtcattcgcccttatcccctcttcccatcccctggcaaccactaatctaccttctgtctctgtagatttggctactctgaacgtttcatataaatggaatcatacaatatgtggccttttgtgacagagttctttcacttaacataatgttttcaaggttcaaccttctggtagcatgcatcagtccttcattcctatttgtggccaaataacattccattgtgtggatataccacattttgtttatccattcatctggtaatggacacttaggttatttccacttttggctattatgaatagtgttgctatgaacattcatgtaggaggatttctttatcacttgttttcagatactttgggtatatactgagttgcggaagtgaggaactgtcagacagtttgccatagcaactgcaacatttcatattcccagccacgatgtatgagggttcaaatttctccaatttttctgtttttaaaattatagttagactaatgagagtggtcatcacattgtgattttgttttgcatttctatcatcaggttatttttaaaatacttttcctagaagtcatttgcctgcaacttcaacgctctagaacatggtcctgcatgtaacttgatgcagaagggcctgcatagaagtaagagcagtcatagaacttctgcaagaaagctctgcatcttgttccacaggcccctcattcagtgggtaactaattgttattcaacattcatgactggctattaggttttttggaagagagctggaaaattcactgtggtagatattgtgacagagaagtgacagtggatatgacaacagtctgccacttaaagaggagaactattatacttcctaatacattaatggtcccaagtctttaattagaggccaaattatgtttgatattttttaagaaggcaaagttacacagaatacattttagaatgatttccatgaagaatgactcagagaaaaacatgttttgctcttgagtagataagcttgcttgaactttctaggtatttaatttctcaatgatatttgaaaagtcaggtgatacttaattgcatcttgaatatggaaaagacaaagagaagatttagattttgtaaaattgttgaaaatattgttgaaaaaattaaatgaaatatttttaagaactttaatctcactttttgatgaagttaacagttatttgatttttctaatactcagagctcacttttgcgttaatgctatttcagtatgtgtttatggcatatgccaataaattaacctttcctgtatcttctcagctgttgctagaaattgtagctggttcacactgagttaaactgcatactttaaagctgcataatatttaatctatttcattaaacagcacattctgtctcacttgtttgtatatgctgaaaccttcttctgagttgctccaatttcccttcatagagactaaggagcctacacagaaaaaaaaaaatcttttcagatgacttttttctttatctgaagcacattttacgtttccatcctccaccccacctcatgtgaggttgttgcctagtcttgtactacaacagtaaatctaagcagttgcttgcttttactatacagttttatactgggaaatgccctttttattgacaatggctgactgtactatgttgcactgtcagtatctagatgcttcctgttttaaataggatatagttacttcttttccaaatctagagtttgaaacggaagcattgtattattttagctaattttatttatttttttcttgcaggttctgaaaagtgccttttctgaaaactctgctgcttggattctactctagagctgtctctttataaacccctctccctaccataccgttccctgccctctccacctccccgccgaacctggtgtgcttgtagtttactgtcagcagctggtccatttcttttttctgtgattctcaattttcttagtcattttccctccacttgattttgcaacgaaactttttttgggttctaacatccttcccaatcttgttatttaaagctaataaatagggagaaaaacttttctccccctgatctgagaccattccacaaatcgaagggcagccagcagcatatgttttttgcaagaataattgaaaacatcaactgcagagcccagaattcttttgaaagtctgccggttatttaacataaattcggcaaaggaacaaaataaagcattcattatcttaacagttggcttcttaagagttggtctctaatttcatttttagttattctgatagtttttatgattggctttttgtttgactagaccagatttgactttaatgaaaacctaagtgttaacaaatagacatttcaccaaagcaacctgttatctcttcgcacttagtttgaattcatttttaatcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaaggtgagtcccatctgaatgcacataatttaaatttgttgatttctatgttttttgaaatatgatgtgctttgaaatgagtaaaattaataatagcatgaaagtgataaattttgtttttttaacaaaaaaacagaatgtcaagatagaaggtcttaaagtcagaatgtcttaacgacaaaatgtcttaagtctttgtgtttgtagagctaagccaagtctaaagctcattccaccaaagaccacttaccacttatcaaaacagatatacttaaagaataaaaattgaagaatttttgtaggagtgagggattgtagccttgctatcgtttacttttttgtatatgatttagatgttacagtgatcataatccccatgtaacctagagaagcccttcactgaattatagcatattatccatagtaccaaaatgcacttaggagggacttgtcagctttcagaggataactaaagtcagactgagggagtataagggttccagaaggaaaattatggcattttgaagcgtctcaaagtatattttgaacctttaacttaaacgtattgctacaaaactaggttcacttaattttcctcctggacagatgattgaccaatttcagatttgtgagtatattttgtaaggaaagtcctattactaaggtcatcaagcctgagtattacatactagattataaacaaaatatgaggccagatgaggtattatataggacaggatgtatatgattgcagaaaaagaaaatgcactgattttcatgtgttattcatagttatccttaaattaaggataaaaagtataaattaaaacatagaagcaataaattataatggatttctggtttaattaagatttgctacaatgcatctgagacttttttcaaaatatgtcaaaatgaattaagcttaacaagaactttttcagtttcttgatattgttttaccttcatcatgaccaattttacctcattaacatttttatttatggctgcattggctaacagagatgtatcccttcgtgtgatggtttcctcaggaaacattttcttaagcgatatacaggttaagtatctcttatctgaaatgcttgagactgaaagtgttttcgattttttggattttagaatatttgcatatccataaagagatatcttggggatgggactccagtctaaccatgaaattcatttacattttatatacactttttacacatagcctgaaggtaatgttatacaatattttaaataattttgtgcatgaaacaaagttgtgtacattcagctatcagaaaacaaaagcgtcattatctcagccacccatgtgacatcatgttgacacttaaaaagttgaggcttttggagcattttatacttcaggtttttggattaaagatgcttaacctgtagtacttaaagggttacttttacttatttcgtgattactagttttttgttttttgtttttttttgcagaccattccattttaagaatagaaacttgttattgtaaagataaaggtaattcctaccattgaaaatctctgaattgcttttatttgtggtagacattatgactaaagaacttattttgttttcttcattttggtttcatttaagtttcatctacaattattttgtgtattatttaaatctgcagctacaggattgggcagtgccttgaagtggaaaagcatactgagttagttgggggaaaaatgaggtatctttcatctggtccatatagagggtcaggaactgcagtagaaactttgcattgttgtttcaggagatctggggtacagtcccagcctcactactgtatctgacctcgggcaacttaacctcacaatccttgagtaacttcatctgtaacagatagatagtatcttctgtacctaacttctgtgattattgtggagattgcagtaagctagtacaaatggaaaaccatatatcaatataaaagtgaattaaataaaaggttttcttcctatcaactaaatgtttgttgtaggcattctttaacaaagttctatttagttagggcttattatttaaaattacaaactcatgttccaaatgtacatgaccaaatctagttgctgtgtgttattagttgttcaagctaagtataactgtttttatggttactctgatatagagttccttgcaggctttgtaaattctatctttccaaacatcatagaatgtgaaaggagacatgtgatcttcctaatcattaataaactcaggtcagtaattccatttaaaggcaaaagagtgccataaactaaacattttgaagaaaagtactagggaaggtgactgtttacaaaatgcgtgctgcactacaactttagagcttggaaggtgtttaattcagagacaaaatagataatagccaatgaatattaataagccacttaattatttaaataagttgtctactcactgtatctagtgtttttaaagtaatgtttgcatcatgttaatatcctgatgaccagtcacacagggtaaagatgatttacataatccttacattctcatattttagtgaaaaccttaatatttcaaatatgtaaagccgttcaaacaattacttaatttgccatttagatagcacattaaacaaagttccatgtctgcacaagagctttgtagttcttatccatgacatgcatgaaggttaaattaagttgagggtaattgacctatgtgcattgtgctagtatcatatctataatatacaaataacatacctcagtggttactgcagcatttcctacttctcctgagtttttataattgaaacactgttgaacttcatctgtgtactatttcttctctcatgagtgattaaataactgaaacaatcatttgatgagttttgggctgctgcttttgtttttgttttgttttgttgttgttgtgtaagaattctattagtactagctactctaccagatgatggttattgccttaataacaggtacaacagatacaatgttctaactcacctcataatgagggaatgttatgaaaataagaagggcaaattggatggctgattgtgtattgtgctgaagtgctgtgcctatcaatccatgaatgttgagtgctcagtgatgaaggcagcaccatcttcaaatggaaatctagtgtagtccatggattaatttccagctacatagaatggtctcatatcatgttggtatgcagctgtttttgactctgttgccttgtggacttggcataatctgtctccaaagttttcttcaaagtatcgcttaatccattctatgccaatttcttgatattacagtttgccattgatctaggttggtatttttagtgaatgttccttggatttaacgaagggtcatcatttttaaaacgaaatcaatctttgtgattgttttcatagccaagttattctgcttcagcaatatcatgatgtcttgaacctttccctttatacttgaagcaatgtgttatcagtcactttttatccaggaaggatataaatgttgtcattatttcattatgacagatcaacacccatcacaactgtccacccctcttaccactttgggtagttttgtgccaagaatttcctggtaaaggccatagcagcagacatagttagaggatactcaagctaacctatatacattccttaaaaaatgggaactgggtaaggaatgcacataaaacagtcacatgccatgtcttcaaaatcacatatgatcacgagaaaaataatattttgacaagtgaaaccttgtcaaatattataagcatatcgatatgaatctatccttgtaggtcaaactggcccaagttaccagtatattctgcaatagcaacactagtcacagcagttttcattagtttaaaatttgactatttttgactgaatacttactcatccctatttgccaagggaaagtttaccagaaactagatgcctagcaacacaatcccaagggtcactggattatgcaagacttagcaccatttatcagctccatcagagaggtctgtctacactataaagacacataagcagcagctgtcatcttgagagtcaaggaaaataacattttatttaaggatctctattttctatgatgctaacctttaaagggaagtatctttgactggtaaaagtcaatgctattttggacatttcaaaaacctcttttgaaaggaaaatagaattacaattataggttggtgcggaagtaattgtgttttttgccatgaaagcaatggcaaaaactgcaattacttctgcaccgacctaatggtacccaaacaaatacatattgatagttcagcctcgccttttaaacattttattttgaaatattaataattttaggcttacagaaaagttacaaaagtgatacaggaaactcctgtatactttttatccagattcccctaatgtcaacaacttacatgccatgcattgcacagttatcaaaaccagggaattatcactggtacaagattcttaagtaaactcaagaccttatttgaatgtcaccaattttcttcctaatgttatttttctgttccaggatccaatctgggatcccacatggcatttattccttatatctccttagtctcctccaacctgtgacactttcccagtctttccttgtctttcatgaccatgacacttaggatgaatactggtcagttattctgtaaaatacatctcaccttgtgcttgttgaatgttttctcatgattagactgagatcatgtggttttgacaaataaaaaagaaacccacacgcagaaatgatgtgcatgacatctgagggtatgggatattgatatatcttattcattatgttaactttaattagctggttcaagtggcatctactggatttctccactgtaacatgaccagtttttcttttgtaaaaactgataactatgtcccccatttattcatcatcccctacaatatgccattgatcgtaatgggcatcccaatgtcctagatgttaaaaagtgaacaagtgttcatcttagaagtgattggtaatgtacttctataattatagtcaattaagaaagagagcaagggaaaatggaccaagagcatgacagagaaaatagcagcaacaagccactggaaagacagaacactggagagtgagcagtcctagaagtgatgtgatatgtgtgtgcctatcatatactactgcagagtgtgacagctgtccccttcttgttcatggccttgggacttagccgtgaaccagaaacagtccctgcctccatggtgcagacattctcattgggagttggaggaggagcaggtaaaaaataattaaatattcaggataacaatacattgtcaggtgtgaggaaagggtgcagagaatggcaggggctactgttttagatacagtggccaggaggcctccagtgaggtgacctttgaggagaggcatgcaggagatgaggggacagtgaagaggatttctaagaacattccaggcaaagagaatggcgacagctaaggccctgaagctggcggcagcctggtgtgtgtgaggaaactcaagatccccagcgtggctggagcagagccatgaagggggagggcagtgggagatgagggcagggaggtcccgggggtggggagatcaggtggggctctgtgtatcatgctgaggactttggatcctgttccaggagctggaaaggttgacataatcgggggaaagcaagcccacacaaagcagaggtgtctagtctttatattttttaagtggaaaagagaataatttccacgaagacaaataactcctgtttataggtgaagtagaagtcaaatggtgcccaatccctattcttcactcccttatttctgtgacttgtacctcaactccagttcataccccagtgatggggaattagcaataaagaaatctcatgtgaggaaagagttaatatagcaggtttggtggcttactctttgcatgtctcccagggaaaccttaactatcccctgggaatgtggccaccattcattttgtcactgattggttattgtgttgtatacacctggaacaatggaccatgccataacagcttgtcagggttgctttgctcaagatcaagattgatgactgattcattgttagggtcctgcattacagttgccatggccagttggtagcaggctgtgcatatgtgaccaggacccatctgcacctcagaccttgagactagaactgggcttcccagggtggagacattccatacatgcctctgtagtttgctgctagagagagagagtccttgtgcatgtggcttcgaactaggaagaacattggaagcttgtgctgggcttctcttgattctactgatacgtatatttttcctgttacttttcctctgtattccaagctgtaataaattttagttgcgagtgtaagttgctattgagtctgtgagtcctggcaaatgtcaaagaagcttttctgtatgttgttatttttcatacattatttgcttgattttttttttttacatttttctgttttttatgagaagggctttttcattttgtttctattttttaaagtttaatttttgaatggatattttcataattcaaaaatttagaaaaacagtcaactaatgagtacatcaacaaaatatggtatatacatacaatgtaatattactcagctacaaaaaggaacaaagtactgatccatgctacaacatggatgaaccttaaaaacatgatgttaagtgaaagaagccagacataaaaggtcacatattgtgtgattccatttatatgaaacatcaagagttggcaaatccatagagacagaaagcagattagtggttgccagggtcttgtgaagggcagtagatgggtgagtgaggggtgaggggtatgggaattaactactaatgggtacatggctttttttttaagggtgatgaaaatgtcctggaattagtgatgatagttacacaactttgtatataaatgtgttaaaaactactgatgtgtagactttaaaagggtgagttttatgatttgtgaattatactcaatgaaaaagtttaagaaatttcaacgatagtagagtatgcagcgaagttttcccctcatctcttttccccagttaatcagttgacctccaaactgatattttggttttccctctcccatagatattatatatatacatatgagcaaatatatccatacttattttccattttcacacagatagtagcatactgttttcctccttgctttttttgagtttaaaatattaacagtaaaaagatgggaaaagctatgtcatgctgacactaataaaaagaagcctggaggtgctatatttataataaagataaaaagaattgcacacaaatacaggattctagttagtaaatctgttcctcacaggcatatgtaagtatgtagatactgaggttgaacaaataaatgtatatagagtagataatgagagcctattttctcactatcagaggaaaaaagttaaaaataaaaagggaaggttaggatgaataccgtggtgtggattagaaaggacacatgagtatgtatacagatagatacaggaatagatattgatctgtgtgtatgcatgggttattatgtatgctttcatttcctagctctgtcttgggaagccctagaagcaattaacaccccaacagcaacgagtatacttagtacccacatctttgtgtctaatatcattctccaataaaggaactcgggatctttggaataatggctaattctggacagaagcagggaaaatacaagatgaggctgtaatgtcttttggtgtaagaatgtaagaaagtgctagagaaagggtgggggcatgacaagacagcatagtagccagtctgaaggagctcccaatggctgaagttagaataacttgagcaagaaactaaatgatgacagtattgaattatagctcatagaataaaatagatgcccatgagtccatagtttacaaaaaaaattgaataaatggataagttggggagaagggacaactcctccttacagaagaattccaattaataaatggagaacaaatgaaggaaacacaaaatcactagtaggcaaatgccatggtaataatggttgcaggcaagatccactgatatatgctgaaatcagtgggtaaaagttggaggagaaacaggatatttgcattgtcccaaagtatttctcccaggatatttatcaattaaaaatagaacaggcatggtctatttcatttatcaataaaaaatagaccaggcatggtggctggctcatgcctttaatcccagcactttgggaggccgaggtgggaggatcttttgaggccaggagtttgagaccagcctgggcaatatagcgagaccctgtctatacaaaacatttttaaaaaaattaactgggcataatggtgcatgcctgtagtcccagctactcaggaggcagaggatcgcttgagcctgggagattgaggctgcagtgagcagtgattgtgccactgcactccagcctgggcaacacagcaagaccctgtttctaaaataaataaataaagggaaaatagtcactttacagtggagaaacccagcagatgccactttaaccaggtgtttaaggttaacataatgagtgataagatatatcaatatcacataccctcagataggatacacaccatttctgtgatgttcctgccaaaaagacatggtctcggtctaatcatgagaaaacattcaacaaacacaaagtgagaggcattttacagaataaatgaccagtactcatccaaagtgtcatggtcatgaaagacaaggaaagacttagaaagtgtcacagattggaggagactaaggagaagtgaggaataaatgccatgtgggaacctggattggatcctagaacagaagaacattaggaagaaaattggtgacattcaaataagatctcttgttaagagtctcgtaccagtgttaatttcctggttttggtaattgtgttatggttatgtaagtatttaacagtaggggaatctgggtgaagggtatacagggactccaggtattatttttgcgatttttttgtaagttcaaaattatttcaaaatgaagtattttaaaagttagcttttttagtctgtcctttgaggctcagaaatattgtggggtattgtttcttttcatttttattcttaaaaaaaaaactttgagtatggggatgagaaaactctaaaatctagtcatgactgatcatgagattgcccccaccaaaagttcgatgactcagatatcttcatagttaagaaagcgctcatacatataaaagcacttcacaaacctagcaaacgaagaattttggctgtagaaggaagaacgttcagttcaaaattgttgccatttacagttgggtaaactggtgatccgttgagggagagtgacttgacctagttcacatatgcagttatcaaaagagcttgatgactccggcgttcttccaatcattattcagtcttctttcctgtggagaagaaggaaatggagagaacatcaattaggctattgctttagtaaaccaaaagcatccagctcttatcacagtcatgctgctccacatgacattgggactgtctgtgaagttttctggttctcctttactttttgcactataaagtaaggcgtggataagccaacttttcctttgctaatccctccctcttttattgtttctgattcatgataatttagattaagactttattaaccttcatatttagttcatggacaattatttggataacttgttttgaaaataaggcagaagagaagaatttttagacaaagttacctaactttgtgatactaaactttgcttaattgctgagtgtcagaacactgagctgtctctgctcccttgtccatccttctccccaaacaccgcattgttgagtttgctgaccagaactggggattgtaactgtggctgtgtatcacatcttcactgcatgaaactcattgatgtctgattctgttatatactcattagtacaatgccctggccagctaggaagaaacctgtcatagatcagctgaaatattgcagtagcaattcagccttattatgggtcaagtattttatacaataatttggaatctaatccaacttatttaaagtgttgttttatgggatcatagctcaaaatcatctcttcctggccaagttgtaattgggcatctggtgagaaaagacttgggctagggccaggcatgtattccccaactactgtttgatgttaccattaatactgaccctttgctacaggaactccattaagtaggagagatttggaaattggaaatttgaaaactattatatttcaactcttttgtctagaagaaactcttagatgttagggtaatatacatctgatcctacttggttagtaaataatctcttcatgtagcatagctgaaatgaagtctttttctctatatcagattttttcgaaatgtggatacaaggtacttctgtgcatccggaaatagcaattagttcttctaggaacatgacattattcatagaacattgtttacttactgttctgtttgcccttgcagatgacctttctgcatgtaccatccttgaggtgacccttgttttcctctcagtgtgtcacttggtccctgacttatggggttatatattccagaggaatcttagctgtctgctattttctgtaaatactcttttttttcttcagtgtttattctgctacataatcggtcttcagtttcttaaatttatggttttttttttttaatttttgatgtctaatccagatttgcagtcctgcttgggttttcaatgtttttgtttctgtgccttcaattctcaccccagggtcaagttttattgctagatgtcattacaagtttatctcacattttttgccatctttcttgatattgttttctttaaagtcagtaaacaattccatttgtttttcatccttttattttctaaatgatctccagtatttggattgaaccatgttgtatctagagatagagtaaatcatttttcggtatcttgtttatgatgagattatgtaaaattgcttaatgtcatgtctaatatgttatttagttaagtagatatggctatagaatctatctgttagaaacagttttgcagctataactcggtcataggcatttaaatgtatgccttaaattggatttttgtatatcataaataagctttttttctgttgaagctcaaattttttttaacccactggaaattggtagaaaataaattaggctttgcttctacctatattcttatgagtagatagtggacaatgaaggcagtttccacgttgaaaactgtacaaaaatttgaaaatgtaaagtccacagtaatataaatgtattacatatgacaaattccctttaattccattaaatatgacaaaaaacaagacatgtcctatgtatcagccatgatttgttagctaacggaacggtagtaatgttctaatttctgtcttagcgtgcaaaaatgcaaacagaaaacctttttctgtgactttaaactctttaaccatcttttatatgcatctaaatacagtgagtagattacattgtagtatcaataatctcttagctccaaatactttttagagatctcatttttaaaaaccacattgttttaagaccacattgtcacattgtcttaatatctttgttcatcttcccatttgtgaaagatagtaaaaccgaagtaacaatttgaggatttttaatagcttcatgtactctgtgttcttgttttaaatatttcacaaatacctatcctaggagttgttccacttaacaaacttaattttttccagcttttataaaaatgtaatctctagtgtttctgcaatttcctggttattttactttttttactaaccaaaaaaagtgttctatatagaaccaaattcagtcttaacttcagtattactaacaaattttaaaaccatagccatctttaatctcccagtaccccactgtaggaagaatttgactttggaatattgtctcatttttcaaaggagcctgagaagtagttttggaaaatacctttttcttgggtgaactctagatgtaaccactgaaaatatctgaaatgaaacattctatcagcaagtggcataaacatcgaaaatgctgccttgtcacacataacagttctaacaagggctccttatgtcatgggaatcctactacctctgtttctcttcatatgagagcaagcagcagcactgaatttgtaagactatttggttgtggtttcctagaaggatttgtataaatgtcaggggttatttaatgctgaaagtcctgttaaatccattaagaattgtatgtacattcaattccccaaagaaatgattcattcaacaaacatttattgcaacctcttacttgttaggcactgggctcagtaatgtggagaatacaaagttaggaaagatgtggttcttgcctgaccttttagtaagaggttacttgtgttatatgccataagccagatacaaactaacagctacaacagtccaagggcacaggtagggactgggattatattcagcagtggtggttgaagatggagtcatggcagagacactgtttgaggtgttctttgaagaaggaataggaaggtattccaggcagaggggataacctgagcaaagatagagggggaaaactgtgatatgtttggggagttgaatgttaagtcagaatggctgaagcatgagaaatgacaccatcagcttgtgcaaaaaaaatgacagaaaaaaagagactggcaagaggaagtacctcttagaaagttgttgaagtattgaaggtatgaaatattaaggttttgatttagatggtggtggtgggaagggaaaactagcgatggaattgagatgcagatgaagccaacatggttaagtagaaagcagtggatatttccctccagcctactgaccttgtgctcatcttaacatcagatttctttgaagttgcagtgaaagtctgccatactttttgttttgttttgcattagatgctatcttgtccaccaacatatcttttgtgcctagtacacgttagggcttggaaaaatatttgttgaatgaaacatgagattgttgaaacactttgaaagagggagaataaatatgggctcaactgagaggtacacagagatctcttcatctgcagctgtactttcactcccagttcagtttttactcaaatatagatgaaaattgtatacacccatgtgccaactttcctcactcaaccacattttaacctagatttgatggcctgcaaattgctgatatttgcaaatttaattccatcccttagcattatagaaatgatatttggctaaatgctgttggatattctccaactgttacattttcagtgcttttacgttatatacggatttttttaaaaaattacttagtggccattgttaagtgttatttttaagataattagtgtgattatgtagtaatggtctagcattttttgtcttaaaatgtttgaagttgaattttacagcagatgggtagcttgcaaatcaaggtattcttggaagcataatgagtgctaataaggtgattctaatcaagtacaagctcataatcttcaaaaagggattttgtggaaaaaggtgactgcctagttcaaaaatatatatatttaaagtttaataaagaactcttgttctaaatacacaatgacattttgaaagtccaaaaagtttgaacatagaaagacaaagaaatataataatagagagggtccatgaattgacactttttaaaaaacccacaataactgtaatttagtccaagcaatatgcttttaaaagaaataggaaaaataataggaaagtaatttcaatatcgaagtttaagaaaggatctctaggcttatgtactatatcttggagtttgtacagtcagcccagtctcttagactttctccatgttcatctccattcctggataatgattgctggttttctgtacaggcgatcctgaggtcttggtgcaatcctcaataaccaagatatgattcaggtttggacaattgactctgctttcaaaaacagggaaggtgtctggaacatttgagaaaagtgtttcaacaacaacaacaacaaaaccttaaaatgatttttaaatatttagcagcattcagctggtgtcaacatttggcaatgatttccataattgtgactagcatattttaataggcaactgacagataaaacagaaccaagactgtctccccctttttcccaattcttgaggcctcactttagtggcatgtgacatttacttcatctttgaaatgataaaacatttaaatatgtttcacttatttctccccaaattttcctattgtcccactaaagaaatacctttaaaaagtgacattgcttccaagtcagagatttaaaaaaaaaaaaacagaaggaaagaaggaaggaggaaaggagggagagagggagtgggtgaagaaagaaagaagttaagagacacccattgagaaaggcttttcattctgaaatacttcagctccaataataatgtatttgtaacaaaaacataaggaaagtgtaatgaatagagtaacatactcatgaaaagagggtaatatagaagagtgggattcctccacccccaagagagaattgtttgtgccatttttatcgcatatttttcattataaactcctctgctttcgttgaagcaaaaatgaatagctgtgattaattatggcccagagaagtctcattctccccatggaacttgctcttcctcattttcaacagcaccactaaacatgcaccactagttacctttgatctccccactgttcacaacctccaagcaggcgtcaagtcctaggtcccccaccagcacaactactcatgcctctagttatgggagagagaagatttgtaaactccttgtgggcagtttccatggcataatcttcatttcttccatagtatctagcacagtttttacttttatgcaggagaggtattaaacagtatgccttcttttatcaggctacaggagcaaatgcaattcagtacattttcctatttagtgttgccagaaaactcacagctaccttttgggcccagctgcagcaattaaccttagtctagaattttgaagtttttgatacaattatctccattgttccacctttcccattatatcagtctttacagttactgtaataatcttacttcaaaaatatctttcttgaaggtcattttgaagccttttgggaagaatgtaattgtctaagtagtaagagagcaagtcaacaagagaaggggctaattccatttctgcatttattatttgcagcttataaggctatctgagtgattttcatttggacatgttaatgtattccaggcattccagtatggttaactgggggcctcagtttaaaatgggcttccagtgatactcagaagtaaaccagatgcagctggggctactcgtaaaacagaaaggaataaataacaaatacttgaaactccttagacgtttactttttttcattaggaaaaaaggagaaagggttgtatgagatgtgttttttccttacttcctcgctgcagggtgcaactgatgaacttgtattcagtgcttattttgaggtttagtaatctattgatacttcggcttttgatcatctgtgctgaaatgctgtggtcagcattaaattgtttgcctaatcgatctggaaagtattttcctccttttagcttgtctttttctaggtatgttttttttaggggtgaggagaaggggtaatgttctcaaatgattgggatttctgtagtgagtaaaggtgtgagtttattggagagctgaggggcagtttttaaagaatcctttattcgttcaaatttgggtacacagaaaacatttagaaaacactctggaaatgtttatacagcaaatgtaagcaacatacaatacagagctctcatatacatacttaccatcataactaatagccctactttgtaaacagaaaatgaatgtgtttcctaggagtagtagaatagattttgagaaggccaatccttcttcatgacctagaccggccttcttttacgtggctgctaacatcattactgatgtcagagatgtagaattaaggtgtccaaatttctttagtatgaccttttggaaactgaattatcagtaccataataaaatgcatagcaaataactaaatccattgtcggataggacaatattcccttagagcaggggttctcaaaaatgtggcagactagcaacatcaacttcacctggacacatttagaaatgtaaattatcacctcacccacacctactgaatcagaaactctgtggggaggcctggcactttgtgtttcaagaaactctcccggtaattctggcaaacactgaagtttgggaaccattagtttagagaaaaccataattggtttagcagggtgtcaattaaggatgatgtttcaaagcttcataattctcaggattctgtgttgttcctctaatgcctcctccttcctcaccacttgttcaaacggccctttcttgatatatattcagatctgttggaagggaaatgatgtctattctggaagacttaatgtttctttgggagacctattatattttccctccaaggagcatcacaatgctttttagctgagaaaaggctctgagaggtattgcatgaaagacagtttagttctgttaactgcgtgttagtgtagtttagttctgttgaacccaagaatttctgtaaatcctttgatcacagaaccctatctttgtggagcatagagaaacttatggaatgctacataacaggtgactgggcaagaatcatgctggtgtctaaatgtgtggaacccaaaagaaatgaagttattttaattatttgactattataaccctttgaaaggattagtgacttttttgtaccctgaaaggcgtattgtaggtgttgctagctgccacacatggaccttcaaattttcatatgtagcaactgtgagaacaaaagggtgtgtatatgtacacacacacacacacacacacacacacatagtatattcagacatttcacatttatatgagtcaatcttcacttccataaggttagcctattaaaatgaaaaataagaaaaatgaaaaattagctcaaacatttataaacagttttctaatgagattcaattttattattttaccaatttatttaaatgatatttaaaatcacttcgctacaatttttttttaatattttaagcaccattaacatcttttatagtctcttatttggctttgtctttctaacttaccaggaaaaaatgacttgcctgctttcttgttatcattttaatatatgttataagtaaaatataacagtacccatggcaaaattagaataaaaatagtaccaactagagtgtgatgctccatgcttttttatataatacaaatgactttgaatgtttcattcattatgattttaaagtggatgttcgttatgctaaatcttaaagaagcttgtgatggtaaaagagtgtctcttgactaggtaaactagtctcctaagtgggcactggcttattaccacttgaaaagaagcaataattattttctccttttagttatttacgaggatgagattaaagcttggatatgcttcctttatcctctgccttttcgcctagaatactactaagttgtgggaacagcgactgtttgacaataatatccagttctaataagagaagtgtcctcagtttcctaacattatacgtatataaattctctccctaggcacatagtaatttatattactcatataattggtaattactctatgataatatattacctcttttagggaagtagaatgatttaaagtagttataatctgtcaaagttattatacttaattctcgggaaatattttagttctgttgtaaagaactaataaagaaaaatatattttttacattttgtactgattttacttgcaaaacagactaaattttactttgttccttttttctttcaaagcacctagaaagtatgtaggggcaggaattatttctagagaagttaacacgattggagaataatttaccgatgatctaaaactaaatagaattaagggcacttgaatctcagcttagcactctttctaataaaatactgtgttcctattgaaacttaaattcatttcttcttgggaacaaatacattagaggacagagtatgaacagcctgtgacctgcttccgaaacagttgattcatataacagtgttgttgttattattttccctattatattgtctttagaactattagtatacttttggattctgcatcttcagttgtctagtcactttttattttttctgagacagggtctcactctgttgtccaggctggagtgcactggcaagatcatggtgagagacaggactagctggatttcctaggccgacgagtaatccctaagcctagctgggaaagtgaccgcatccacctttaaacacggggcttgcaacttagctcacacccgatcaatcaggtagtaaagagagctcactaaaatgctaattaggcaaaaacaggaggttaaaaaaaatagccaatcatctatcgcctgagagcacagagggagggacaatgatggggatataaacccaggcattccagctggcaatggcaaccccctttgggtcccctcccattttatgggagctctgttttcactctattaaatcttgctactgcacactcttctggtccatgtttgttacggcctgagctgagctttcactcgccatccaccactgctgtttgccgccgtcgcagacccgccgctgacttccacccctccagatccggcagggtgtctgctgcgctcctgatccagcgaggcacccattgccgctcccgatcgggctaaaggcttgccattgttcctgcatggctagtgcccggattcgtcctaatcgagctgaacactagttgctgggttccacggttctcttctgtgacccatggcttctgttagaactgtaagactcactgcatggcccaagattccattccttggaatccatgaggccaagaaccccaggtcagagaacaagaggcttgccaccatcttggaagtggccggccaccatcttaggagctctaagaacaaggacccccagtaacaatggctcactgcagcctcagcctcccgggctcaggtgatcttctcattttaaaaagctggggagaaacctaatgataaatcacagaatagaattgttgtgtttattttattggcatgtttacatgatgcagccacatattaatttgtatttgaaaccctttagttttattttgtgaataatgtttgcttaaccaaaaataaattgccaataaagaaaagaaaagaaagaaacatgacttgtacatttgaagcactgaaaaagtcaaaccctagtgcctagggccgcagatcttcacctccactttgcagtatctcaaaatatatctactttacggtcatttaactaaaacctcctctgaaactgagctttcggtggggtagtcttttgtgaaatggtgtgtgcagttcatgtgcgttctcatttgcctttgtccttaggggaatgaaatgcttcagaagaacactttgtaccattttgtgttaaggttgatcttttctcatcatttggagactttctctgctttgtgatagtgtcgaacctacagcactcaacttgtcatctgagtaaacttgcttctgaatggcactatggtgtttttaaaagattcttctcttagggaggtgatgatagtcatgaagttcacagaccacctcttttgttgagtcctacttctatcggttctcaatctccatgggatactgctggactgttacttttgtcaagtcatggccgtttatgcttaagccctcatgacccaactcctgataattggacattgcttctcccaaaccaactagcgaaatgctactgtgcaaacatttactaaaaagctgtgttaacagataacatgtttatgctaattgttctgcttcaggaattatggaaggctatttctaacatttggttacctagggccaggtacagtggccctcacctataatccctagcactttgggaggctgaggcaggtggatcgcttgagcccaggagttctagaccatcctgtgcaacacggggaaaccccatcgttacaaaaaatacaaaaattagctgggcatggtggtgtgcacctgtagtcccagctactcgggacgctgaggtgggaggattacctcagcctggggaagttgaggttacaatgagctgtgatggtgccactgcactccagcctgggcaacagagtgagactctatcttaaaaaacaaaacaaaaccaaacaaacaaacaaaaacaaacacattcaattgccttgacacattcaattgccttgtcttattcattctcaagccatccaaaatccctgggttttgaacaaaataaatttgccataaaattgtgctagtaactagtgtctggacatacctaacagccagttgatatgcagtctttgttataatcttagagggaaagtgtggcccagacagtataaatatttgaaccagctcattcctctatttagaactatcacagtattatgaagcacagtatcttgattgagtatgagctctggacacagagcacgtaggttcaaatcccagctctgctacttattagttatgtcagcttgggcatgcgtcttcacttctcagtgcccccgtttcctcaattgtgaagattaaatgagttaatgcatataaagcactttgaacaatgcctggcacgtggtaaatccacaacaaagttagccattaatattaaggtggacatggtgtgaaaaaatggaaaccagtttacagtattctaaaaaatctctcaaattagttttgtttctatgactagttttgtttttaaaattagtttatgttttatgactactttcatgatattaatagaaaatataattttacaggggcctcaacctggtgtctaaatgtgtatcaacaattgtctcatgccaagtaacatgagctaaagctgtatatacaatatctgcagcttattcataagtgatctgaattagttaacatgaaaaggatcatttgaccttatatgcaagagtctagtataccaagtcaatgcaatacatgaaacaatgtaaaaccaaattaatagtctagttatctttagtagaaaaatgagtgtaaaagattagcacactgatgttttacactacctagtttctttcgctctatccactttgtcaaaatctttgagaatggaatttgatttaccttatataacagacataaactgacttatttttttttcagaaagatgttttctgaagttttctaattttatcttgattttgagggaaagcacaatggagctagagtagatttattttatttatttttcttcaccaaaataaggattccgctaattaaaaggcactgactagaatatcaccatggcctgaatgaccccagaaatcttttcgtgcttaatagaaaggatgcacatttttaatgaacactacatccttagacatgtactgctcttctaataagtcttgttccagctgtttaaattgactaagggagtacagttcatagattttgaagctaactaattaactctctgttctttgctttatttttttcttgttttgggtgtggagatatgcatcctttggcagtggtcatatttcaacttcttctctgtaaggccatgagacatttatggttgaggcattgatttattttaaagcaaaaagcctccctttatcactattttctttaaccccatttctagttacattgtttgtggagggccttgtttagttctttaaatattgggaacagtttcatcatcattaaatattaactgctcactggaagcagaagctgagcttaattaaggttgcagtatttactaaattagactgggagaggaacattttaagacacacacatatatgaaagagagagagagagaaagaaaaataaatattttacagtaatctcagcagtttcattagagctttgtcaattgtgttcgcatatctgaaacatttcatcccaaaatgaaagttacattttggatgaaacttaacatacttggtagatattcaggccaggcagaatagatctttatttttagaagagaaagcatttgtatcaataccttgttttcatgtctgtagaacaaaaacaaacagtaagttggcctaattttcagatgctttttaaaagaatcacttggctaaaaatgccacttaaatacacgatacatttagagtttggaattttccctgggcatatgcctgatactctaaattacatacaattatattttatttgtaattgataattattatgggaacataacagttgtgcatatttgtgggatacatgtgatattttgatacaggcatacaatgtgtaatgatcaaatcagggtaattgggatatctatcacctcaaacctttatcatttcttcgtgttaggaacattccaatcctactcttttagttattttaaaatatacaataaattgttattaactatagtcaccctattgtgctactgaatactagaccttattccttctacgtaattgtattttgtacccattaaccatcccctctttataaaccccttctcactaccctttctagcctctggcaatgatcattccactctctatctccatgagttgagtgggttttttgttttgttttgttttgttttgttttgttttagctctcgcatattagtgagaaacgtgcagtattgatctttctgtgcctggcgtatttcacttaacataatgttctccacttccaatcatgctgttgcaaatgacagaattttgttcttctttatggttgaataatattcaattgtgtatatgtaccacatgttctttatccattcttccattgatggaaacttaaattgattccatatctcggccattgtgaataatgctgtaataaacacaggggtgcatctctttgaaatactgttttcctttaggatagatacccagcagtgggattgctggatcatatcatagttctatttttagttttttggagaacctccatactgttttttttttatatatatagtggctgtgctaatttacattcttaccaacagttgcctactttcctacaattttaataacaagttagcacaaaggtttcaatagaacttttggtgatgaaatgtatattttccctaacaaaatataaacttagtccatgcctcaaaagtattttaatggcagtccatgtcaccaagtaaaaactttctgcatggaaattccatttttggtgttaggttggtagtagggtaggagtgtgaggaaaatgcttattctgaagtggagacatttgacctcattgggggattgaaacataatttcacactgattaattcaccctgtaaacaatcattttggtacaatgttttacatttctttatctgaaagaagattcatgtttaacaaaagaggaactgattttcatctttgtaccgctaatttcaaaatgcagaggtaaatcaatagccatatctaccctttatataaagtttgagtggagagatatgtggctggttataaagacataattatttaatttattctgagcagcacactgagccctgcaaagataaattgtttaaatctgaacaataatcagtgcctttctcaccttatactcttcatatacatttgtaagatatttttgcaaattaaattcttctttgaaacttttcattttacttagagacaggaaatttaattttaccaagtggaaaccccaaggtttaaggttagtgcaaaactaaaaccatttggaattgaggagattgcccaataccttctgacttcccaggtttcagtacagcgaaaactcacttgagacccttaagtcatggaaagcctaaaataattagcatggtttcaaggggcagaagtcacaatgtaggaaagccagttaggcagagaaggcttgacgttcttatttcagaagttccttgactaaagccttcaaatgaaagaagaaagccacggcaaccatttggaaagatctgacgaaacttacagctttgaaaaggggtgttgggaaggtgattgtgggatgttactttgcaatcataggaaaatatccatcttgttagcttttgggagatcagggatgggcaaaaatggcatttcaacagaagagccatttttggggagttcactctatttttctatttaagagaaatcaaaatgaaaatactaaggaaaacttgacctgtaaaacaccatacaacttggttgaagctttagtttctttacctatagaatgaggaagttggattagatcagtattttcctaagggtgtactaaagagagatgttaacgggaatatgatgaaaaaaggggggatggtttgtgagttaaacaatgttgggaaatgctgggttaacaaaggtaaccaggtttctttactttaggacatgtgagagcctttatcatactcttgtgtattgtcagcctacaagagaggaatataaagtgacatttcttatacccgattgaccagtgaacccagcttttgaggttcctctcttgggattagttgtctgtggtacacactctggcaaatgctggactaaatgatctctaagagcctttccagctttactatttgatctttctatgatatgcccataaacatataaacttccccagagcagtacaattttactatttctgaccttactaattcttaatctttgatcattccaatgaaagagtctgcattcttaatgaaaaaataaatttaggactgtgtctagcaattgcttaaatgttcacaattgtaatgtgaggctattgtggattgccatttttctcgaatatattatttggttcattagaattagccatacctctctactttgtgctctcttttaatgtgagtaatcagggattgactgaaaaagatatctatgcaaataatggctattcatctgcatgctgtgaatctgtacctttatagcgcttatgtgtgcatatagaaacatgtgctaagtagttatttccctgcactttaatgattgacttttactcgaatttgagtattccaaagacagggctgaaggaaaaaaagaaaagattaaccacccctcacctctgcacacataaataaaaaccttaaaaaacttaaaagcctcatctttatgtaacacctcatatactcaaaaatctgttctgtaaattcggagttacgggtttaggcaggtattggtcacacaccatccccctcttcatcctagcctaaagggggagctccagcagacatcgagggtatttaaatatactgttgcgccaccggtgggtgggaaggtggagtggctgccagggtagcgagccgtgtgaagcttttggtgggaggagctatggatcaaaaattgctgtctccaacagtcaacttccttaaatttccttgcagctgatcaggtaagctggggctgagagtgtcttctactttactctgggcaaatgaaggcctgggagagcctgggctgattccatggagagggcttctaagaatcttaaggtaaagaggtaaaatgggttttcaaggatttgcctttattgagctcaacttatcaaggcagaagaacagagcgggagagggctgccagataacatattgtatggggcatacttatactaaaaaattttttttcactgtttatctgaaattcaaatttacctgggagtcctgcatatttatttgataaacctggcatctctagagaggatcctaagcagaagccctagctggggaataaagggggcaagcagctggtaccctctttgtcctggcttctaaatcgttgtggcaagtgagtggatggggtgtccagaaaaaggaggtaaagaagcctaggagcaggagatttgactaatgggtcagagagaaacacctccttatgttctttcttaatgaagtccatgtagaaggagctttttgaagttatatgattttctgtgtgttttatttcttagagtaacaaattcagtaccattactttttctctccctttttttccattcttgatgacattttatgttggcagctatcagctgctctaaagacagcgtctagtaatactttgcatgaggaatgccttctgacttttgataacttggtaccaatgtgcttcgttgtgtttgggttttaattttattctggttggctggtttgtaaatagatgatgcatttttgaagagcttataattgaccagtcattcagttaatatttttctacagtgatgtacggtattcgatgagaaccgaggtaaaaagtgtgtaagtggggtggaatagggcaggaagtagatttgggttattagtgaggcaggcttgctttcactgtgaacaacttctgggatttttagtgttatttgctgttcaaaaaatttctaagaaaaagatcaagctcatgatcatttgaaaataaatgtttaacgtaaacaaagctaagcgtgggtcatgaaggaaagccgcaaacatttttcttgtaagaaggcatatgcattagagagccacaagaaggccccacctgctgtgattttcctaaagccacctttgtcttagtagcttcagggaatttgacttgcggcttgttcagagaaattcaggatggggggtggggcagttggagaacgcagtttttttctaaactgaccctggaaatgcagggccctcctgggcaggcccaggtgctgattagatatggatctgctgctggctcctttattcgtccggtggggccctatatcctgagggcctttgtggccagagaccccttggaatcagaccagagtttctgtctctgggtctcatggattcatgtcacttctggttaagttatactaaattaccaggatgtttcagccgtaatggtcacatattcctcagggtctatattcataggaaaaaaaaaagttaggaactagctattttctggacctgaatagaataacggttcatttggaacagacaaccaggggcagcctcagtcatgtgttgactattgttctcttcttggagggagaagaaagaacttatgaaagaaaatagcaagagaagcacttaggtttctaaggtagacttagtgttatgccctataaaattattctcacaaacttcaacaaacgtgtatggcagggcggctattcatcaggcacacacacatccctggagattgaaagtggaggaagatgtagttctgccgttatacaggctcaaagtctaatagaggagacaagcatgcaaacaatttatcgatgtacacagcgataagagctacgataaaactgagtacaaggtgcagttggaagcacaaaggagggagagataaatggggacaggaatggggagacggttccaggaaaatctttacagaggaaaagtgatttgaactgagaatccatattgggtagtgaaagtctggaaacttggcttgtgtgcttactgagctgcttatgaattaggacaagtcaccccacccctttggccttcacattctctgtaagataaaggtgcacaagatgttccctacaatccgattcagccctaaactgtttccatcctgggaatcaagttatcttagtgggctatttcagaacaaaagtgtgattgttgagcccagtactccctttgtcattgggagatcaaaatgtaaaagttctctggagacagataggcaagaaaattcttctgctctcaccccagcttctcgcctattcaaacttgttatctggtttgcgccaaagtcattgccctgtgtatgtgtgtatgggatgtgtcaagaaaacagagttgggacagcatgaagaaggtgggtacagtgctggctgcaatggtggggggtacttggctggccctctccatgggggtcaacgttcagcctcattaattttgccttcattatatttaagaaatggtttattaaagacttttccctctaaatttcttgcctgcatctcacatttaacttaaaagttgtatgcagaattttaaggctgctctttgtgcatctatatcaatatttatagatgatacaatatttggaggagaaaatgatgcagattatccatttttgtaaagacagaattctaagaggaagaaagtgggaaatttgccagtagaatgccgatatctggctaataactcgttgtatgttgatcttgactcaggtttttcctagctttaataaatctgtgatgcttgcaggaactagccaaactggtacatatgatttgtaattctgaaatcactgttacttcctctgagaagccatgtctgtgcatgtaagtatgttacagtggggcactatcatcagaattatttcatttaatccattatgattaaaatggaataacaacatttttcttcatagaacaaatcatctcttgggtgccttgatttaacatttaacttttaactgttggcagtctagcagatcagtgagattatgtatttgaaaagtaatccagttataattgtatttgagagaacatatttaggattttttttttctctctaactctgtatgtatttgaagaagcaagtcattctgcaaacagctgtttctcttaagatactgtggctgacaaagggtaatttgcagcctcccaggttccttttcttattctgatgtatggtagggctttttctcatgaacatgaagtacatttcacagggtttttctaccacccagtgcatgggaagtcttgtgacagactctgactctcataactctctagacataggtgggatttgaatctctacaatgagacttttctctcttagttaaaggctttgtattcatttgggagaagcctgaaggtaggaagaaggcaatagattgaatttgggaggctttataaatgttctgcaatgtatccctttgtctgtcatcaacttcttgatgcagatgtacttcagaaatgtcatcggctattttctccccctgcttgctgctttttgagtgcatttttcaaagacagtcgatgggaaaggggagctggaagattcatatgattcataggtgtagtagcacttatttcagcagagaatcgctttcctattgaatcactttgctattttcttaactcagtaacacagtgaaagaccagatgagaatgacatgttttttaagtccaaaaggaaatggaaaaggagggaaattgaggcaagcataaatgagcttgcactctaatcgcttcaacgtttctttaattttgagtgtatatgggagggggagagagagagagttgattttcatgtcttgactccccttagctgctgattttagtacgtagcctgctctgccagaggatggcgactgttgtaggtacgtttacagagtcgtttaaggcatgctctgatactttgcactagtgtgagccaactctgaacctgtgggtctagattggaagaaggagggcttgggacaccattgacttggctagggaaacatgaagggtgatttttcagagccaagatggctgctgggctatcacaccaaactgttatagacccaatgtgatagggtaccttgtggcccactcagagtgcttaggtggcctacagaaatcattggaaccttcctagtacagagtcattgattttccaaaggacaaaaacaatagatgattacctactccactgggacagtccctccctaatccccactctatcccaaccttacatgctttaccaaagccttaattctatacaaggattaaaaaacaagtgttaacagatgtaaaaaaaacaagtttgttctctcccaaacaccaattaaagtattttggcctataattacgtttgggcctcttgaagaatgaacgctatgtagaggagatttattatcaccaagtgttgtgtgtacaaatatattatcctgagttctaaagtcgttttgaaaaaacaggggcatagttttcttttgaaatgttgtattgcacggataatatagatgttaaattacttggtctcctcatctattgtttggatagagaatacagatttttattttattttataagctttctggaacataagcagcagtctctggtaagatggtgttgctatgcatttgcattgttatagaattaaattatggattcggtcattcaaaatagaagctttataaatcaagtaaaatctcataactaagatgaataagtttctttaagtctcatgctgcctcatattccatactttagttttatagcccaacttgatataattttttaaagtgtaattctctttttttctatttctgtgtactgtttttgctctgctaaactgtcattatttcccaagaaaaagcttaagataagttactttatgtaaaggatagtgatataaaagcacaaaggcatgttcacttctttatctgtatattggcaggaaatgtgccaaatacagtgtgttctctccctccctttcttcttctctctctgattacattcaatgtagatgatattaaaactcaattgtaacaaatggtgaaattccaattattcttttttctttttttaacttatctaatgtctggaattcctgaatatgaaagacagtcttcattatatagttgttttggagttaaaaattgtgttccacgcttgtgtatgctaattgtctaaacaagctatctaggtggctctgcaatccttaagcaatgctgctgagctgcataatttattttccccactactgctgtctaactaccccaaagcataggaattagagtggtggccctaactgggagtatgcagtaagatgaaaaatagtcaaatgagaaggaaggtcagtaataagttatttagacctggttaggcagcagggtctccaaatgcagctgcaattggtaaaaaaaaaaaaaaaaaaaaaaaaaaaaaaaaaaaaaaaaaaaaaaaaaaaaagactgaaattcagaagagaggtcaggggtagagatagagatttaagatccgagcaattgtacaaatagatggaactttgaaacaacttagtctctccagggaaaagagattagagaggagagcaagaggatttagaacagggccttggggaaatctttaatgttagggtgtgggaggaggaagagaaaccctgaagtagaagtataaactagcatgcttggctgtggaagtcaccaagtgccactccctccatcagctgttaattctgagccagatcacctcagttatgtagatggagagtggagaatctaggaactgaagatccttgtgactttctgccttgcttcacattggtgggtgtaaaaagaagcttatggtctctcttaggggtacatttatggggaaaagaccccaattattgtgatttagcacacacaggggtctgcttacactcattatatatgttgaaattgcgtagctattcctaggctacttttaagaatttaggaggattaggttaacgtgattcttaactcatactaccaataaattattctttctccaaggtttgcatagaaatataaaagtacataaaactaagatagtatttgattttgtaaatcactttaatttaattaaatgtaaattgagcaatgggaaaaacaaaaagacaaactcgacagaaaacaatgatgtgtcttttaatttctcacactgactttaaagttatactcagcttcttgccagaggaggtaaaacaatagagccaccttgccctagtgatctaatatttaaaaagagccgttgcaatgcatctgggtttgcattatatgtagctctagaaaagttttgaaggacacatcttgattctcagtgaaattataggaatattttaataacaacataactaaacaatggagaagccattgcataaactgtgtaggcatcataaataaggaaaatgcagatagcatgtgttgaatgaaaacacttggtgaacaaactcatttttctctcgggaattcaggtggcctagcagcttgcactctttggtccaaaaacaaagttgcccttttgctccccaccttccccttccccaataacctcacctactgtaaagaatcttagcatctgtggaaaatagaattgtttgcagttgtgctttcttaaaaggtttatggtggacctagtaatccaaataagagagaatcgttagcttctttatatactgctcatgagttcaacacagtaataggtcacattgtgacaatgtgaccaacaactagtccagtgacatcctttgctgctacatagtaaaccataatcagcagccatgccaacatttaggtgacaccaaaagcatgtttgattccacggaactgacatactgtcctgtcttgaaagtgcttaacatcaataaaaaacattcaattagctgaggatccaaaatacactttggtttccatcatgcaagtgatctagggccattgtctccggaacctaaagaacaaaatggctgccgggcatagggatttattatttcattaacagactgtcagtgaatttcagggtgtttctcgccttatatggattcaagatgaagagttttggagcttagattgtccccagataatggagtccaaaatttatctatttgtgtatagttttaatttaatattttccctattcttcattgtcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttgtaagtcgcagctatattttgaaaattgccgataaagatcaacagtggaataacctggcagggacttggggaaattagttgcaacaggatttaggacacaaactaatatgttcattgacactacagagctgtgcacttgaagagagcagtcaggtgtgttgcactgaaaacctggctgcatgagttcactttataaaagaatatggataaaggagcaggggcattttaagataaggagagttgattattattacatggaaacctttgaattctaggacattaattcaaacaaattttcttgttctttgatgggggttttgttgctttttttttttttttttttttttggtgagacagagtttcactcttgttgcccaggctggagtgcaatggtgcgatctaggctcattgcaacttctgcctcccgagttcaagcaattctcctgcctcagcctcccaagtagctggtattacaggtgcccgccatcacgcccagctaatttttttgtgtatttttagtagacatggagtttcaccatgtccaggctggtctcaaacgcctgacttcaggtgatccacctgtctcggcctcccaaagtgctggaattacaggcgtgagcccggcctgttgttgcttttaaataaacgttttattttgaaataattttagatttacagaaaagttacaaaggtattaatagtacaaagagttcctgtattacctttcacccagttctccccactgttaacatcttatattaccctggtagatttgtcaaaagcaagaaactggaatcacacatcattattattaactaaactccagactttattcagatttccccaggttttctattaatgtaatctttctattccagtgtctgattcagggtaccacagtgcattcatttgaattttgcctcccctctcttctctgctctgtgaccatttctcagtttttcccaatttcccatgatcttgatagtggctttcccttaacttagctacagggtttccctatgcagaaattagtaagattatgtcattctagactaatatctactattttctggacttgcaagtttaaatggatcctttataaagtaattaagctatatctgttcatattgttctattgaaaattcatcttgccctatgccttaaaatataaactttcattttgcttttacacctcttagggagaattgaaaactgtcccttttctgctgtagttcttcaggcctcacatttagctcagtggtgcctcattctaattccagctggcctacttcctttaaactattaacaggataaatttgaaaatcctgttttacctttatttgttacccatttaatcagtgatacaatgaacatattgaaagttgaaatatgtatatagtatttagatgcaatgaaaatgggggaggacaatcagctgtcagtaaagcctatctcattataaagttaattctcagaattcaaggatatctgtgttgatatggaaccctttaatgagtacatctttatggataaatgcaaaaacagatgggagaggcaatgatgaatcactaaaggtttgcaccatactctttttccagaatgtctagacagatttaagtaaaataaatagatgtcatgttctgtactattagtttaccaaaaagttttgccttggaactcagattaattatgttggtaaattagttcctagaaggtgaactcctcaaagctcctctttgaccctcagtaattctttacatcgttgaactccttgcgcaaacgctttttctgggctttcacatactgacgtatctcagtccctccctacttctaagggcagagggaagataaagtcttttggatactgaaaattgttatgaacaaaaccacagagaagtgatcgtgcttggtaagtccagaaaatgtgagtgggtggggaataaagcaaggcagcttctattttttcccccagctttattgaggtataattaataaataaaattgtgtatattttaaagtgtacagcgtgtgatgatttgttagacgtatacattgtgaaatgagatgacatggatgaacctggcaggcattatgtcaagtgaaataagccagacagagaaaaaacaaatactatatgatctcactcatatgtggaaccttgaaaaaactgaatgcatagaaacagagagtagaagggtagttgccaggggatgtgggtgggaggggatgggggaagatgttggtcaaaggtatagcaagggagattttaactcacaattattactctcagcttctcatgggatgtctcaatttcaaactgagcaaagaataggaagcagatttcattatcagacacctgagcccagtggttcctacagagctggagcatttatcttttcaaaggtcgagggatagcttcagggtactagtgaaatgccttgtttcagggaatcagagagcaagaagtggggtaaagtaggggtacagagggaagccgttctattcagcctctgctagagtctctccattccaagtctcaacccttcaagtgttattgatcgtgctggctcacactggagaatagggagtagcttttttgagaatccagtaagaaatccattgtgctttccagcctcttcacttgtgctttctaatttgattctctatgctttctatgttagaatatgtttccctatcttttcttcaatgagggtaatttcagatttcagatgacggaagatgactgctatgattcacaggagtacaatttattttatagaatgttacaagatacaaggcattacttagaagacccaagggaacaattggaaattgcttctctaccttgtagattatttaatgatagctgttatgatgcgatgagccgataaatgattaattcctgcagttattatgtgtacaaaaatctaactccgagatggttgatatgttcctcttctatggtctaaggaagccactttgtagacatggtgtaattgagctagtgtgagcaattttaagtaacatttaccagtctgatttggaaaaaaaatttctttattgtggatcctgatattattacagaagtaatatatgattttacttaatttctctggtacctactctccctcaaacaactctctatcccttttaatcacccctacccaataatctgattcttgtctctaagatagtcatacttttgtttaagaaatttccagtcctgatatttgtaaggttgcatattaagacccatttgtatgactggcttgaacttcatgtctttccacaaagaatactttgatctgtttctaggataccagaagagcacatctgcctttgcagaattgaatatggtttgcttattataagcccctagataaagggaatgtcaacctaaatgcgatggtacctagagaacagattctgttgagtgtgactgaacaatgaataaaagccacacctagtcaatttgggtggaatgcttgctggagcaggcaagtttgttcactctattaaacaggtctgaattgacatttgccagtataaaagtccatctctgaaagcttttttttggctttattaaggaagttcagcaggtgaaacaaaaggtgtgactccctagtatttttcaatgcagtttaagagagattgttcctgatgttcccagcaaaaaagtataagttgaagtatccccttgccataatcatgaggcaaatacaaccactgtagaagaatattagaaagagtaggcacagtggattaccctgaagcaaagctaatgttttaaaattttggttttacaattagaaattttagttatgaggaaagattctccctactgaatgtggtgtatgtatttataaagtgaatatgatattacaggctgttaaaatgttttatttggacattttgcatatctacacctgtccatatccaaactaaaggaaaacctgggaaattcccctagtttctctctttgaatgtggtgattcacatggaaacagatcctgacacacaggtgaacttgactcagtagagtgtattcatttgattatttatatagagattgttgattcagcacatttgaggttgcattgggatgtgccaagtcctcaggttctgttgtatgctattcatggctggcattcctgtggctaagttaccgagttccaaaccatgaaggccataaacaagtcttcctctctaggttttcctttatctcaaattgaatcatctgatagctgcctggatccctctccacctttttacatcattttcataattctgtttaccaaatatatttctcataaacaggcttatatgtttatctaacattaatatagtaaggaacgaaggtgatgtaatgcttcagaaccaagagaaaaaaaataatagaaagttcaaataggtacgaggaagggagatatactaattaatgaatattatttttagactcatgtttttaatgttgtttttttctcttttactaaagggctacaatgtattatattacttgggtttatattacttataaacttaggactagaacaattttaagtgactggagataaaattggaaaatatttatttactttttaatttttttttttttttgagacacggtatcactctgtggaccaggctggagtgcagtggcatgatcatagctcaatgtagctgcagacttgtggggtcaagtcatcatcctgccccatcctcctgagtagctgggactacaggtgcacatcaccatgcacagtaatgttttttaaaaattttttgaatagaaatagaaatgtgatctcactatgttgcccagtctggtactgatttcccagcctcaagcaatcctcctgccttgacctcccaaagtgctggcatgcctggcctactttttaatttttgtaagtcagtcattaaatgatatagtacttgaaaacaagaggacaaatattcatattagacttacagttttttagttcacataaatttagtttattgactgaaatatttatgctataaaaaagagtagttttgtcatggctcttttattaacaattattattttaaaaggtgacccagacattatgtaggtttaatagaaaagaaaattatgtccatattctaaattaccagtctcatggtcagtacagaaattataacattttaatgaaggttctgcagcaggtttttcagttcacctactcatgtaatgatgaatgatggcatttagttctttcatcttgatgtggtgacattacatgttttgtaaatgatttttgcaaaattttcaagttaggaaagacaagcattatgtaattataaggttaatatgctcttaatataattacaacagtcatgatcatgtgaacttccgcattgaggttgaccaaatcatatcacagaagtgcctggagtgctaccatgccatgatcatctggattttactacattttctgaaagattagacaaaattttacttttaggtatatcaactgaagcctactgtaatctgtttgttcaactaacattgtttttaaggtgtacttaccctgagactaacatgaggggtttagggatgctcatttgcatggtttccttccaaaaccctgagaggggtcctagcaacgtgtttaaaatgtgtttgtaaaatttgcaaaatatattcgtgtgtttcattcttaaggctccacttccccacccagtggtctaagcttcagaccccacatatcctagatttgctcctcattgcaattactggtccaaagtagagtagttattcgggccttttgctaataagactgtgtatgtcacatagcttaaagcttcttttacgttaaaacaaaataaatcccctagcagtccctttgctgctttgccccatctctgttaatagacactgtgaaatctgcttttttcaaaagttgaatgaaaatgctacacttttgcagccaaacagaggacacttgtacatgatatcttctttattttattttattattattatactttaagttttagggtacatgtgcacaatgtgcaggttagttacatatgtatacatgtgccatgctggtgtgctgcacccattaactcatcatttagcattaggtatatcttctatagtgtccagtttctttgatagtcacaaatctcaacattctccctttatcatcctttatatattcccgtgagataaattacatgtaacctcctctattttgtgtccttctcctctggggctggttagctcagttagttggagcctggtgctaatgagaccatggtggcctgtgagcttcactgttcgtggtcacagtgtaagctacagccagctaccttgagattgcttgctgttgatcacaaatgaggtgaaggctgggagtttggtgggctctgtgaatttttttttttttttttacctgcaggttggtatggctcagtaatttgtcaatgagaggagaccttatataaaaacctgtggctgccctaccacctgataattaaagtggtacccccaagcatttctaatttgccttaatatcctgtaatcatctgttaaatattcatttacacccttctttccgtggtcttctctcttgaaccactctggataccagtcacattagcaattcattaatcacctggattatacacattgtgaattactttgtgtataaaaaggtgtgaattactttgtgtattacaaagtgtataaaaaattactttttatacactttgtaataaagttacatatttttatctatagtatcactaaatcacttttttttagaactcttaattaggtaccttctagtatggatttagccactccaattttaaaaatacatacacatatgggattcatgtatgtacatatgtacatatgtatgtataaaataccctgtgcttttcatactgtttgatctagcaattcatatctttatcaaaagacagcttaggactagccatctgcctaaagtcttcctcagtggagaacaagactgaaggatttattcaatttctttgccaccatttttgaaactacttttacttctttttgcactctgatttttaaattgggttgatctatttagtaaatcaaaaattaattaatggtttaggaatccctttttattgaattcagtaagtattgagcatatactctgtgacaggtatttaaatgagtaaagggtggataaaaagatgatcaagaaacaaactctaccctctaggaattcgttatgtaacaaaagtaagatgttggatgaatattttctggtccccttaatttctgatttgtacctgattcttcatatttttgtagctttgggcctttcttttttcaacatagaattatctttctattagccatgcaaggttctgttttggtttgtgttgttttgatggtggtggtggtggtggttgtggttggtcaaacccttgataattttaaactcttagcctacctatttatctaactttcactgacatgttcataaatagtctccaggtttcctgtgggttccttgctttgctcagttcttcctatttatctcccaaaaacccacattttgtttataccctttgttaaaactagataaccacttaattctttgaactacttcaatgaggtatgattgacacacaaaagctgcacatgttcaatgtatacaaattgatgactttggagacaaacagatgctcatgatactattactacaatccatgccacaaacttgattttttaaaaaataatctttgtttcctactagaatactaaagttaattgaattgccattattattacacggtggtcaccaacaaatttttaggtcaattcctgttcacctcctcaggaacaatgtcaaagttaccctgcttataagtgtcaatcatttgctctcttcctaggtgatgtgctgatctgtgtttaggtactcctttatgattcctggcctgctgttgtatttctcctcccagcaaatatgggtagctctgaaccatgacttgtgttctcatttgtgttattctttatacctcttatactcacaatcacctattgatctttcaactaacctgcctgccttcaatggttcctcttacttggagaattctctgattaataagatcagaaaatccaggtctaggtgaggacaatggttcacttttgacccatgaactttttttttcttagctctctctagagccatggggacttattcattaacaagtacgattagtacttaaacaccactatcagcttgcatctgtttttaaagttaactctcaattattgagaaactaattaactagtctggaggttatgtgggtctcctgcagcctgcattttggccacttcagtccccacggaacattactcaaggagtgtggaaatgaccaagcaaatactgtgaaagagagattattcaattgtactctgtgtgaaagtgaagtctgatggaaactaaaattatggatttcagtgcattttgggattatctaaagatagaaatatgcatgatgaccgtaaaaagagccttccttttatattatataaatgcttgcaaatgagcaataaaatgaagatattatgacgctagtaaaatttatgagtgctatttttcttgtattaaaattgggtcaacaaattgttaccaaatgtttacccttctgtaaaagaaaatatctagtcattcaactctagacaggaactcagagatggaaggccccgattattctgttgaccttaggccaggattttgaaatattttacattcatccaacaataattgtaattgatcttggatatttttgaggtaactacaaatagatctaggctattgaggagacacaaagattgatttggcataacatttaattttcatttatttatactagcttgagaaataacctgttaagtcactgttcctaaagtgtgtgtaaactagacatttatttgaggcatagttttgcattgaattgcattgcctcagaatcctttaagagcaatctgtggtggcttttaaaatttttacctttacaggattccaactactatttccccattcttagtcacggagtagtgattgttctataaacaaatagttaaaaatcctaatcctaatattagtaactatgtaaaagaacattttagtgaataccttagtattggtttacaaagccaaacattttcaatttgtggaatcttgctacaaatactaaattcatatacatatatattcatatatattcatatatatatgaatatatatgaatatatatatgaatgtatatatgaatatatatgtatatatgtatatatgaatatatatatgaatatatatgtatatatgaatatatatatgaatatatatgtatatatgaatatatatatgaatatatatatgtatatatgaatatatatgaatatatatatgaatatatatatgtatatatgaatatatatatgaatatatatatatatgaatatatatatgaatatatatgaatatatatatgaatatatatatgaatatatatatatgaatatatatatgtgaatatatatgtgaatatatatatgtgaatatatatgaatatatatatgaatatatataggaatatatataggaatatatataggaatatatataggaatatatataggaatatataggaatatatatatgaatatatatatgaatatatatgaatatatataggaatatatataggaatatatatgaatatatataggaatatatatataggaatatatatgaatatatataggaatatatatataggaatatatatgaatatatataggaatatatatatgaatatatatgaatatatataggaatatatatatatgaatatatatgaatatatatgaatatatatttggtgctttactcctgaaagcgttggagaatttcattttttgaaatcatttagaaccaaggtcggtgaactttcttgtgaatggctaaatataaatattttaggctgtgaggttcaagatgcaaagttgagggtattatataggtacttatataacaagagaggaaacaaatatctacaattttttgtaatacagctctactaatgagcacaatgaaatttgtggatggacactggaataagagtttcctataattttcatgtttcactaaatattattctcttatttttttcaatcatttaaaactgtaaaaaacattcttagattgctggccatacaaaaacacaggcaggctgaatttggcttatgggccctagtttgcagagccttactctagaacagagattcttaaccagtaagtagttcataaccccacaccaggggtgagtgtcgtggggtccttgaacttgctgagatcacaagcaacattttttgcatacatgaatttttctgtggacagagtctgcagcctttatctgactcttggagaagtcctggactcaaaaaagattaggagccagtgttgtctagatatttcgttaatttttaggacacatttcctgagtgtctgatagttcctaagcaatctgcaagtcactgggaactcatgggaatttctactgtaggagctaatactgctagagacatggggataaatagttgtcaggtgatcttattcataaagtctgttgccaccaccattcttgctggttgacaacactcagaaagatgaaaatttacacctggttatgggagggacagccgtctcttttcaagtatttagtaaataatttaggttggaatttaaatatctgaaacatttaagtgttcagaccatttcaggctgtaaagataaatcagagtcagtatagttaaaaccttttcctttacaataaaaattaacccacagataggttcatgttagctcaactgacatcaagggctgagatatatatagagacaggattaaagttgcttattaaagctgagcttctgagcttgcaggctgcttgacttaacccatggctgttagtcaacgctaagcccttgaatgttcaaattcatgaaatggagtagttaccctggggcagaggtggtggtgagaaaacagaaatgtccaactgaaaataaataagccactcaggagttcctgcctctgccccagtattgagaatgggatagcttgcttcttctcaataaacagtgttatagaatgcatttcatactcaaggaggaaatagttataagagctaggatactaattttaagatctaaagatagcatagtttgtggtgaaaccttagaaaaatctaaatactttcagtaagccctttacattttatatgtagaccaatcattaatttatagcctttttttccatacacttggagcatataacaaacctaagaaagtttaaaagtattccaaagaaagcagaacttagctaggagaatttccctggtgagtcacctcaaaaaagaaaagaaaaaaattacagaagtaaaaagctaccataaacagaaagcattgctttcaaatacattaggcttcaatattgttgattgatcagcatttattagtgattaataactttttaatctggaaaattcacccacctccaggtctttctttcagttcaaaaattaatagatacaataatggtcctgctcatttttgtaaaaggcaagagcaaaaagtatgcaggagaatgggctggtggcttcagtgagaaatttaccaggaaagtcagagacaacgaaaagtcaagtgaagagcactatcgtgtgcttcaaaaatggactctttctcatcagagattcttggtgatcttgagacaactatgaatcattacattgataaagtctgccttattgcggaagcatgcctgggtggctgtttccagaagatttccttctcattatataaaatcatgtcacatcagctagttcctgagcttcacatctcattccatgacaagtatcccgtattcctgtagtctattacatcataagagctagttagactgggtcagcccttggctatttgcccccagactttagagtccttctcctgactacaccatcatctttcctggcacctggcgttccctttccacttaaggctcttggcaaccatgtctttcctactcaccctcgtgagtcttgccagttttttggtgccagattctttctgcccttcctaatgtcccaatcagctaatttgataaactcatctaaggtagaatgctaatgggggagtgcttccttctaagctgaatatggtttataacagagtcttcttggaatgctgtgtgggtgacaatttcaagtctgtgtgggggtgaggcaatgagtatacattgcccttcactttatattccacaatttgtatttagacttgtttctattaatgtgacttagcaggtatgggcacagtttggcaaatgcaacagattcgggggttttttcaagtgaaaaaattttataaagcaagaaggaacacatgcaattagtaatacacaatgagacaccaccagtttcacaataactaacttgtagagtcattattagaaatatactacatttagtcatgatttattattcattcattaagcttttaaaatgtatcattgagtatatctgtcaaccagtcattcactaagtgttgggtactataggggagatgagaactatcaaaggaataaaaccacattgacaagaaaagatacccacatgtggaacaaactggaaaacagcaaagtgataaataatatggcaacagataataaaggaaatacacatattaaactttttgaatccaggatctttgaaaatagaaaaagcagtaatagctttttgcatttctgaggttttttttttttttacaagttactctagtttgtgtaccatataatcctgttatcttatctcttcctgcctaacagggattcttgtagcatttctagtgccttcttttgaactatgaatatcatctggccccctggataaagacaaggctaggcaagtcagattagcttgtgaaacaggacctctaggatgactacagtaaacaataatttcttgtacacttaaaaataactaaaagagtataattagagtgtttgtgacaccaaggaatgataaatgcttgaggtgatagatactccatttaccctgatgtgattattacacacagtatgcctgtatcaaaatatctcatgtaccctataaatatagatacctactatgtacacataaaaatttaaaaaacaggacctctgatttaaaaaaataacaaaatataatggaccatactaaactcattttaggtagatattaaagcactcactttttctaatttatcactttcttcctcaactccttgctgtgttccataattgtcagtgggccaggaagacagaagcacagccagtatttggtagtacaggtggggcctgtggtaggacaggcagccttacagccaagcagtattgatggtgaagaggaaagaggaaggaaagggactgaatgcaaaggccatgcctgtgtaaggaaacaaagaagattgtccatatgtgtaatgtcattggtgacatggtttttagggaataaagaaagagttggaggaaacacatttggaacagactagcagtgagatttaatttggataattcatgactgttaaaatcatgtggcttattttatgagcttaccaataaagttagtacgtaaagagatttgttggtttaaaagcaactcctctatgggaattagtatgaggctaaaaataaatcagaagaaaacaatagtaaattttgatgtggcataagtaattttgatgtttctgaaagaatacctctttgtgtaatgacaggaagaatctttacctctaacatctttttttctcttttaaacatacagggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtatttgtgaacatatatataaatacctgtagaatagatattaaccttacacataaagcagtattctcagagcccagtgtgttgttttaaataagagaacccaaatttcttagcttatagggttgttaaacattttagtactgcaatcataccttgttataaagtgcattgattcacctgtatggtaggtcaaacaatatgttaagtgtacccagccatagactgtgcgatggcacaggaagcctctgtgggaatgttccttttacctaggctccagctttcagaaacagattactatatttgttaatgagtctctacttgctagaataatcaaagtgggaaaaaagtagacaatataactctctacgattgcagaatgtaaagctatatgaacacagaaggtaaattagtctcatagtgcctcaacttttttctccattttgagagtgatgtgctaggcagtaaataaccccgatgcctaagaaaagaaaatctgaaagaaatttcaaacagctttttgatttattgaagtccttcattcttctattgttattctttgtacattgaaataactagtctttccttacaaagtcagctccatttgcagccgcttaaatgcctagtaatgtattgtaatataatctgattgtacatataactcagttatggttcacaagttgactttggaaaaccagtgcattatggtgtgataaagactcatcttggacttaaaaaaacactaattatgcttaaggctgtgtattaactggagaattaaaactggttttcagtaatacttttttaaacatttttatttcaatgtaaggacaacctccttttggggagaatagaatttttttctgggaatagaaattctgtctgtttatatctcatagtgaatatggctttacattattctttatctttttagatttgttcacacataatatattcaatgtatatataattactgttacattcactagcaaaataaataaaagccagtcagcttccagtcatcagtgtgatgcgtgtgtatgtgcatgtgtgtgttctaaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggtaagaaaaggcctgcacttgtggcctgtttcagagtaaatgctttgtatattcctcaatttgtctaatatcctgtaaccatactcatggatggtcatgagaggaccttaatatgaacagtcaaggttataagctggaaaagaaagaacctatttattctactttatttactaagattttctaaagataattatttaaaagccttactaatgcttttaacctactgtgctctttctcccattttcagagtaagggtaaattatataatttaaacagtaagttatttttgagtgcttttatagtttcactaccctcaatatcctagagaggcagaaagttgcctctgctctgtgagccactttcatgggccctttgctactaacatccttaatgcctttcaaaaacacagcacttaaaagatagggtattaagtaggttgtaatttcctaaaggttaaggccacttttcctctctagaggcatagtatcaaggacagcagcctgcttagtctggggggaaatttctacgtggttgggagcagaggcctgactttggttttttttttttttttttttttttttgttgttgttgttgttttgttttgttttgttttgtgggggtggttgtgtgttttttgttgttgttgtttgttttgagatggagtctcactctgttgcccaggctagggtgcagtggcgtgatctcagctcactgtaacctccgcctcccaggttcaagcaattctctagccttagcctcctgagtagctgggactagaggcgtgcaccactgcttctggctaatttttgtagtttttatagaggccgggtttcaccatgttggccaggctggtcttgaacttctgatctcaggtgatcctcctgcctcaacctcccaaagtgctgggattacaggcatgagctaccgtgcgcagcccagagtcctgacttttaagttgctgtagaaagccagttttgggggaacagttagtgctgcttagtaatactgaaaggtaggaagcaggaaaaatatttgtgtaacactgcagtgtgatcactgagaaccaggaattctcgtgacttaagtttgccacagctgtccgttgttttgatgtgctgcttgctatgtctttctttttctccctggacctttccttgtgtaataaggcataacagccccagtaaaggacaaaacccacaggaaacctcatgttccctgggtgtggaaaaagcactgacatgaccctgaagcccaggagatgcactgtgagctaaatctcctcacaaacattcatagtttggactcccatgacagagactttgcctattcacaacagagagacacttattttcaaacatccctattaagaaggttttcctcataccgagttgaaatttatcttgctgcaactggaacttcacaaaagaagtcagtccctattccaagtgagagtgactctcatgtctcctgtctaagccaaatactgcaaattgctcccttttcctggtagtttatggtttcaaggacacagtaccatttttggactggctccactttttgtcagaactgaactcattacatcgtgaaggatctgagcaccaaagtagaacaaacttactttctcccttgatctgaacaacataatctgttaatgaatgttaaaaaagactttaccaaattctttttgtcttaaatgcttttgaaggggtaattataagctatgaaaatagcttcatatgcatctgtccatttctgattatttgagtgtgtttgatagaatgcataggttacaagtcagcctcaaatttccacgtagagagctaaatattatatcataggccttcaattgttacttgtgaatatcaatataaaattcccttttaagtaactgatcacagcagggtcttagcagtgagatcaagttggctcataagaatttgatagaggtaagattaaataaaggagggcttcatgaagaaattcaagctttttatatttttaaggattcatagtggacatgctttataaaagagacatttttaccttgttcatgtatatagctcaggttgagttcacagaaagcagcttgtatttaaaaaaaaaaagagagagacataaagggttgatacttagttcatccacagtctcacacctcttcggcaggtttatgagtttaatagtacaatcaccacccaattggaactgggcactgacccatcaggataaaccccagccataaataaacaagcagtactaccttaccagcgtctacctgttgaatgttcatctaggtttcaccccaatttgtagtttactagggaacataactggttctgatgatcataccatgctgccaactttcaagagagagaaggggacactccccgtttataccaaagggaaatctttttaacaaccagataagtaggtcttctgtcttagttaaaatgttcagcaaaaccattttctcccaatggtaataaaaggcattcgaaatgatagattttgttttatggtttatgattttagtactgacctttgccatctggtctgctgggataaatttggaaattttatatctctaaagctactcagtttattttatctcactcttctagcatgcttttctttatttaggtgaaatgaaaagcagatctgtcacagtgtgtgcactgacagtagagttcccaaaagaaaatagagataccttgagacctttgttatccacaggaacgaggtcatggcattacccttttggacacatggtaggatagttactcaacacaagcattcctgtttccttaagaatttggagcatacctaattgttgttgctgggacatgttttttaagtaacgtgcaatttgctgagaaaaaaaaaatgtaaagtaatgttaaacttctccaaagaatctgatccaggggcaagtttcacggagtattataagcacagtgggattttgaaagaactgtagacatgaaaggatggtttaaaaatgctaataggttttagaattaaaccttacaagaacttaacaaagcaaatggtacataccgaaatggacagcaagcctctataaataagaactgcatatattttgctaactatctacatagtacctgcgtgaggtaggtcgtgggggaggaaatattcatttgctttttccttacatgttagttaggaaatatataattataggacttgaacctgaagtctttgtataaactggattttattttatggggtgacagtgtcagactctgatctaccaacatctgttttatcacctatatgccatttatgtcctagatctgtattggagttttaacaggcagaaatctctttcctgctatatctgttgcttctgctaatctcatttttatagattcatagatgagtatccctgagatattaattataaatgattgtttactgtagtagctttctgtcatatcctgcccaaatgaggtctaaattagtgaagttgaaaacctttttttttttttgcatttttttttgttttgcactactgctcatgtagttggactacctctttttttttttttttttttcttgagacaggctcttgctctgtcactcaggctggagtgcagtggtgtggtctcagctcactgcagtcttgacgtcctgggctcaagcaatcctcctgtctcagcctcccaagtagctgggaccacaggcatgcaccaccatgcctggctactttttctattttttcagagatggggttttgccatattgcccgggctggtctcaaactcctaagctcaaacaatctgctggtctcagcctcccaaagtgctgggattacaggcgtgagccactgtacacggctgtgaacccccttatctctacatttggttaccttgctgtggggccactgcttatccagtgtcttgcccaatgcatacccttacggaggattcccaggaaataccttatatgactggtgcttgcttggtttgagtacatttgttactttctctagtactagtaccatctctccccccacaggccctgcagcctggtacactgcaactgataccaaagagatcagcactggaaaagcccaatggtgccaccccggtctttaatcccactgttttccactgccaacaggctctgactaacctgcagctcccacagccggcatttatccctgcaggtgagaacacagctctaggcactgcagcgagtttggtgatgttgtgaatgtatacaatgcaaaacagctttcaaagagcttgtataggaggactgtcgacatgtattttgattaaaaataaaacaaggaagttatgcttatctgctagtatctagaactacttgtttttctataattcatgaaaattcatggtttgaaatcaaactaggaaaaagtatcaacatttttctttttagcatttgttggtttttgcttatgattaattcacttggttcagtctcaaactaattccttgactcttaggtatcactgtcacagacagtagagtgctgtcaaataaaaaggcaaaaactcccagcttcgatattatggaaatgcgttgtcaatatgtctttgatatgccaaaggtagttaaaataaaactaccctaagtgcataatatagtataatatagattaaacagatagttttagcctgtaactcctgaatcagttaatataaaatacatagcagtttatattttctgacattttgcagcatattttgttatctcctacattcagctatatttaatagcctgttttacatgaaattgaacagaaaatgttaagccagaaatttgttcaattagatatcatatattggggggaaactaattttcttccagtggtttagtagtttaagaatgagcatatagtctcttaggaataaattgaaaattctaaccattgagagtacagcagttttttttttccatttttttttttttttgacacaatggtaaatgcccaagattggaaactatttttaaatgaaaataacatatgttttaaaaaataatttagaaatccttgttaatacccagacttgagaaaacttattggttaactagtaaattaatcagttaattaattttgaaaggtaccataaaacaccagtctttagttactagccacagcagtccttcatgccatcatttaaattatacaatttgtatacatttatatgatagtttctgagaggaaatatggaattcttcagcactttcttacatcccttataataagtaactactgatatctaataatttagatattttctcccaacctaagaaaaacacacataatgtctacagagtaaaagagaaaaccagtatgagttgacatgactttattcctagcattttttttcttcaaaaattgtggtaatttacctacacattagatcactctaccttggctacttccaatttgtattatagctgtggaatgaattcagtagccctggaagtctagtcaaggtggttgaatataataaaatgtatgctgttcatcatagtttttcttaatactacagttactttgtttccaagtttgaattttttgccagatttggccaacataaaatctagtttcataagcaaaaatgtcagaaaaattccctttcccttaattagtagcaacataaaagcctgtccagctaagaggtctctcttaatggaacctctttgccatatattcatagtcaagtcctattgactatgagacagtggaggagacagtgttaacagattaatactctaaatagaaacacggacaccagatacgagattctggagcatatttagaaaatgatatgtgtaataaattaaaattctcttattataaaaattatttaggatgtatttgtccacaataaatatgtaatttaagtgagttaattcttttaaagaaaaattatagctgattttgtacctaagaatccaagaattattttgattacctgggtttgtgaccttaaaactaatctgtaattgtaaacatgggagattgttggacttgcatgtgctgagtaattgatattgcaaagaaataatctttctgttaaaatgtatttctatcagtaaatccttaataatcaaatatctcttttactttccacgcttttctgcgtggtgtacagggccaatactgtgcatggcacccgcttcaaatattggtaggttttctacaaaaattatcaacattttctaatctgaaaaaatgtgtttttctgttgtgactatgaaagatgaatgactgaaagatgtggctggaaattttctgagtatgttaaggtttaacatggtgctttctgttttatgtctttgtagcatcaaaatagtcctactttctcaagtcctagttggttgccactgtggccaaatactggccctgtcatttctctatttctaccctaacaacagcaactgaaatattaaaaaatcgtttcttttacaatatttgaaactagccagactgggcagttttgttctttgcttaacatgtattatttaaaaattgtaaaatacttaaaatgtataacttgtaaagtacaatgaaacaattcccacctgaaaaagttatctataggacttaaagcattcaatgttcctatgttgcgagaggatgagttcagcaaagccagaggattctgcagtgttctgtaatgaatcctgtagtgttctagcctgaagcaccattggcacagaagctaggcacaacagaatcatttcaaaatgactctttgagtgttacgtgatttttaacaagcagttgcacacagatccttttgttagccactaacacaatatgatagccatctctaaaccattttatacagcactaatactgaagagcatgagaaaggaatggggagttcacagctcctacagtcctcatgggcacaaggaacagaccaggagaaaatagctctgttctatgcaaggagaaatgatcccaacccgtcccactctaccgtctcacatcaatccaggccatcccctcccttttgagagtttgcaacaaattgacctttgtcaccttggtggaccagaatagatgcagagccccaaaagcactactaacaggcttcttgagaataaagttcaaaatgacaaccacatagtagcagcactcactaacatagcgagatctgaaccctgggaatggaagtgaggcccctgttactgagggtttgactgtcttctgtaggaattaataaacatttccattaataccaacaggagcacaatatgtatacctttgaatcataatgtgtacaattagaacagacttctgcaagtttgagaaatgtgtctttgccttcatgttttgtgacagttttcttgaagatgctctcttgtcctttcaccttcagagctttgcttaggaatgcaaactgcattctttagtggatctgcttcctgtacaattgctgcactcccaaagggaaaacaagagtgtttttagaattggcatatgagacaacagggatggctctgggtaatgggtaactagagataaatggaagggataactatggagtttctgttaatcaccatttggggtacattttcagtttctatgacattgcacatgttaatttttctctggccattcattttctctttagactttcagaaaatctgaatttaattgatgtagacatgataaattattacatatgcatgcttgccattcacacattgccattcacacattaattccctggtttgctttctgaaatgagctagacatcagaaagcacccaaaacgctttctaaatgagatagaaactagaaaaggcaaagataaaacatcctgcaagagatttcacagctgctaaccattgtagctataatagttgctgtgaagacaagatttactgtgaagtactccatgtatttgtttgataaatggccaaagtttcccaggagtttgccagaggtgtacttaaaaacctgcatgcatagtccactgtattcttcatatctgcccccctaccacataccaaccagtctacctaccatgtctttgcatgcagatcaggtaagtatacatataactgcctgtttgcacctgcaaatctagtgacggcattcatgtccataagtcagtgaacctaaattccaatttatgattccttaattccattttgaatgtgcagtccagttacttgtctgcttaactagcttcagatagatagcccttgtaacattggatttttgttttcatatgcattcattatagccccttctgaaaatttagccttttgagtaaactacaatgggattctgctcaaaaacttactaaatgttgagaatggttccattttccatattggtaactataattggctttccccttttctctttttaattttccccccttccatgctgtgttgctttgcactgactgtgattgcatgaacaccctgatgtattcatcgttatgatgtcacatggcttgttgctgtgatacctaccacacctcattccatcgtaaatgttatggttgcataaatcctctaccctcccgtgtgttgcttctatggttttcaactgaaagtgcccatgatgcacggtgctacacctaccactgtgtctgcagcaacaacacctgccaccagcgttccgttcgctgcaccaactacaggcaatcaggtttggccatttatttaagctgttcagatcaagataactacaatgttttggtaatgcacagtatatgctttttggattggtgagattcttatgtgtttcttaagccattgtcacatttagaatttttatttttgtgtatattctagaatgctatatgtgctttgctattcatcccaagatgaatcagaggagttttgctcatttttaattggttaccagatgttgctcttgatattctatatttaattactggtaacacaccaatcctcaaatgtatatacttaatgttacttaaatgcttcctcattggtcaagagaatttatttcactgccatttttgattattgtgtttaaactttggcttagtacagtcatcacctttaccttcagatccactggagagaaaacaaaatatcacatttctttccaagacatggatatccttatcatttcgcagtgattacatcagaagttccttctcatatggacattagatgtgcttgttgttttgatttttatttgctttaggtatttctaggcagagttcacaaggcagattataagtttggggggagtcttgaaattataaggagatacatacaataattattgtatagtattagggccattttgccttattaaagtgggaaccatgcttatagactaaaagatccacatatataacaacataaacagaattctcccaagaaactattttaatctaaaatcttttttactactatagataccccaattatcaatagatgaactgaatagcagcatgtttgtttcacagatgtagaagttctcagtagaacagtaagtttctttcagtattaatataaataatatttataggctacatattttatttacacaattgcacttctaaaaggctttcgtaaatattttcattcatagacattgcttgtgatgtagagcttgatttacacattataaattttccaaattgaaatgtgagtgcaaatatgcaatattttttatatggcaatgacagctggtactgtattttctcaatgagctaacacattcttaaatgttttcctattattaaaggaatatataatttgttagccagaggcacagattacttttgagttgtaattctttaaccattttatagcttcattttttttttgaagatcaaacaagaattttcaggatttgactgatatgattatgttaaacacagtaagcactatgcctgtcatgtgacattgtattgaattttgagtgacataatttagtaactgagtcattattttcattccaatcatgtctcttttttaaaatttttgttgttgtgggattttttttttctccttcaccctcaatctcctctttgcctggtgcccatcatggcacacacttttttaagcaatcattcacttaagaacatgtgatttctgaagccacttaagactcctaggtattttaattaattctagggacttactaaaatagtgtaccaactctgaattgcataccttcatcatcgaaagtttgaagttctcacacctggagtgtgtcatttggttgaaggaggcagcagttctgttccctcgtgaactagttccccagaccccagctagcccttctttcctgctgaggacacacgggcttagaacactaagtgttctggacagagcagatagccgactggacattaaataaataggtctcctcaatcataaggaaggattttaaaaggcacctttgagcacatgggataactgaaggagctataaattgtcattgtttccagaggtgtcatttgggatagtggcaacttggaaatagcactaaacatgataatgtaggttttgccaacacttgcccaactttcatgggctgctttacgtcaaggtaaccacaagttgtcaaattaactttccaacagagcatgttagggaagagtgattccttcttgcttgattttgttagaaatgtagagatatttggcagaacataatcacttcaatatgtaataggtgctaaaaattcctctaaagttcaaaaatgtaattttgtacaatacaatacccagatttcacaggtaggctacttctgcatggctctaaaacattcagagaaaaagttgaaagtgtatttaatatttgcatatttcaaaatgttcggtatcaaacatgttttctcagtacatgcctgttgaaaggtggacacatgggtgtatgttcaacaaaaagtagatagataatgccttaaacattggattgcatctctgttaggacagttctccacattagcactcaaagggtatcatagactatcatagatatatggttctttcatgatcattctcaaaagccccatttcaatctgaaattcagattggggatattttggcactgttaacagacagaactggaacaagacccaccacactctcctgactcttccttcaataacctttcaatatttctcactctttctttctttctttttttttccatttcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatt

SEQ ID NO: 3719 - DNA, 104352 bp, human
atgcacccctgctaaaggctctcccggcaccggggccacctcgcgcagcgctgcttttgcttctgccgctaacagatggcatgtgccgctgtcgctgccgctgcccctgctgctgccgctgagagcagggccccttagcctctgggtttgcgctagcagcgtaaggtaaggctggagatgaattgggatttgtaagagaggctgccttcctcggacgccgaggaaataatgccttttaaacttcattttacaaaatagcaaataggaggaaaagtcatcctgcaactttgttgcgattttagagctttgatcattttcctcctcctttcctcctcctcctttttcttcttccttctcttcctcctcttctcttcctcctccccttccttccttctttctttttttctactttcttctttttaatttaaaggaacttcttgcatggcatataatcagcaaatgctttttaacaacgaatttccccattttcacgcgatatcgtgagcagtgccacagcttccttgcagaaccttgtctcttcctgccctgagtcaacacgtttgggcagctcgcttttactactggggtttgaagggcatgagagtagattttaggagactattaaaaagggaactttagtttttaacactcacacaataagcttttatggtaagaaaacgaaattaaacccagacgagtaatgaaagttgacatttaagtgattctttgttgtggtttcataattagggtaatagacctactgtgtgtttttctgagcactcttagatagctagctagctagctagctagctagatgatagataaaacagataaattaattgtggctctaattaaagtaatatgttttaaaggagttattttctcctagatgttcttacatcgtttgtaaattgagctgggatccccacagcctctccgtatttgtgggtagacttcatgggaaagaatcaattaaaacaaaacttgcaagatttaattttgaagtgattggtactttttttattaagcggactccctgctttagtgaataaacgtttgggtgattactgatataatgtttggaaaacagattgttggtatgtgggaatgactaaacatccatgcttgatacaatttatctgaattttgttttgttttgtttccccctccagtgaaaggtaaatagacaatgaggcttatcagacaccttggatttttcctgattatatttccatcttctccttggcccatgaaaatctaatcctgaatgtttaactactttttaaaataatttttaacttttttctaatgtgcgatacttttgggggatgctttcatatttaccaacacttcttcaaatatagactaaaatgggcttctgcccacagctcagctgataatattctatcgctgttcactccttctcccaaagcagtagaaactacttggttggcagacgctctgctactaaatttagcaagtgtgtggaaagggagaaaaatattgttttgcccttattaaagcatggtgcagttttctgcccaggtgctgtagtctacctagaaacaaacaaccaaactgtttacaatggaattactatacaacaaattttcagcagtttttcatattattcttgaaagaagtatgtggggcaattcattgcttcatgtctaaaatgagagttcctgcaggtagagcaataaacacttgcattttggtaaagggaggatgagaaaaagcaacttctcccatttttagtgattatggacttagatcccagttcagtactgtttgcttccggatgtgctaccttgctgctaaaagacttcggaccaaatgcatccttaaaaaaaaagaaaaaaagaaagaaagaaaagtgaaaatactaaaccttgaggccagaatagacaagctaaactggtgtcagagaaattaggaaattttgccagttaacattctgctgcctcatacagtgatgagattggagaccttatatgaaaacataagtgaaggagtttgtaaaaaaaaaatgttttgagagataattgatatagtgctgggctagaggtggtgactgcatgttttgctctacttctaagagctacttcatttctctaatttcctttgctactttaagcaatcgtaatgactcccaggactattataaagtaccttttttttcctcaactgtccacttcaggcatttcacaacagctgctttttatgattatgagctggtagcaaaggacctttggtattctcttgcaccaccctctacctagataatgctttgcacaaactaggtgcttaataaatgttacattaaaaagaagaatagcttataaactcacagtggaatagattttgggtacagcttttaatttaaacggaaggcatttttatgcactcacaagaacctaaacattcaaagaagagtagaatgtacattcccctagttgtctgcattgtatttgcttctaaagggttctcttgcctctcattgtacttccaggcacttgtatacttcatgcttttgaccagtaggtgtattattatctctccagcttcactgtgatacttcccagtatcacagcagcttgggaataaaaaaggttttgtcttttgagtgattgtatagtaccacacatgctggaacagtgacagtctcttgactgttgtgcagatgttgacagtatagtttagtacagttttgttctccacccagctgcctttatgtgtgagggacgaggggagggaatggagtgagaagctctaaaatgatgaagatttctattgataacattttacttttattctgcttatagtacaataaattcaggaaggtggcagaatttttctgttttcaaataaataatgttgcctgataggcttacaaacagggattggggcatagctgacagtacataagttatagtacatttttgacaagtaatttcatcctgtaattaaagttagataatggtcactgccatgttaacattatcaagtgtctgtaagagcatgaaggctacactcacctttacttcatcaaggttcttccatgctggtgagttttcttatgacattgtctactaggcaaaacagatggatttttcctcattcaaatgtatgtgatatcaagaaaatagaaatcagaagttgtgtttgtgggatttttctgcctttctctaggtgtgatatagctctcacttcaaatatagaaagaaacccgagcctcagctaaaatgagatggacacttttcctgaaagagaagaaactgtgtctgggagcaagttgtttaattgtcaattaaccaaccagcaaacaaacataaattataactgaaagaaagcaattagatctttcataatgtgggcttttaggtcttaaggataccagatggttccatgacattctgttcttcctaaatggttatctattgcctcaagatagccaaatgacagtgttggaaaggcaactttgagaattaggataaataaggtatcagttgtcttaatggatgttaataacatccacatgacctgaaagggataagaaaatattttttcagatcattgtagtaaaaatgcattattaactcatcatttagatctgcttggtattagattgagtgacattgtttttaaaagattgatggagaaaacaatacaatctgggaagtaggaccttatcatttttatttgagaaataatgggacttccaaattgcctgggcacacaaacacacacgtacatgagtgtacaaattagtggtcaattcaaaacaatgtatacagatgtgcattgctttctcactggaagattataggaaaatatttttacagtattcctccaattctaagaatgaaataaaaaagttcactgtaaactattataaatatttgatatagtgatgtcactctgaggctcaggaaaagaaccagggctttgaatgttcaactccaggcagttaactttcagaaaaaaataaaaaataaaaagatgctttgctcagaactcaagaggaagcaagaataaaaggaggcttgatttaaatgtgtgtgtgtgtgtgtgtgtgtgtgcgcgtgtgtattctccctttgtatgtgtatggtgattttcaggaagcccaagcataggactcagtttgacatgcttcctaaaatattatgtcaactctcaagttttacttgcatcagtattaagttggctcatgaggaaaaggaattatttgttttctgatttgaggcaggagtttgttttttgcccagacagtgagtgaacttgaagggcttagaaataaagggcctcccatagagaaaaggcaacctggacagaaatgcagggggttggcagtagagactagaggtcatttgatctctttaagccatgggagcatcctggagtctgatagttggctggattttgttttccatttaggatcacaaattagcttaaaattgtccacattggattcttgaatcctgagcttcttggcattgccttcaactggtgtggaaaattgagaaaggtttcctcaggcttactcaggtttccttgaatgtaccagtaactattcattaagcagaggttattgggtctctttacctcatatccctaatgcctggtagatagtaggttctcagtaaaagtttgttaaataaatgaaagactagattaatctttctaacttgtttttgcatgttacgaacattcttccttgtagcattatttctgttttttattgacaaaagaaaaatcaacaccaataagcagactgaacgctagattgaatgactgttctgctagaggccacagtagcaactcaagtccagggagatgcaagcagtgccagctttggggctgagaccttgaggactggcctgaaagccagctgctacttttctttcacctgtagttgcatttagaatacctcccccacatcccagggatatcagtcttcattacaaagaaatgtttacatagaaacagttctttaactgtttcaccagattaaaaatttaaaaaaaaaatcagaaatactgtgactctgatgcctcctgtcatgtatagtttaggaagtgatgaagttacagacaaaatccaaaaaggacactgggagctgtctcattttcagtcagatgttgattgcccatttagaggctggatttgcataggtttttacttaccaagatacaggtatgaatagtgcctctttttattgtgtacagaaagcaaagtccacacagtagaagagacaagagctgtcatttcagatccaccacaatcatcttttgtgcccagaggataatcagtctttaggtttagcgcttgcaatttctccttatgtggcagtacaaagtaaccaaacaagaggttatgttggagagtggcatgggaggggtagtctattagcaaaatgaaagagtgaaagaaccagagagcttacatttcaccttttgttttgtagtactcagcttctacgcaggaaagcaaaacaacacaaaacaaaagcaccctgtagaatattaactggacatgtatctcgtgaaataattccttacttaatttaccaatggggaaaatgggattgtcacaatatataatattaaggtggttgctttaaggttggattcatatactatacactggtttttctgagttccatttaaaatatgtaatgacaaattcaacaagacccatggcacagaggtggggatcacatttaacctcagtacccaagtgaagagtttgtattcgtcctctgaaaagtaggcacttgataatggcccagttgggggtgctgttttgttaaagggtacattgatattttaaaaattgtttgctgtctgtgatccatgaggatcctgaagaaaggatgggggcatttctttcagaagtgattttgagaaaaaattaaactcccaactcctttatgtcagcattttcccctaagtaattggacaacatgaagagaaaccttattagctcacccagatatatgaagtgaaacatagtacatgttatagagttacattttatatttaaggacttcccaataaaatcattagggagggactggggtaccatgcctgtgtaatctgatatgtttcatgaatgcctatagcagcggcctcagctgcagacagaggctgaggctgtgtcaatatgcactctgctcgctttctgaagccagggtcaaggccagactcagattgacaggctcgtcaagggagggccttttttgagaaagaccttggattttggcgggacttttttgtggtgtactttatatgtttacatttattaaattaacattgtaatgcaaatgaaaatgtagggtcaaaatacataacctgatctggagatagtgttaaacatctgcatgtgaggcagtttgtgaatttgaggccttaggtaaatggtcatcacgacatttagacatgacatcagaaccagggaggagaccagtatgagcagtgaagggctccatgtctgcctctaaacttaagttcagggtaggtcccgctcgccatagaagatgagttgaaaatcagtgttacccatctaaatgaggaggaagggctaaagcctgtggattgactagagggagggtctgggagttctttttataaacttatatgtatatttttaattgacaataattgtaatatttacggggtagaatgtgatatttcaatacatgcatacaatgtgtaatgatcaaatcagggtatttagcatatccatcacctcaaacatttgtcatttctttgtgttgggaactttcaaaatcctctcttctagctatttgaaaacataaactaaattgttattatcatcacccaacggtgctgtaaagcactacagtttattcccactatgtggctatagttttgtgtccattaaccagcctttggctattccccaacccccacccttcccaggctctagttaccactgttttactcactgcttctatgagatcaactctttcagcttccacatatgagtgagaacatgcagtatttgtatttctgtgcctggtttatttcatgtaacacaatgtcctccaggtttatccatgttttggtgggacttttgactgactcgcaagttgcccctctaccccatgtttaataacctggttttgctggggaattcatatagatgcgctgagattcagtgcagcaacaataccagggcagaatgcttttgctttctaactgaaactccccctccaaagctcttttgtgattgaaaagtggataggctagaaagatgtgtcctagggcttggcatttcacagtgctgaaaaaaagacaagactacctccatattttgtgaagagtgtgatcatcatcatcatcacatcataaaaggatctaaaatgtgatttgatttagagaactctcatgcacatactttgaacttgcacaagtcattttgtgggatgacaatgatgatgatgatgagagaaactctaagaagctagatttctgggatattgtagtctccagctctgtcatttactaatcaggcacatgaaaattgtggttctgaatatatattctaaattaacaggaaacagctaggcaacctaagatctgattttaaattcttttacaaatgtgggcttttattccaatattcattaaaatgcagtggttcaagtgactgaatctgtaacctgtgttaagtgaatgttttttggataaaagttacatttttcactttcaagcctagatcatataataggcctccttgttgccttgtgtctatccccaaagaaatctctgtaatatttttagccatctaagaaaacagttcagacagaggcactcagaaacggtgacaagcaatgacaggaaatgctggttgcactgggctccctcataacttagtgaggccacagctggctgatttgcttttaacttcctgtttggcggctatttgagtcaaaagtagctgtgttttccatatagagttttttttttctttattctgtaaggccacaataaatctgtcactgggctgcatgttttgtatattttatgaactgtatcatgtggtttgagtttaatttggaaggcagtgcttttacaatcaaggtccctcccccaccacacgtgcagctttgtggtctgggattgcatgggccttcgaaagtttatggctttatttacacaatagtgattgctgaggagggcatttcctgccagctaatgactggttggaaggaccaacagtccaaatccacggagagaggaccattcattaaatgccaggaagcgaccaggctgcttttctcatgaagcagtggggagaaagtgaaaccacattctgccctttgaagagcccagagcaccatgggcagagctgggtatggatgtggtgcctcctcatccatatggacaatggagctacttttcctaacagggacaaactacttctttctcataggttgccaaatcgggcctttgatgggagggcatttcctataggtcgatggtccaatagagactggccaaataaagttgagggccctgaatttgccattaacgtctgccagataattcttaactcagaggtgttacagctacttgaaaacctttaatatcacatgattgagtttcctaattggttgaataactcatcattagtaaagtggacaaaaacttggaaaggaatggaaagaatggtttgttttcagggtcagtttagcaggttacagatattttactttgatctcgtaatataatgaaggtaaataatatacatgaagagtgctttgcctttagtggaagtaccattgagagctgtaatagtaatcatttaacccatgacatttccaggaaacagttttgtcctcagtataattcttgcctgctataaagcagctgaggtgtgaacagtttggcattgatttagagcaaaaacagaataagatcgaggctgggttcacatccaggaatccctgacttcctggcctgcccttcactcccttagcttcctaagccttcaatttgctaaaaagttaaatgtttataaaagacaaacatctgttctgagttctttggtaggtacctccatataaaggaggctatgtgacagcgccccccacccccaactcccctgactccatgacttggcttggtcctttatcttgaaatttaaatttctttcatatcttccaaatttggtggggggatggcaggggtgggctgaatctctgaaatagaggcaatcactgatggccagacacctgcatttcttcatgggattgagtaatctgttacatgcagaacaaaccaaatattaagtttcatttttgagtctggcaaatgtcattacatgctttttaaatattcagtaatccagggattgctggtcattaccagttcacaaaagtgaaagggttttctgaagtttaaaatgttccacaaataaaccgtatactcattactgttgttattattagatgatgcccagagcagatttataaacaaaaaagcggctgatgaacaaaaaaatatatatttcaaaatatgattttaatttttgaacatttttgagtttgaatgttaagatacactaaaattttgaaagctcagatgaaagaccgtattcgatttagaaactggtttggactaagaacaaacaacgttttttgtaagtagattggcctgaatatttacaaacatttataattagcaacacagctgtatgtatgtatgtatgggtttatttatttatttttatttttggagttgaagtctcactctttcgcccaggctagagtgcagtggtacaatctcagctcactgcaacctctgcctcctaggttcaagcgattctcctgcctcagcctcccaagtagctgggattatgggcacccaccaccataccatgctaatttttgtatttttagtagagatggggtttcaccatgttggccaggctggtcttgaactcctgcctcaggtgatctgcctgccttggcctcccaaagtgctgggattacaggcgtgagccaccgtgccgggcccggacattattattttgtttagcaaaacctttctttataggtaatctaaaatacatatttcaagctgattcaggttcagttatcacaatctaaactagtggtgtcaaaattaatataggtttactctactgtatttggagccaacagcattaccttgtggtattagaaaagcctatttattctatcattgtaattttcaagtggtaggcaacaactcattagtgcataatgaaatccatttagtaggttgtgactagcatttctattaaacagaattgcattaaatagacagtaagaaaatatcaacatgtgtcatgtagtaagattagatatattgggtgagactgttatttcaaatccatgcacctgttactgagttaggatgtaaagtgtgtttcttactatttgttgccgtcagaaaggtttaaaagtcagtgttttagtggatgttatttctgtgtcagaaatatttttcctctcttttttgaagggaagatggtcaagggatgctgaaggctttcatgataacatacctagtgctgttggttcagtaccctgatagttatgtgtctgcttttcaaactgaacagtaagatattgctatagatgtgctataagatttaatgtccaaggtattttgcaatcctgaaggcagaaactttatatattatgtatttactaagtgctattgctagaacattgggacactgaaaataaaactatctgggaacaaaagccaaaaacggatgtttaacaacgacaacaacaacaaaatgacaactaaaaaccttgggacaattgggtgtgaggtgcttcgaatggcaaaagaattatccaaaaattttaaatgttggaagaaaatcaagctcattttaataagttaaatataagttaaagggctcaaaaattgtttttgattttcataaatcaaaaatggtcatagcaagagaatgtgtttgcaagaagaaaacaagctgattcataaatataaatgtttatgctgggaaaaaaacctgtgggtgtctattttttctgcggtgaacaaaggcacactttaaaatgaattttaaaattgtagatgaggcataagctgaaagtctgttaaatatacctaaaatattaatgggaaagattacagaaataaagaagaaaatagccacatagtctttccaatcactttttttgtgctaatgagtattgagcctagtagtaggaaaacataagattcactcacatgaacagataagagattaactactgaatgcaacccattaggagaagtctggccttagaagtctggccaatttgtgcatattccttagaattaaataattgtcagggggaggaaaatattgccttccgggggtactattgcatctccagtaggatcatgaggagtttgtcttcaccctcacctctcctgcagttccctcccattgtcattaaatctctttctgcctgggacatattgaattctttcccaaaagtctcttcctgtggacatccttcagagccttaaagcactgttgcttcctcaactttgagacttgacatacaataaggctttatagatatttaaatgttaaactgaagttactgctctgaaaatgtaatgtcagcttcttatgagttagtgactaaactctgtcattgtgagtttgtatctccctcctcagatataatacatttaaagattaagaatagaaaaagacttacagatctactgattgtgtaattagcaatcaatttatgaaatgagatgtaaaacaaattaaggaccataataaagggttacatcatcaccaacaaaacccgttattctgtttatgacgataaaaactaaaaaatgttgaagggtgaaattgcatacatgctctgatcctgagagctaaaggttttaattctttcttattctgatgttaaagctttttagaaagcagtaatacatattttggggggttataggatacctttgcccataagcatctgtttcactgtaaacatgtacagagtagtatagagtcagttgaataaggtgtggggggtttgagtgtgagttattcaggattttcagctgtaacaagcatgtagttgactgttctaggcaaacaaaattagtcattgttttgggtgtcagctacctttttcacgttagccttctgggatttttttgttatgggatgcttgacaaattaatagtgataagcaaaagctctgtgagagggagtgctcaagccaactaaacaccaacttatcattcatttcatgcagcactctaactttcatcaggctgtctgggaaatattgtgacgttttatataatattacatttgaaactttaaggtatacatggaactcaagacctttgacaggtgagtttgttttgtttattgtaagtggaaatttccttcagtaggcaatgagactgtcaaggcaaactttcttgtagaatggaggaggagaaaggaaggagagaaagagctgcatggtttcctaacattttgtttggagaactccttataccgcattcctcattttcatgaaatccaaaagaaggttgaaatgctgtattgctgttagcagagttttccctaaactagtaagtgagggaaaccccttcttcccaagaattgcaaccattagcactctcaggaagcctgcaatgatttggacataaggaaaacaaaatatatacaccttctatgtactcacaacattttttaaaaaataaaaataaatataatcatgttgaaaaaaaaacacttgatcatctcagatccaggagaggagctctggctcatattattcctcatgttggataatcattaaaacagaagaaaataaaaccctcttgaaatggcaggttttttaagtgaaaataagtaaggtttccttggacccctataaggagactcttgtgaagcatgcatccagacttctgagactttatactttttgctttctagagcaggaaagacttaagaaataggaagtcagaaagtacagtaaaaatctatgggttctgtgctgttaagggtccctttctgattggcttggtgtgaataatggtatagaatttaaccatgtaagatgttagaggcctgagacttcccttgacatttccttatgctggcaggcccaggcagtttgactttggctcttgtggcacttgggtggcaggagaaacagtgtttacaaccaccttcacctccaggaatgtattatacttttaaatcaatcttagtatctgtaggcaggagtttatatataggaataaaatttgaacccccattttcacacccaataaaaacgtcctgtaataggtgtttattcagagtcaactgacatttattgaacaattactgtgtgccagatgctctgctaggtactttcattttgttatgacagtttttttaagttatgaaatacagttggttctagctgggcaaatactctctttggcatctaatagatatcaggctaaaaattgcatcctcaagtccctgctcactttttgtataaaacacaccccccaacacacaatcatttcttctctgtcttgcttcatcatttgggaaccatctaatggcccatggcctgcctcttccatccatgaagatatttatttcattataaatcaagccaacactaatctgttacccatcttgatgtaacaaaaggctgctttcactgtttgatggatggtgctacagtaggataggagaaacaggaagaggcttgagaggtggatgaagagtgaggggtcaggagtgtgaaatgatgtggagttaagtgctagtgaaagccatgtagaaaaatctagaacaaaattggattaaacttgtccagaatgcagagaaaataacaaggcaagatgttggaagttaatccctcacccctaggagtggccaggacagcccaagttgagcaacacaggaggatttttttttgttatagaagcaaagggcaaagaaagtctctaaaaggagggagcaatcaacaaataccacaggaattatgtaagttgaggccactggttttggcactgaaaaggttgttggtgatttttgagagccaagaagctggtttccagtgggttgaggagtaagtgaaaagttggaaagtgaaagtggtaatgatgactttttttcagatatatgatgatgaaggatgagatatgttggaacttaaaaaggaaattgcatcaagggaaggaagggttttcttattaggatagagatgacttagatgtgcttactggctgatgagaaggaagcagaagagaatattgaaaatgtctgtcaagcatggaatatgttctgagtggctgccctacttgcgcaacatctctgttaatatgcacagtattaattgtgcagtctgatcaagtaattcatacagaactctggtgagcctgaattttgggtcctctttattctttttgcctttaaggtggaggattaggattgtcataaaagaactgggataggtacaaccaaaaacaaaaaaggaggagggggaaagacagtggaattcagctaaaataacagataggattatttttaaatggcttcagaggcaagacagtgctactgaaatagcgaaaatgtgactgacatctttttacagcacatactcaatgaaaatgaaagagagggttggggaaagctataaaaatgagaattcaaatgtaactatagaggatataggtttactctgatttgcctttacactaggattcagtgtctttcataaatttggaaatttaccatagacattacttcccttatgttgcgtctgacaacttcagtttttcatggattttatatttcaacttgtaaaaataaaaaaaataacaaacctcaggtctggttcaattcccctcattttaatcaccatcccctttctcccatctagaagaatatatttcctcttttcttagaagcttatgattattgatagaaaatatctctaccttctctaccttaagctttgaatttaatgtctaggttgattctagtcaaacaaaaggtgatgctgctctgaggttctgcaaatttctttttactctgaagcggaaaacgatgcgaattttcaatgcaaatacattgaaaaacttaaatctttgaagttatattgtagagatactaatgatctaaaccagcgttttcaaaactgtgtttattttgccacatggtctaggataaaaaagatatactaggtggaatgcctgagaattgaggttgaaacaaataccacattctgagaattaaattgcattaaggctacattcctaaaaatatatataaacatatgtatacatatgggttttttttgtgtgcgtgtgtgtgtgtgcgtgtgtttattcttctaaatttcagcttttagctttttatgctgcatttcaagttactgtgcaaatattacttgttgataagaatttaagaatactctatcaataggaatcaaagtagattaacggcatcttcatgccaagagaacagattgcacaaaatcaacaggactttagattaaaatatttccccaatgctagagaaaaatgtttcttaaatgcatttctaaaatgaatacaggaattttgcttttaattttttgtttatggtttctagtataaattctttatcattttatactggggaaaatagatttttatagtatcctatatagagaagcaaatcaaatggctttacatttagattatggaggatatagttttactttgttgaagtaaaaatattcagcaggtttaaattctgaaataatagcatgaatgagcttattaagcccatgatcaacgatttgcaactgtttgcttgataattggaaggattgcaaaggaaggcaagtttatatggttggtttaaattaaggctattgttttgagggaatcagccagccctgtaatcaagttgtgaactcagtgcatctctgaactaattaatttagtgtgatatcccctcaaagtccgtgttctgtgttaccaattagctacacctcataggaatcttagtccctctttcaggatctgcactctggtttaatattatgatgattatttactggattcagttaagaaattcaatttgcaaacagatcctttttgggtttggatagtatcaataatcaacattctcagaatccttttcctctgtaaaatagtatttttaacaagttttacacaatgaaattaagagaattaaaatgggaaacctatagaaaagatgtattttccccaaaagtctttactgcattatcttttggggggtatgtgtctgtatgattaatattacaataaataccaaagaaatgacgagttgtttgttgagcttaaagtggaaaaattccagcaaggaagacacaagtgagtgatgagagagtatttccaaacatatccctcttaaaatgtcttaagatggcttttcagtaaaaagcttttgcctccatctctgcccagctgcattttagttgagagagagaaacatttactttaggatgctaagtaccttgccttattcaaagatagagaagcctagtgtgaaggacttgtgatcttcgagaggtattcacttcttccaattcaaattccaatcaatttctcttgtgtctgtacatcatcagacctcccttttgtctgaaagtgcaagctcacatttagccctttagccccagttcctggtgcagcatcaatgttcctaaatatccacgttgacatccaaacttttgtatcctcttttcttggcaggaatttgattcttccaatactcaaattgaaaattgtgcccttaacatgtgtagagcagttggcacaaaggggaagggcgctaatttatctgactctagtcaataagcctacacaatttcacatgaaaaaaagcaaatctacaaaatacatggagaaaagttcagtataccagttgtgtgtgatgtctgcagttaaccttctatagcatatcaatgctggcatcctcccaaggcaatcttagcccaggaaatcactatacttataatcttggaaaattgcttcagcaacaaaatatattagatagcaagtcttctttttgtttgcaaagtgtatttacagactacgtatgtattatgactttgtaacagggcatcctaagtgctaaatatcttcccttcccccctgcagcatgtacacacacaaataaacatcggaacatctttaacttatatttaaaccacagttatgtagtatcttgcagttacattgtatttttatttatttttattttatgaaaagggggtctcactctgtggcccaggctgcagtgccagtggcacgatcatagctcactgtagcctcaaactcctgggctgaagcaatcctcccacctcagcctcctgagtagctagctggcaccagaggcatgtgccaccacgcttggctagttaaaaagaattttttttatagacagggtctgctatgttgcgcaggctggtcttgaactcctgggctcaagcgatccttctgcctcagcctcccaaagtgttgggattacaggcgtgagccactgcacctggcccagttatattatagatgtgtagcagttgtgaaaatttttcatttgtgttttcccttgtaataactgacctaaaataaatcatttaatcatatctttttattttaatgtaatattaattgatagccagtttttagtttcagagcgggtctaactgtagaactatccactagggagaaaaaagggaaaataattgatatcatattaagaagtggcgggaagaagtgatgtaattttgtacttttttctaatagtaacagctacttactctgtgctagtctctgtggtaagcactttgcacatgttatctcatctaatcctcacagcaaccctgtgaatttagcgttcttatttatctcctttttacagatggggaacatggggctcagagagaggaagcagcatgccaaaagacattctgctagtaaacagtagcatcaaaacttgaacttgatgctctaacattggtctatgcctataatccccatggttatattatggaaatataaaaaaaggtttgattgggaacttgagtttgctgcttgtcacttccacagtgtattagccatctaggattgggcactggataaagatagtgctgcttgaatgaagtaaacatctggaaccaccagacgcgacagacattacaattcacttccaaattatagaattataaactgttagaagtggaggggggaaagcatcatttgattaataatacatttgtacagaataagactgtttggcacaatattgtcagtaatagcaaccctaaatgtttcagacttttaaaagttgtattatggtgggatttactattatttagcagagctagttcctgatatttttctaggaatgtctcatttaggagactttaatgtaaactgttaaatgtctagaggaactatagcatttttgaaattacagcttgatttttccctgatatttggctccctaggactttcctatttcactctccttttcatccccctttcagtttttttgttttgtgtttttttttgtttttgcatttgttattcattcaacgtactttattgagcacatactatgagtcagccatgtttctaggtgctgaggatataactctgatcatgtaagtaattaattttagtgttaatgtaagtgaattagacatttttctataaattgagcctcacaaaacaccattacctttattgccttagatgtccttctttagcctaatcatgttgttttaaaattgtactgatttagtcacaatagccaaaaagtggaaatagcccaaatgtctgtcaactaatgaacaggtaagcaaaatgtggcatacccatacaatggaataatattcaggaatagaaaggaatggaatacatgctacaacatggacgaaccttaaaaacattgtattaaatgaaaaaaggcagacacaaaaggctacctacgatatgattcaatttatatgaaatgtccagaaaaggcaaattcagggacaagaaagcagattagtgttagtggctgcttagggaagaaggggtgggagcacagcctaagaggaatggggtttctttggtgggggagtaaaagtgttataaaattgactgtagtgatggttgcagatattattaaataatactaaaaatcactgaattaatactttttcaaagggtgaattttatggtatgtgaattatattgcaataaagctgttattaagaattgtactgacttagatatgatatatgttatattattcccattttagaattacaaacttaatcaatagctaaattgaggggattgttgatctatttttaaacagaggcaatggattggaataactttggattccacttattctttgttctttatgggaacagttgatttcttacctgaagacccacatcaactatctctgttcttacagatgccttcctttttggtcccactatttactgggcacttggccgtgctgccttacatgtggaccaaatcattgccttcccaacatctagcacaatgtcttccatatgacagatgtgcacaacttccattggtttagcatgtacttgttgacaacttatttgtatgtagtattgagccagacactagagatgaagatgtgtcctcaaggagctcacagtcagccagacagctaagcaggagttacactacactgtgacaaatgttgaggtggagatgggcagacatgtttgatggggatgctgaaaccctgcgtatagttctgtgtctggatctagttcattcacttatctgatatggataccccatccacggtattcttctctatatttgaacacatccagtaacaagatgctcactttttactaacacagtgaaattaaactgcatttttctaatctaccaaatgcccatgtattttgacatcaaatccatatagtacaattacatagtttgtaaataaaacttaaatagagctgttaacattccttggcacctccagaaatgatactatattgtaatagaactttgagtaatctttattattttatagaaagtacttggatttttaatgtgccaaaatctctggtaacaaacatgtataaattttagattatgtttgtatacttttgtgcccattagaggcagtacagagtggtgattgacagtaagcattttggaacatgcctgaatttgatcctagctcttccactcatctgctgcataatctcgaaccaagttacttagcctctctgtgtctcagtttcctcatctgtgaaatgggtacagtaatggaacctgccttacagggtagttatgagcagtaaatgaattaatatatacgagtgtgctaaaaacagtgccttgcacatggaaaacacatgcatattttctgttgttatattttcaattcaactgaaatgccatgttttattagtctgttcttcataaatcatacacactcaccgttaaatgacattcaagtcattggaaattgaatgttccttttacagggacctatagtttttgagtgttctcacaccaaaagccagctagattttctggtatctgtacttgaaaataagaggtcacggttgacattcctttctgctccttttgcgtggtcacagagttttataatgtcacatgcctatctcctatcagttagcttgataaaatctctatagctcacacatgatttcatgccaaaggatcagtgcttttaaaatgtttgatgcatagttacaaatccacaggaaataaagcataaacagtgttggatttacactttttgactgcattgatgccattctgtttgcgagtcttgtgatttacaagggcattttattttagtcagccagtagcatcattggccagtatgctgtctagggaccacaattcagtggtgacttgcagtctgtcttgctgataaatgtttttggcagtgtttgggagttctgcttggtcaaaaattgacacatacaaagtaatttagaataataacaaattaacattgagattattgcttttgccttagtgcagatgcaggttactaataacctttcatctttcaatattgcttcatatttattatttccagtacagtgatgatatatagtcattttcaagattaagcagaagtataaacattgaaaatggcctaaaagagcgatggagctagtttggcacagaaaaacagaagcctgttgggacaagatgctatactatgtgcgacttagtctggggtttacaggagattcacttttcacttttaaccttttgggaccaagttgttaacaatgtctcattgtacttagatcacaattttatctttgccattaaatgtaaatatattgctgttaaatgtaaacatatgactgttgtatccacaagaaagtttcctcagcaccaataagaaaatgagttaatgatagttcttatgtgtattatcattattaatttttaatcagaacttcccttaaataaaatgcacaagcagttaagttgggtttacaaacttaccaacaaatagtctttataacctgctgtaattatctctagaaattttaatgtgttcagtgactaattctccagagcttttactaagataaataaacagaaacagcaataaccagtttccttgtatttcttaattattggcgtgccttttagtcgtgttttagacttaaggagggctgtgtctctctctaggcatgcaaactatgctttctcctagttggcttcctggaaaatctaatcctccctcttgctcattgactcaagtccaactaagctcttgtatatcgcttcattttgtgcatataatgtcaagggatttgaatgtgtggtagtagtctgatagtatgcatgtgtatggccatatagtattgaatagtattgaatatttattgaaatacttccttactggttagtaaatagatactgcctatagtaccctttccaatgctcactccctgacaaccccccatgattcagcaacaaatatggcaacacttggcagaacaccatcagtattgatttgcctgtgaccatgctataagaattgtttaacattttgagtgtcattcctggctcatggtttactatgaggtcagccccctgcctcaccgaccaggccattggtgctctgtgacattcacagccttttgctgaacagtttttcccagattgcttcctaaacatcagctagacttctgagagaagagctgtatcccataaagaaatggcatactacttccagacctcagcttctaacagacactgtagatctcatgaaggccaggcccttaagcatttaaaacatactcatagggaacctcccaaggccctctctaagatcactcaagagcccatgtcatttatattttaagacccaaatcttaaagactcttgattcaataccttacacaaagcaattgtttgctacactttatttgattgaatgtgactttgcaaaccacagaaatttaatcagtgtgtttgtgggggaattaatagaggcagaggcatagtgaagtcatggccaataaatagctgccagtgaggaagaagatagacaaactgtaaaaagtggaaatgaagacaccaaaaacacaggcatttggggccgtttaacaaagtgcccaatatatccttcaaggcattactgaagtttctttctaatgataacctagaattatcagaaaaagcattacttttttcactgtcttatgtctaagggggaacaacgttttacaaatcacttcagaaatatttccaaagattgattaaaagagacaaatatcaatttataagggttttgttttttgaaattttattcttatggatctccttgcctgacatttttccaataaatgaaatgctgtaataagaactgtatgtgaacttagggacttttgtagtatatgatgggcttgcaatattaatcaaaattatttgtcatagaaattatcacagtgagaaaattattttgggaccagagtcagcatcataaataagtatctgctctcagtgaaaatacttccaaactcatagagtttgtttgtgaggtaaaagaacacataatattaatcttcttagtctcttttttcaaagaaatatgattgaagaattattagatatctcactgataacagtctaagggagcctgttcaggaaatgtctaaaatgaactggtgtcaccattgaatgtttacatgtacaccttttacttttttataaatatgcatttgtatttggagggaaaattatttttctgtcatcaatatcatatatgcttcaaaatacttgtgcattatttaaaaatagaaatgtggactaaaagaagaacgaagatgaagaacactaactttttaaggttcgatttaccagtgtaacttttaaaaaatatcaataatactttgcttatcatatgaggattttcaagtgctgtgtgaatgtgaatgctcacaataccctgtgctataatacagagaagataatattatacagatataaatgttacttgtgtgtgccaacaaccacatgtattgtttccagaatcatagcttttaaagttaagtttagctttgtaccattcatagtgtaatgagcaacaaatattccaatttatttaaaagtattaccactaccataacaaaataaatacatagtagcttacagcttacaagatgtgccctagagttttctatgttcaaatatgcacacacacagtaatttaccagaggtaagctttttgatagcctgtatattagaatcctatatatgctaatatatttttgaaaacctactatgtgcttagcaccaaaaagtctgttttacttccctttttaaaaagtttttattatttatttatttactttgagatggagtcctgctctgtcacccaagctgtagtgcaatggagcaatctcagctcactgcaacctctgcctcccgggttcaagcgattctcctgcctcagcctcccaagtagctgggataacacatgcatgccaccacgcccagctaattttttatttgtatttttagtagagatgagggtttaaccatgttggccaggctggtctcgaactcctgatctcaagtgatccgtgtgccttggcctcccaaagtgcaggattacaggtgtgagccaccgcaccggccagatggtttttaaaacaagctcttcttacctctccttagcatataaaatgtatttggatagtcaatacaataagacttttgtgtggttacatctttagttgatacagcaccattccacttaccactaatggtcttgctgatttttctattggcccgaataagctcgtaaagaaatggcatatggaattaatgtttttttggtgttttaagtttcacttctgagttcccacctagatgtgaaaaccaagagccccttcattctttactgttattttatcaacctttgcaattgtgaggagaagatattcttgattttaacttagcatcatatttatttacattgtatgatcatattatttcttttcactgagggctactgatacattttctcaggtgcattgaaatattaattaagtagaacccaactgtctgaaacccacagtcgacagaagttttatttgtatttgattattaggaaaaatttgaatttaccaaggattcagtgttaagaaaagtataaccacgttctttagtaatgagagaaagttttaattccgtttacgatatgctgtttaccaagacaaaaacaaggacttgtattttgaaatggtttctatcaaaagtggtttttagtaaccatgattaaaaaattaattccgtattttcattaaatgaatctatttcacatttctactgatttccaacaatattgtgctttatcttttcataaaacagaggaagaaaatctatttttctcatacatccattttttatgttcataatctcatgccacattattctcccctaaccccttaaaaattgcagacaaattttttagggacagtgatggcttaaccttttttaactttggcacatatacagatcatgtttgtttgatagattataaatgagaaatttatttatttctaaatcttacacagtgataggaattgctatgcaattgattgagttctaataatctgtatatcttaaataccacagaatgagaaaaagcagtcattgaaaaggcgtggttttagtaatttcttaacattttatgggatacttttttttaaaattgtgtgcgaaactccttatttttaactagccactatgcttgcaattctgttatctgccactaggtggtgcgtggttataagttgtaaccatctgggcttgccgtgtgtggataacaatgagaataggtttatagtacacaactgaattcgattttttaatgaaaattaatgattaaaatggtcaatgtaaatattccttttgtttgtttgttttttgagacggagtttcgctctgtcacccaggctggagtgcagtggtgtgatctcggctcactgcaagctctgccccgcccgggttcaagcgattctcctgcctcagcctccggagtagctgggactacaggcgtgagccaccatgcccaactaatttttgtatttttagtagagacggggtttcaccatgttggtcaggctggtcttgaactcctgacctcaggtgatccacccacctcagcctcccaaagtgctgagattacaggcatgagccacggcgccccgcctcaatataaatattcaatcagcttccaagtatagtcagattggtatgcatttttaaataaatgagagtgcgtaattatgagtacttttctttcaccaaactttaaatgttttaaatcacctcatgtgctttctttagtttttctttaaaggagaacttgattctttacgttattcaaaatttttttgtttattaaaaagctctgggccctatgcttatggacaacttcccgtggctctttgcttatagctttctcttctattgccctagttaattgttttgctactagttctaagtgccctaaataactaaagtctggtttagttgggtttcaggtgaagtgttaagctctagcaattttatataggaaagaactgtgtcacgtattgaatacagtgtgtgagtagttttagctcctttttgaccattagacataagattccacacctatgtccaaaaataacaacacacacacacacacacatgcatgcacacacacacacatagtgcaggtgtactcacccctccacacacactggtttctaacagtatagtatacatatgtggacatgtggctgtgtctttctttggtctctgaaaatgtcctgcagtggtctctcttccaccaactagcttccagcttgtcactcattctaacttatgctttcttgtggactttgatgcttggattggtataaaaactaatttgcatcaaatagtgaaattacctgtgaacttctctagcagattcccagcagttttacagtctgctttgcaaaaggaggccaatagtctatttctactgaatttttgaaaacatttatttcaacttcccattcaaaaaaatagaatggtttttaagtagagacatagttgctttagttctttgaccacatgtattatcatgccatgaaaattgggagtttaactgtaaagagaaacaggagagagagggaggtagagggagagagagattgagattgggaaagagattgagatttaaactttctccaaaatgtagaacaaaatattcaactccagttatcagaactgagctcttgtgttggctctgtcaccctttgtgactgtgtcatttatcctctatcgtcctattgtcttctctgaaaaatgagggagttggcctgtagatcatcactgcccacattgtgagtctgtaactcaggctttcatattaaagcaaaaatgtgggggaatgcatagtttcaggtctgcttgcattcatgattgaactactcaacttcctataaaaagcacagattcttatgtataatagaaatatgtaggttcattatttttatttttatttcttgcattttctgaatcatctgctatcaatgtagtgctttgcacttgggatatcttgttagatataccatattcccattcatgctaaaggaaaataggaaccttgcaatgattatttttttgtttacatagatacagtcattgtgatctacaagaaatactgccattggataagagagtgcattctaagagggcaaagcttgtcattttatattctttttaaataaaaaagcaagtgaaattcagaacttaatcatatgctgcctctgatacttttggggtgtgagattatctccccaactagattataagctcattgagagaagaaactatcttgtatgcattttgtgtcacccaaaagccaaatgcagtgctatgtacctagaatacaggttagaaatgcacttcctctctgatactataataataagttattgactcatggtatcttagccttgtgtggtcgtttgggggtttctagcccaacttcccagccagtgtgacagaaatccagtgaagaggagtgtaccacccagaaaagcatttcaaaacactttcggaaagctcaagctgtgagaaggctcttcactgtgttgagctaaagtgtatctctctgtaccttttacctgtagatctttctggaaaaacagaaagcaaatgaaccacttgtctttatttttttcttgttcatccgtgttcatctccagaatttatcattttgtaagtatttatataaggaccttgatggcttcagagcaaatacataacaaatcattttttaaaaattgagtcattgcagccataaaaaggaacaaaataatgtcttttgaagcaacttggatggagctggaggccatgattctaagtgaagtaactcaagaatgcaaaaccaaataccgtatgttcttacttgtaagtgggagctaagctatgaggacgcaaagacatacagagtgatataatggattttggggactcatggtgggagattgagaggcgagagtgagggataaaagactacatattgggcacatggtacacttctcgggtaatgggtgcaccaaaatctcagaattcaccactatagaattcatccatgtaaccaaaaaccacttgtacctcaaaggttgttgaaataaaaagtaataataatttaaaaaattgagccactataaagtaatggaataaggtttgtcagatttctatttctacactgaatgagataagttcaggtgatttatttcagaagcacttaattagtatttactctgtgccagacagtattctaagtcctttacaaatattaactaatttcaatctacaaaacaaccctaggagatagatactattactgccaccattttatagatgaggaaactgaagtacagattatttaggtaacttgcccagggttttcaattagtcagtaagaagtagaatgatgatcaaggccttctggctccagaatcctattcttaaccactctgctatgctgggataactgttacacgtttcaaaaaattctaggacatttaattttgtttctcttgttctcttaagtaagaacctagttgtttaaagtttccaatttttcatgagaacttatttaaaaattaatcttaaaagatctggaaaagatattgctttcatttgttctgtttgtgccatcttgaagcactctacctttatttattttgattatataaaacttttgcctgtttaattaattgacattgctactgtctgggtaagttttactatagtctctaaggatgctgttacatcagctctgttttctatcccttgggcaactgttaacttttttccgtctaggtcccttgcactctcccacactttatttaaagcttcaccttggctgaagtcaaacctaaaacaccaaataaatactataattggctcatttttaacattttctttgaattcctaacagcccatttaccatatctgtcattaactgggatcttggctttattgagtgcctacctcacaccaagcatttgcacatctgtcatatgacttattcctgctaggaaactgagatactgagtttaaatatctggacagaggttcaaattcaggtctttgtgattctaaaccttattctgtagtgtatacaacaacacactttcttcacttctctgggtctggtcttagtttcctcacctgcaaaagggaaaaaaatatataaaaagtagactgagagcctattaagtgttaggcaccaggctaggttctgctctgaaggggttcacagaaatagacaactttaatttaatgggttcatggtggtgatgtctgtttgaacagtgttttgagtacccattgatcccttttacttggtgtaaatcaaaagctggctctcgcagaataagtaggatttctcccattctaaggaagcacattccataatcctataagacctttaaatatatttttaaaaatcaaatttatgttgtactcttctttctatacacaggtttattaagtatgtggcatggaaattatagtttgttagactattaaagttcatgagaacaggaaccatgtccactgccttgtactaatacttaatacatatttggaaaacaaatgaaagaaaaaatagttttaaatatggagactcttacacaactgacaatttgaagttttaatgagtaactactatatagtgcacactacctttattatttatacaaatttcaactcaactagtatttattgagaatctagtatgccaagtactgtactaggagaggtaatattcaattcaaattaatgttctacttgaatgcagtcattgactctaggggagttttaatagaatgattgatagaagccatattgtagtacatgctggagtgattaagggtgaagaagaggaggtatcaggtagaagaagatatttcaaccatgaaggctttggaagccttcctctagagggaggctgagttgaagtttaggaaagtcacatggatgtttgttggggagacaaaattacagctcaagtgatagtgggaagaggcctgagaaacatggtcaagggatagatgggttctgctgtggtttggatgtggtttgtccctgccaagactcatcttcaaatttaattgccaatgtaatggtattgagaggcagtggggcctttaagaagtgtttatgtcatgggaattccaccctcacaaatagattaatgcagttctagtaagactgggtttgttctcatgagagagtgttgttataaagtgggccaaccactttgtccccctttctttcgcatgtgtctacttgttcttccacttcccactatgagttgaagcagcacaaagcccacgccagaaggactgcctaatcttggactttcctaccttcagaaccatgagccaaaataaatttattttctttataaattacccagtctcagatattcctttatagcaacagaagatggaccagttcctagtgatgatatggtttggcctattcttcagtaaccttgtgggcctacacataagttttttttttttttaatgaagggtatataacatcaggattcctaaaatcatatcacttatccactaagacattttttgaaatttgtttgaaattttgaaaataaaatgtaaacatgagggactgtggcttatccatgtttgtaccttcaacatttagttatgtggccctgagttagttcttactgtgtgtttagtgaataaatttatagaaggttaattatggataactgctattgatatacactgaataaatggatataagccatctaccctaaaaaaagatttagaggcctacatttacctgcctgaaggtaatgagctagacttgatctttcagagttatttccagttctagaattctcaaaattcttaccctttactgaatgaatcttatttgacttttgacaaacctgaaaacatgagttgtgttgtttccgtaattactaatatgaaagctgctttgttgtttgaggcttgagtatcttcagtggaacaattgtttagtagtacatgtaatagataataccatccatattagaccctgggaatttcagcctagttttatgtcagtgtgagttgaagaagtttgtatttgctgagaacctttatgatcttttgtaggattatactgttattttaaatagaatgaaggcattttggttccctttctgtatatggaattatatggctgtcagatttaatagtttaagccattcagtacctagtgacatagatgatacctacatcacatgattcctacctacagtataggaatccatcaactttgatggactttctcttcacttcagtataaatgtaaatgccctctttaaattactatttaagccatgactcctcctcctccatctcctcctttttcacctccttcttttttgcctagccatttaagctgagttgatttttgagatgattcttaatctatagatatcttcttactttccatatatgttggtacttaacaacatatatgtacagacttgcttgcttgtttgacttcagtatttcccttgagttttattttcaaatccctgttttatttgtaggctcttactcagatcttgtcctgaaaacctcttgtggtgaaatctttttttaaaaaattttgccttctttttatgacttgcacactccagattttgatatagtaaatttacaagttagcaacagagttgaatttgtgaaggtactgacaatcttgttgtagtattatagcttcctagttttttcataatttccaaatcttggttcagagatttcactttgatttggatagccatttttttggtagaaaaattttatttttagagcaaggacctaccgtgcccaagggcttttatgcttcccttctgccagctggttgccagatttctggaccacatgttcttttgaatgatgattttaaacccactatgtcaagcagtttctaacttatttgccagatatgtatgaaaacatataccttccaaattataagcaattcaggatgctctggcttccatgggtagggagtagtaagctttcttattgtcatttcaggaatctggggtgggggaaatgagaacttggagattttttattggtgtttatgactcttatgatttctgagaaatttaaatattgaaaaactcaatacaatgatttggtaacaagtctagaattaaaatttgtgaaagactgatttggtttttaaatgaaattttaatgttgccctttaaaagtatgtacctcataggatattggggatgattaaatgagaaaatgaatataaaatgcctagcacagtgtctggcacagaataagagctccatacatgttaactattattaatatctattacttaataatcaatagattgaccttggaagatacaaatacctattagttaataacaaagattggctttagaatgcgtcatatgatatgctcagcaaggcaaatttatcttcctcattgtgttctagtggttatttgtgaatcctaaactcactcttagaattcttacttaatacaattcccagtatcccagttgattagaaattaatatagaaaatattttgtgtagacacagtttatccagaccagaggataacaggagaaatgggctcacagaggtaaacacaggaaaaagagaggacaaaccaaattatttgtttaacagaagaaatgtgccagatctcacgagttttggcttgcaacagactgtggccaggagggtcagatggttacaaacaggtaaactaaatctgattctaacaggttttagaaagtagagaggatcaggtagagtatgatagaaaagctgaatccaaagtttggacaacttgtagtagagaggcaattgaaacaaaaccatgtgtgcaaagaagatgttgttctctgaaactgaacaagggtgtcacggcagttgtgttgaaattaatggaagacacaggcccacagaggtcaatgaatctttataactcagaagcaagcgattgcctttctccagggatttaaagctacagaagatgtccttctggttttcagtagtgtgaaaatgcctccatagccaggaattaagttccaacatgaatatgagctgtcaataaaacaaactaaatgaaccgggacaattgggttaaacttttgggactctgcctacccattctgatcacagattgccaagatatcagataagatgaaattacagcgtgagctcttcatgtgtacactaaaaattttaggtattttgtccaagtaaatgaatccttctgggcctctgttcaaggttgaagtaatcagtaggttactttgtccctcactggctttgataactctattatgagcccattttatttggaatattttcatatttgatgtatacttgattgtccgtatcgctttttgatatccaaaacgtggatttaaatcgcatgccttgcaaaagtcgacacagaagttgcttccccatttattgacgcaaatcagagttgaaaatgatagatttcatagcattgtttttattgaagatgagtattagattatgtgggtaaggtgttgctttccaacctcatggtataattaaaccaatctcctttccagctcccctctactttgggggttctataatctttcttttgagatttgttgagattgatcttggaagatggaagagaactattctatctgggccaagaagatgactttataatgactgtattatatttacacaactttctttagtgttaacaaggacattgactacttggccaacattcaattaaaagatgtttaaaagcaagcctatgttgcagttcctctaaatttttccataaagaaaggcccacaatttccagtgaagcataaatcactttggaatatcaagagaaaaatgaaaatttttattttagaaacttttaaagaaggataccctcaggcctgtgtaaagattgggaaatgtagagcttaagactgtatcctgtctgtgctcccagcatttcactcataactttttactaaagcagccaactttccaatgaactctaggcagttggtttgtagatatgtatttcagtcgtgtgtgatatgaatgtgaaataatgcttctagaaacagtaagttgagacacaaagggttagagctcttgtgtatactttcctagaaaattcactttcccagaaaactcccttcaaggctactggagggtttggcattggtctttgaaatcagggtacatttgggactctcccaacattttcagccacagagattttttctcttataagtgctcctgataaggagaaggtacttagtatggagattgagaatctgaatttattggctataatgccagtgatgaactcaggtaaggaagccctcacaggatgcctattaggtatagtagtgaatccctttacgacattatatcacatggatgctaccttagtttacctctctgccaaataattatccttacgtgaccctcatgtttgactagagaattacttgagctgtttataattaaaggatgaataaacatttagtgatagcttttgatatgtgtgtgtgtgtgtatgtgtgtgtgtgtgtgtgtgttggtatggggaggtgaacagtgaatgttcaaccaaatcttatcaatgaatatcttggccaccaaaatttaatttgattcaattcaatatgtactttgggagaaccatgaacactttcttttttctttttctttttgagacagaatttccctctgttgcccaggctagagtgtaatggcatgatctccattcactgcaacctctgcctcccaggctcaagcgattctcgtgcttcagcctcctgagtagctgggattacaggcatgtgccatcatgcccagataatttttatatttttagtgaagacggggtttcatcatgttggccaggctggtctcgaactcctggcctcaagtgatccgcccgcctcagtctcccaaagtgctaggatgacaggtgtgagccaccatgcccgtccacatgaacactttcagaccactggtttgaaaggggtgctgcttaaagccctatagcaggaatttacaggatgccattatacccaaaaatttattgttcaaatttagttcctggtatgagcttattatttagcaaaatgtaacaaaaaaaccatcctagttgaaagttcaactacatttttaaaggaatttctattatagagataaagattgaaaagtatttgagtcagttcagaaaataggaatgctgctatgtgtccttaatgactggggtcattgataaatgatgggtaggtagcaaaatgcaaagaagaagctataattttctgtttcccaacctttttatgttggccggtcttgaaatactctctatcttgtcctcacggagcctgtgaagtagagaaaaacactctgacctttatctactttcgcttcaccttttgttcttccacagtacgttgagtgcatgaactttactctgactctgtgctgtgggctccttaagtaaaccaattttccaggagcagatcattgttaacattctacatttatggcctgtaagattctgctctgcttcaagtctatgagagaggctccttcttctataacaaatatatactccttaggtcactttccaggttcttcagaaaccacccacacattatttctcttccccagtataaacctaccatcctaaccagcccatgtatgctcaccatcctacacacgccaggtgcccagtctgatcttccagcccttattcatgctgcttcccttttcagaaatactatctgcctctcttgccttcatctagatccttctcattctttaaggcccagctcccctttcttcttgaaaactcctttaactactccagactttagtgatgttctgttctctgaactgtcatcagatttgttgttaatgttaccaaattttgttcttaattgtctgcattgtttgcagacatatcatatatgttgttcttacctccccaactaaattaggggcttcttgagtgcagaggcagttccttaaggttatactaattcccaagaagcacgtgatacagatctgtgcaggtagttggtatacaaaacatgtttgttgattgattggtattttcctatattaatatttttaaaggttttacttgcattgatattaaatatttgttgattggataaaatgaatgatggaatatatttctttgtttattttctgcccctctggccagtcctcacctgctaccactcacttgaatgtacaagtcaaaggacagggcttttgtgttgttcacctttgtttccccaggacctagataagggcctgggccatagtggatgcctgataaatgtctgctgagtgaattgtcagcaaaatcaccccacgtatattaaatggaatcagtcttggaacccatttagtatttcattcatctcaaatgcttgagtattataggattggaagtgccaaatgtgtcaagcttcctgttgtcttcaagttgaaatccagtttttggtgaaagaagaccttttaatggcactgggatttctgtcacatgcacatacgcaagcacttaatgagtgtgatttaataacaactatgtttaggatccaggttttcagctgttttatattaaattgggctagtttaacatatttaagtggtggattctgggtgtagagcaagatggtagaataggaacagctttggactgcagctcccagcgagatcaacttagaagacaggtgatttctgcatttccaactgaggtacccagctcatctcactgggactggttagacagtgcgtgcagcccatggagggcaagctgaagcagggtggggcgttgtctcactcgggaagcacaaagggtcagggaactccctcccctagccaagggaagctgtgagggactgtgctgtgaggcacagtgcattcaggcccagatactatgctttttccacggtctttgcaacccacagaccaggagattcccctgggtgcctaccccaccagggccctgggtttcaagcacaaaactgggcagccgtttggggagacactgagctagctgcaggagtttttttcataccccagtggcacctggaataccagtgagacagaactgttcacttctctggaaagggggctgaagccagggagccaagtggtctagctcagcggacccccacccccacagagcccagcaaggtaatatacactggcctgaaattctcgctgcaggcacagcagtctgaagtcgacctgggatgctccagctttgtgaggggaggggtgtccaccattactgaggcttgagtaggcagtttttccccacagcgtaaacaaagccacctcaaagttcgaactgtgtggagcccaccatggcttagcaaagccactgtacccaggctgcctctctagattcctcctctctgggcagggcatctctgaaagaaaggcagcagccccagtcaggggcttatagatgaaactcccatctccctgggacagagcacctggcagaaggggaggctataggcacagcttcaacagacttaaacgttcctgcctgctggctctgaagagagcggcagatctcccagcacagtgcttgagctctgctaagggacagactgcctcctcaagtggggccctgacccccatgcctcctgactgggagaaacctcccagcaggggttgacagacacctcatacaagagagctctggctggcatctggtgggtgtcactccgggacaaagcttccagaggaaggagtaggcagcaatctttggtgttctgcagtctctgctggtgatacccaggcaaacagggactgaactggacctccagtaaactccaacagacatgcagcagagaggcctgactgttagaaggaaaactaacaaacagaaaaaaatagcatcaacatcaacaaaaaggacatccacacaaaaactccatccaaaggtcaccagcatcaaacaccaaaggtagataaatccatgaagatgaagaaaaaccagcacacaaaggctgaaaattccaaaaactagaatgcctcttctcctccaaaggatcacaactcctcgccagcaaggaaacaaaactggacgaagaatgagtttgatgaattgacagaagtaggcttcagaaggtgggtaataacaaactcctccaagctaacggagcatgttctaacccaatgcaaggaagctaagaaccttgaaaaaaggttagaggtattgctaactagaataaccagtttagagaagaacataaatgatctgatggagctgaaaaacacagcacgagaactttgtgaagcatacaaaagtatcaatagctgaattgatcaggcagaagaaaggatatcagagattgaagatcaacttaatgaaataaagcgtgaagacaagattagagaaaaaagaataaaaaggaacgaacaaagcccccaaagaaatatgggactatgtgaaaagaccaaacctaagtttgatttgtgtaactgaaagtgatggggagaatggaaccaagctggaaaacactgttcaggatattatccaggagaacttcctcaacctagcaagacaggccaacattcaaattcaggaaatacagagaacaccacaaagatactccttgagaagactaaccccaacacaaataaccgtcagattctccaaggttgaaatgaaggaaaaaatgttaagggcagccaaagagaaaggtcgggttacccgcaaagggaagcccatcagactaacagcagatctctctgcagaaaccctacaagccagaagtggcggggggggggggggggcaatattcagcattcttaaagaaaataatttacaaccaagaatttcatatccagccaaactaagcttcataaatgaaggagaaataaaatcctttacagacaagcaaatgctgagagattttgtcaccacctggcctcccttacaagagctcctgaaggaagcactaaaatatggaaaggaaaaaccggtaccagccactgcaacaacataccaaattgtaaagaccatcgacactatgaagaaactacatcaactaacgggcaaaataaccagctagcatcataatgatagtataaaattcatacataacaatattaaccttaaatgtaaatgggctaaatgccctaaacaaaagacacagactggcaaattggataaagagtcaggacccatcagtgtgctgtattcaggagacccatctcatgtgcagagacacacataggatcaaaataaaggaatggaggaatatttaccaagcaaatggaaagcaaaaaaaaaaaaaaaaaaaaaaagcaggggttgcaatcctagtctctgataaaacagattttaaaccaacaaagatcaaaagagacaaagaagggcattacatactggtaaagggatcaatgcaacaagaagagctaactatcctaaatatatataaacccaataaaggagcacccagattcataaagcaagttcttagagacctacaaagagacttagactctgacacaataatagtgggagactttaacaccccactgtcaatattagacagatcaatgagacagaaaattaacaaggatattcaggacttgaactcagctctggaccaaatggacctaataaacatctacagaactctccgtcccaaaccaacagaatatacattcttctcagaaacacatcgcacttattctaaaattgaccacataattggaagtaaaacactcctcagcaaatgcaaaagaaaggaaatcataacagtctctcagaccacaatgcaatcaaatgagaactcaggattaagaaactcactcaaaactgcacaactacatggaaactgagcaacctcctccagaatgactacaggataaataatgaaattaaagcagacataaataagttctttgaaaccaatgagaacaaagacacaatgtgccagaatctctgggacacagctaaagcagtgtttagagggaaatttatagcactaaatgcccacaggagaaagcgggaaagatctaaaattgacaccctaacatcacaattacaagaacgcgagatgcaagagcaaacaaactcaaaagctagcagaagacaagtaataactaagatcagagcagaactaaaggagctagagacacgaaaaacccttcaaaaaaatcaatgaatctaggagctggattttgaaaagattaacaaaagagaccactagccggactaataaagaagaaaagggagaagaatcaaatacacacaataaaaaatgataagggggatatcaccactgatcccacagaaatgcaaactaccatcagagaatactataaacaccgctatgcaaatcaactagaaaatctagaagaaatggataaattcctggacacatgcaccctcccaagactaaaccaggaagaagtcgaatccctgaatagaccaataacaaattctgaaaatgaggcagtaattaatagcctgcccaccccgaaaagcccaggaccagatgaattcacagccaatattctaccaggggtacaaagaggagctggtcccattccttctgaaactattccaaacaaaagaaaaagagggactaatattctcagtaaaatactggcaaacctaatccagcagcacatcaaaaagcttatccaccatgatcaagtcggcttcatccctgggatgcaaggctatttcaacatacataaatcaataaacataatccataacataaacagaaccaatgacaaaaaccacatgattatctcaatagatgcagaaaaggcctttgataaaattcaacagcacttcatgctaaaaactctcaataacctaggtattcatggaacatatctcaaaataataagagttatttatgagaaacccacagccaatatcatactgaatggtcaaaaactggaagcattccttttgaaaaccagcacaagacaaggatgccctctctcatcactcctattcaacatagtattggaagttctggccagggcaatcaggcaagagaaagaaataaattgtattcagataggaagagaggaagttaaattgtctctttgcagatgacatgattgtatatttagaaaatcccatcgtctcagcccaaaatctccttaagctgataagcaacttcagcagagtctcaggatacaaaatcaatgtgcaaaaatcacaagcattcctatccatcaataacagacaaacagaggcaaatcatgagtgaactcccattcacaattgctacaaagagaataaaatacctaggaatcgaactcacaagggatgtgaaggacctcttcaaggagaagtacaaaccaatgctcaaggaaataagagaggacacaaacaaatggaaaaacattccatgcccatggatgggatgaatcaatatcgtgaaaatggccatactgcccaaagtaatttatagattcaatgctatccccatcaagctaccactgactttcttcacagaattggaaaaaactactttaaatttcatatggaaccaaaaaagaacccgcatagccaagacaatcctcaacaaaaagaacaaggctggaggcatcacgctacctgacttcaaactatactacaaggttacagtaaccaaaacagcatggtactggtaccaaaacaaatatatagaccaatggaacagaacagaacagaggcctcagaaataacaccatacatctacaaacatctgatctttgacaaacctgacaaaaacaagcaatggggaaaggattccctatttaataaatggtattgagaaaactggctagccatatgcagaaaactgaaactggaccccttccttacaccttatacaaaaaataactcaagatggattaaagacttaaacataagacctataaaacccctagaagaaaacctaggcaataccattcaggacataggcatgggcaaagacttcatgactaaaacaccaaaagcaatggtgacgaaagccaaaaattgacaaatgggatctaattaaactaaagagcttctgcacagcaaaagaaactctcatcagagtgaacaggcgaccttcagaatgggagaaaatttttgcaatttatccatctgacaaagggctaatatccagaatctacaaggaacttaaacaaatttacaagaaaaaacaaacaaccccatcaaaagtgggtgaaggatatgaacagacacttctcaaaagaagacatttctgtgatcaacaaacatatgaaaaaaagctcatcttcactggtcattagacaaatgcaaatcgaaaccacaatgagataccatctccagacactggagaggatgtggagaaataggaatgctttttcactgttggtggatgtgtaaattagttcaaccattgtgggagacagtgtgacgattcctcaaggatctagaaccagaaataccatttgacccagcaatcccattactaggtatatacccaaagtattataaatctttctgctataaagacacatgcacatgtatgtttattgtagcacgattcacaatagcaaagacttggaaccaacccaaatgctcatcaatgatagattggataaagaaaatgtggcacatatacaccatggaatactatgcagccataaaaaaggatgagttcacgtcctttgcagggacatggatgaagatggaaaccatcattctcagcaaactaacacaggaacagaaaactaaacactgcatattttcactcataagtgggagttgaacaatgagaacatatggacacagggaggggaacattacacaccacggcctgttggagggtggggagctaagggagggatagcattaggagaaatacctaatgtagatgatgggttgatgggtgcagcaaaccaccatggcacgtgtatacctatgtaacaaacctgcacgttccgcacatgtatcccagaacttaaagtacaattaaaaaataataatgataataaaactttaaatggcatttattagcaagttcttgtactatttaaaaatggacacatctttttaaaaaagatgtgccagtaacattattttatccattgctaaagtgattttcaaaagagacactgttgcacctattttttccttttatgattatatgtatgaactgagttggggtgtttaattgttttgcaaaatagaataagttgacttacctgctttttgaaaaaagacatatggaatttactatcccaggagtattatgaaaaaatgcagcaaagctttaaaaaaaagttaatgaaaaagttctgtaggcaaaatatccttattttttacgacaattttttttttctggacagaagacttggttttccataggatgcctatgaaatcatggtttccatctgctgtgctgagcacctcttatattccttacagaacgtgtggtggtggaccactaacgaaaacacgtgagggaaatagaacttgaagcaaatttgaaaacttgaaggcttttaaatcttgtcagccatccaattcaagcagtgtatggcaggtgtgtcatatatttgtagagccaaaataaatgaccacaagaaattcagaagtaatacagatgtaaggaaagcttaaaatggaaacaaagaaaacattgttttcattgtttattcaggggttgataaatgcatttaaaggaagacctctttagtgattggtttaggtgccaaatatctttgtgatcttctggaccaggcactggcagtgttcttgttatgtgctggtttgtggaggggaggcaaaagaaagtaggagacaaggaaagtataggaaaactggggcaaaagtagctgatggcagtggccttgcaaacagctctaggacaagttactgtttccattagattagaagaaaacatgtctttcttctcttgttttactttcaagataacttccatgagaatgtgaattcttaaaaataataaaatctgcagttcttttttttcaaaggttgcacttaatagagaatctattatgtatgtaattttaaaatataagtttctacattttccttatattgtgtcttgtctaggactcttatagatgagcatcaattcaaagtcaaaattaactattttattttcatggaagaatacttatgaaaggtttcttcctgtggatcagagagaaatctcccccacccttactcccaccaccagttcagtttcatcatacctattattgagcaaaaacattccaaagatgaacatactatccaaagacacaaacagaaatcatctgggaatttcatatttttatacgatcttgttgctatcaaatggacaggaataggtcattctttgtggagaatgaatgcactgtatatgaagaatcctagatattgtcatcccaatttgaaggctaggattgtgagaaaatattcaacttcacaggtccaatcgattcaaaactaacagaggtggccaaagctcagctagcctagaggatgcccaactgacaaaactcttttctagtgtgatacaacagaagggttaatgttaaattactatttaatctttatagttttcaaaacaaaaaacctggggaatgctactgtaacccccagtgacaagatagagccagcaatgctgagcaagacatgatctctatgctcaagcagtttaaatctaataagggagaaaaggttaaggggcccagtcagcaagcatgaggaagaatatgatagatgccataagagtaacacagtattgtggtatggttaagtaggtggggggggggggggggggcggactctggagtcaggctgcttgagtttgaaccatggcttgatgacctgctagcttcatgaagttgtgcaagttaaattactcaacctttctccaccctcatttccccatctgtaaaatgagaacagtagtttccctctccaagagaaatatggggagcaataagtctcaatgtaattccaaggtattcctcttgatgacttaacttctatgcagtagtgtttgagtgtgcgtttaagagtattcttaaatcatagtgcttggtgtatcattcatggtgagttagaagtttgtactgaagtcagaattcctagtgtttacttccagctcttcataaattctaatactcatttcatttccttgtacatcaagttacttctctatttaaatgagcatagcatgttccacgggagcaaggaccttatcaagtcttgttcagtaactagaacaatgcctggcacatagtagatgctagataaatgttggttgagcacaacttacggagattatgaaaatgttgatacatcaggcatgaatgtaattctgagaatgaaccataagtactctacaaaaatgacaggtttctcttgtttaagattcccaggagagataagcaatgctatctatgacatttctcagctagaatctgtgcatgagatttggagtcagaagatcttgcctggagtcatggctctaccaccaggctttgtaacttcgaataagtaatttaacctctatgagcttcatttcagtcatcagtgttttgggttatcacttatgctttagaatatttttgagagatcgaaacatcaatgaaatacaagcacttgtaaacctgcaagtacaataaagtacaaatgcactaagaaatggtaacttttcatgttctgctttagaggactataaatcttaagaagcagaactgtattcctattacttaagtctaaggaagtgaagataaagctgtattatccccaaaacaaaactgatcttaagaatacagagacaactgacacttctccctgtcttttatacatagacaaacagagctgcatgagagaacttctccccatctttgcgccagctcccttgagtgttgcacttagtttcttctgagtcagccgctaaaatagttccagtctgaaggaagacatgtggtggctagaaatgctttgaagaattggccagggcttcatcataggttacaggccaaaatttttaaaaagaaaaagaaaaaagaaaattccttcttcccctatctctgaataaaatgcatggccagaagccaattcttttttgcagttttcatttgtaaaagttcagaattcacatgtatcatttattatgtttctatacttgatggacctctgtagaaaaagtctccagaccctcactgtttatgttttgagcagatcttgtatagatagatagatcttttttgtcattttccttccaaatgtgttcaggcagactatataattgggttgtgggattaggttggaatatcatactctttcagagtacttttcataatacattaagtcagttacagtgtggaaatgaatttactcttgaaattcaacttagtaacactactgagaaaaatctctggctaaggagaaactcagaaagcttgggatagctaatcccatcactagtcaggctgtttttgattgtcatgtctctttagactttttaaaaaatacataacagctttattgggatgtaattcacatattacccaattcatctatttaaagtgtacaattcagtgactgggttatggtatttcaaaaatcatgcaatcatcaccactatctaattccaaaacattttcatcaccccctaaaggagactctgtacccattaagcagtcattcgcccttatcccctcttcccatcccctggcaaccactaatctaccttctgtctctgtagatttggctactctgaacgtttcatataaatggaatcatacaatatgtggccttttgtgacagagttctttcacttaacataatgttttcaaggttcaaccttctggtagcatgcatcagtccttcattcctatttgtggccaaataacattccattgtgtggatataccacattttgtttatccattcatctggtaatggacacttaggttatttccacttttggctattatgaatagtgttgctatgaacattcatgtaggaggatttctttatcacttgttttcagatactttgggtatatactgagttgcggaagtgaggaactgtcagacagtttgccatagcaactgcaacatttcatattcccagccacgatgtatgagggttcaaatttctccaatttttctgtttttaaaattatagttagactaatgagagtggtcatcacattgtgattttgttttgcatttctatcatcaggttatttttaaaatacttttcctagaagtcatttgcctgcaacttcaacgctctagaacatggtcctgcatgtaacttgatgcagaagggcctgcatagaagtaagagcagtcatagaacttctgcaagaaagctctgcatcttgttccacaggcccctcattcagtgggtaactaattgttattcaacattcatgactggctattaggttttttggaagagagctggaaaattcactgtggtagatattgtgacagagaagtgacagtggatatgacaacagtctgccacttaaagaggagaactattatacttcctaatacattaatggtcccaagtctttaattagaggccaaattatgtttgatattttttaagaaggcaaagttacacagaatacattttagaatgatttccatgaagaatgactcagagaaaaacatgttttgctcttgagtagataagcttgcttgaactttctaggtatttaatttctcaatgatatttgaaaagtcaggtgatacttaattgcatcttgaatatggaaaagacaaagagaagatttagattttgtaaaattgttgaaaatattgttgaaaaaattaaatgaaatatttttaagaactttaatctcactttttgatgaagttaacagttatttgatttttctaatactcagagctcacttttgcgttaatgctatttcagtatgtgtttatggcatatgccaataaattaacctttcctgtatcttctcagctgttgctagaaattgtagctggttcacactgagttaaactgcatactttaaagctgcataatatttaatctatttcattaaacagcacattctgtctcacttgtttgtatatgctgaaaccttcttctgagttgctccaatttcccttcatagagactaaggagcctacacagaaaaaaaaaaatcttttcagatgacttttttctttatctgaagcacattttacgtttccatcctccaccccacctcatgtgaggttgttgcctagtcttgtactacaacagtaaatctaagcagttgcttgcttttactatacagttttatactgggaaatgccctttttattgacaatggctgactgtactatgttgcactgtcagtatctagatgcttcctgttttaaataggatatagttacttcttttccaaatctagagtttgaaacggaagcattgtattattttagctaattttatttatttttttcttgcaggttctgaaaagtgccttttctgaaaactctgctgcttggattctactctagagctgtctctttataaacccctctccctaccataccgttccctgccctctccacctccccgccgaacctggtgtgcttgtagtttactgtcagcagctggtccatttcttttttctgtgattctcaattttcttagtcattttccctccacttgattttgcaacgaaactttttttgggttctaacatccttcccaatcttgttatttaaagctaataaatagggagaaaaacttttctccccctgatctgagaccattccacaaatcgaagggcagccagcagcatatgttttttgcaagaataattgaaaacatcaactgcagagcccagaattcttttgaaagtctgccggttatttaacataaattcggcaaaggaacaaaataaagcattcattatcttaacagttggcttcttaagagttggtctctaatttcatttttagttattctgatagtttttatgattggctttttgtttgactagaccagatttgactttaatgaaaacctaagtgttaacaaatagacatttcaccaaagcaacctgttatctcttcgcacttagtttgaattcatttttaatcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaaggtgagtcccatctgaatgcacataatttaaatttgttgatttctatgttttttgaaatatgatgtgctttgaaatgagtaaaattaataatagcatgaaagtgataaattttgtttttttaacaaaaaaacagaatgtcaagatagaaggtcttaaagtcagaatgtcttaacgacaaaatgtcttaagtctttgtgtttgtagagctaagccaagtctaaagctcattccaccaaagaccacttaccacttatcaaaacagatatacttaaagaataaaaattgaagaatttttgtaggagtgagggattgtagccttgctatcgtttacttttttgtatatgatttagatgttacagtgatcataatccccatgtaacctagagaagcccttcactgaattatagcatattatccatagtaccaaaatgcacttaggagggacttgtcagctttcagaggataactaaagtcagactgagggagtataagggttccagaaggaaaattatggcattttgaagcgtctcaaagtatattttgaacctttaacttaaacgtattgctacaaaactaggttcacttaattttcctcctggacagatgattgaccaatttcagatttgtgagtatattttgtaaggaaagtcctattactaaggtcatcaagcctgagtattacatactagattataaacaaaatatgaggccagatgaggtattatataggacaggatgtatatgattgcagaaaaagaaaatgcactgattttcatgtgttattcatagttatccttaaattaaggataaaaagtataaattaaaacatagaagcaataaattataatggatttctggtttaattaagatttgctacaatgcatctgagacttttttcaaaatatgtcaaaatgaattaagcttaacaagaactttttcagtttcttgatattgttttaccttcatcatgaccaattttacctcattaacatttttatttatggctgcattggctaacagagatgtatcccttcgtgtgatggtttcctcaggaaacattttcttaagcgatatacaggttaagtatctcttatctgaaatgcttgagactgaaagtgttttcgattttttggattttagaatatttgcatatccataaagagatatcttggggatgggactccagtctaaccatgaaattcatttacattttatatacactttttacacatagcctgaaggtaatgttatacaatattttaaataattttgtgcatgaaacaaagttgtgtacattcagctatcagaaaacaaaagcgtcattatctcagccacccatgtgacatcatgttgacacttaaaaagttgaggcttttggagcattttatacttcaggtttttggattaaagatgcttaacctgtagtacttaaagggttacttttacttatttcgtgattactagttttttgttttttgtttttttttgcagaccattccattttaagaatagaaacttgttattgtaaagataaaggtaattcctaccattgaaaatctctgaattgcttttatttgtggtagacattatgactaaagaacttattttgttttcttcattttggtttcatttaagtttcatctacaattattttgtgtattatttaaatctgcagctacaggattgggcagtgccttgaagtggaaaagcatactgagttagttgggggaaaaatgaggtatctttcatctggtccatatagagggtcaggaactgcagtagaaactttgcattgttgtttcaggagatctggggtacagtcccagcctcactactgtatctgacctcgggcaacttaacctcacaatccttgagtaacttcatctgtaacagatagatagtatcttctgtacctaacttctgtgattattgtggagattgcagtaagctagtacaaatggaaaaccatatatcaatataaaagtgaattaaataaaaggttttcttcctatcaactaaatgtttgttgtaggcattctttaacaaagttctatttagttagggcttattatttaaaattacaaactcatgttccaaatgtacatgaccaaatctagttgctgtgtgttattagttgttcaagctaagtataactgtttttatggttactctgatatagagttccttgcaggctttgtaaattctatctttccaaacatcatagaatgtgaaaggagacatgtgatcttcctaatcattaataaactcaggtcagtaattccatttaaaggcaaaagagtgccataaactaaacattttgaagaaaagtactagggaaggtgactgtttacaaaatgcgtgctgcactacaactttagagcttggaaggtgtttaattcagagacaaaatagataatagccaatgaatattaataagccacttaattatttaaataagttgtctactcactgtatctagtgtttttaaagtaatgtttgcatcatgttaatatcctgatgaccagtcacacagggtaaagatgatttacataatccttacattctcatattttagtgaaaaccttaatatttcaaatatgtaaagccgttcaaacaattacttaatttgccatttagatagcacattaaacaaagttccatgtctgcacaagagctttgtagttcttatccatgacatgcatgaaggttaaattaagttgagggtaattgacctatgtgcattgtgctagtatcatatctataatatacaaataacatacctcagtggttactgcagcatttcctacttctcctgagtttttataattgaaacactgttgaacttcatctgtgtactatttcttctctcatgagtgattaaataactgaaacaatcatttgatgagttttgggctgctgcttttgtttttgttttgttttgttgttgttgtgtaagaattctattagtactagctactctaccagatgatggttattgccttaataacaggtacaacagatacaatgttctaactcacctcataatgagggaatgttatgaaaataagaagggcaaattggatggctgattgtgtattgtgctgaagtgctgtgcctatcaatccatgaatgttgagtgctcagtgatgaaggcagcaccatcttcaaatggaaatctagtgtagtccatggattaatttccagctacatagaatggtctcatatcatgttggtatgcagctgtttttgactctgttgccttgtggacttggcataatctgtctccaaagttttcttcaaagtatcgcttaatccattctatgccaatttcttgatattacagtttgccattgatctaggttggtatttttagtgaatgttccttggatttaacgaagggtcatcatttttaaaacgaaatcaatctttgtgattgttttcatagccaagttattctgcttcagcaatatcatgatgtcttgaacctttccctttatacttgaagcaatgtgttatcagtcactttttatccaggaaggatataaatgttgtcattatttcattatgacagatcaacacccatcacaactgtccacccctcttaccactttgggtagttttgtgccaagaatttcctggtaaaggccatagcagcagacatagttagaggatactcaagctaacctatatacattccttaaaaaatgggaactgggtaaggaatgcacataaaacagtcacatgccatgtcttcaaaatcacatatgatcacgagaaaaataatattttgacaagtgaaaccttgtcaaatattataagcatatcgatatgaatctatccttgtaggtcaaactggcccaagttaccagtatattctgcaatagcaacactagtcacagcagttttcattagtttaaaatttgactatttttgactgaatacttactcatccctatttgccaagggaaagtttaccagaaactagatgcctagcaacacaatcccaagggtcactggattatgcaagacttagcaccatttatcagctccatcagagaggtctgtctacactataaagacacataagcagcagctgtcatcttgagagtcaaggaaaataacattttatttaaggatctctattttctatgatgctaacctttaaagggaagtatctttgactggtaaaagtcaatgctattttggacatttcaaaaacctcttttgaaaggaaaatagaattacaattataggttggtgcggaagtaattgtgttttttgccatgaaagcaatggcaaaaactgcaattacttctgcaccgacctaatggtacccaaacaaatacatattgatagttcagcctcgccttttaaacattttattttgaaatattaataattttaggcttacagaaaagttacaaaagtgatacaggaaactcctgtatactttttatccagattcccctaatgtcaacaacttacatgccatgcattgcacagttatcaaaaccagggaattatcactggtacaagattcttaagtaaactcaagaccttatttgaatgtcaccaattttcttcctaatgttatttttctgttccaggatccaatctgggatcccacatggcatttattccttatatctccttagtctcctccaacctgtgacactttcccagtctttccttgtctttcatgaccatgacacttaggatgaatactggtcagttattctgtaaaatacatctcaccttgtgcttgttgaatgttttctcatgattagactgagatcatgtggttttgacaaataaaaaagaaacccacacgcagaaatgatgtgcatgacatctgagggtatgggatattgatatatcttattcattatgttaactttaattagctggttcaagtggcatctactggatttctccactgtaacatgaccagtttttcttttgtaaaaactgataactatgtcccccatttattcatcatcccctacaatatgccattgatcgtaatgggcatcccaatgtcctagatgttaaaaagtgaacaagtgttcatcttagaagtgattggtaatgtacttctataattatagtcaattaagaaagagagcaagggaaaatggaccaagagcatgacagagaaaatagcagcaacaagccactggaaagacagaacactggagagtgagcagtcctagaagtgatgtgatatgtgtgtgcctatcatatactactgcagagtgtgacagctgtccccttcttgttcatggccttgggacttagccgtgaaccagaaacagtccctgcctccatggtgcagacattctcattgggagttggaggaggagcaggtaaaaaataattaaatattcaggataacaatacattgtcaggtgtgaggaaagggtgcagagaatggcaggggctactgttttagatacagtggccaggaggcctccagtgaggtgacctttgaggagaggcatgcaggagatgaggggacagtgaagaggatttctaagaacattccaggcaaagagaatggcgacagctaaggccctgaagctggcggcagcctggtgtgtgtgaggaaactcaagatccccagcgtggctggagcagagccatgaagggggagggcagtgggagatgagggcagggaggtcccgggggtggggagatcaggtggggctctgtgtatcatgctgaggactttggatcctgttccaggagctggaaaggttgacataatcgggggaaagcaagcccacacaaagcagaggtgtctagtctttatattttttaagtggaaaagagaataatttccacgaagacaaataactcctgtttataggtgaagtagaagtcaaatggtgcccaatccctattcttcactcccttatttctgtgacttgtacctcaactccagttcataccccagtgatggggaattagcaataaagaaatctcatgtgaggaaagagttaatatagcaggtttggtggcttactctttgcatgtctcccagggaaaccttaactatcccctgggaatgtggccaccattcattttgtcactgattggttattgtgttgtatacacctggaacaatggaccatgccataacagcttgtcagggttgctttgctcaagatcaagattgatgactgattcattgttagggtcctgcattacagttgccatggccagttggtagcaggctgtgcatatgtgaccaggacccatctgcacctcagaccttgagactagaactgggcttcccagggtggagacattccatacatgcctctgtagtttgctgctagagagagagagtccttgtgcatgtggcttcgaactaggaagaacattggaagcttgtgctgggcttctcttgattctactgatacgtatatttttcctgttacttttcctctgtattccaagctgtaataaattttagttgcgagtgtaagttgctattgagtctgtgagtcctggcaaatgtcaaagaagcttttctgtatgttgttatttttcatacattatttgcttgattttttttttttacatttttctgttttttatgagaagggctttttcattttgtttctattttttaaagtttaatttttgaatggatattttcataattcaaaaatttagaaaaacagtcaactaatgagtacatcaacaaaatatggtatatacatacaatgtaatattactcagctacaaaaaggaacaaagtactgatccatgctacaacatggatgaaccttaaaaacatgatgttaagtgaaagaagccagacataaaaggtcacatattgtgtgattccatttatatgaaacatcaagagttggcaaatccatagagacagaaagcagattagtggttgccagggtcttgtgaagggcagtagatgggtgagtgaggggtgaggggtatgggaattaactactaatgggtacatggctttttttttaagggtgatgaaaatgtcctggaattagtgatgatagttacacaactttgtatataaatgtgttaaaaactactgatgtgtagactttaaaagggtgagttttatgatttgtgaattatactcaatgaaaaagtttaagaaatttcaacgatagtagagtatgcagcgaagttttcccctcatctcttttccccagttaatcagttgacctccaaactgatattttggttttccctctcccatagatattatatatatacatatgagcaaatatatccatacttattttccattttcacacagatagtagcatactgttttcctccttgctttttttgagtttaaaatattaacagtaaaaagatgggaaaagctatgtcatgctgacactaataaaaagaagcctggaggtgctatatttataataaagataaaaagaattgcacacaaatacaggattctagttagtaaatctgttcctcacaggcatatgtaagtatgtagatactgaggttgaacaaataaatgtatatagagtagataatgagagcctattttctcactatcagaggaaaaaagttaaaaataaaaagggaaggttaggatgaataccgtggtgtggattagaaaggacacatgagtatgtatacagatagatacaggaatagatattgatctgtgtgtatgcatgggttattatgtatgctttcatttcctagctctgtcttgggaagccctagaagcaattaacaccccaacagcaacgagtatacttagtacccacatctttgtgtctaatatcattctccaataaaggaactcgggatctttggaataatggctaattctggacagaagcagggaaaatacaagatgaggctgtaatgtcttttggtgtaagaatgtaagaaagtgctagagaaagggtgggggcatgacaagacagcatagtagccagtctgaaggagctcccaatggctgaagttagaataacttgagcaagaaactaaatgatgacagtattgaattatagctcatagaataaaatagatgcccatgagtccatagtttacaaaaaaaattgaataaatggataagttggggagaagggacaactcctccttacagaagaattccaattaataaatggagaacaaatgaaggaaacacaaaatcactagtaggcaaatgccatggtaataatggttgcaggcaagatccactgatatatgctgaaatcagtgggtaaaagttggaggagaaacaggatatttgcattgtcccaaagtatttctcccaggatatttatcaattaaaaatagaacaggcatggtctatttcatttatcaataaaaaatagaccaggcatggtggctggctcatgcctttaatcccagcactttgggaggccgaggtgggaggatcttttgaggccaggagtttgagaccagcctgggcaatatagcgagaccctgtctatacaaaacatttttaaaaaaattaactgggcataatggtgcatgcctgtagtcccagctactcaggaggcagaggatcgcttgagcctgggagattgaggctgcagtgagcagtgattgtgccactgcactccagcctgggcaacacagcaagaccctgtttctaaaataaataaataaagggaaaatagtcactttacagtggagaaacccagcagatgccactttaaccaggtgtttaaggttaacataatgagtgataagatatatcaatatcacataccctcagataggatacacaccatttctgtgatgttcctgccaaaaagacatggtctcggtctaatcatgagaaaacattcaacaaacacaaagtgagaggcattttacagaataaatgaccagtactcatccaaagtgtcatggtcatgaaagacaaggaaagacttagaaagtgtcacagattggaggagactaaggagaagtgaggaataaatgccatgtgggaacctggattggatcctagaacagaagaacattaggaagaaaattggtgacattcaaataagatctcttgttaagagtctcgtaccagtgttaatttcctggttttggtaattgtgttatggttatgtaagtatttaacagtaggggaatctgggtgaagggtatacagggactccaggtattatttttgcgatttttttgtaagttcaaaattatttcaaaatgaagtattttaaaagttagcttttttagtctgtcctttgaggctcagaaatattgtggggtattgtttcttttcatttttattcttaaaaaaaaaactttgagtatggggatgagaaaactctaaaatctagtcatgactgatcatgagattgcccccaccaaaagttcgatgactcagatatcttcatagttaagaaagcgctcatacatataaaagcacttcacaaacctagcaaacgaagaattttggctgtagaaggaagaacgttcagttcaaaattgttgccatttacagttgggtaaactggtgatccgttgagggagagtgacttgacctagttcacatatgcagttatcaaaagagcttgatgactccggcgttcttccaatcattattcagtcttctttcctgtggagaagaaggaaatggagagaacatcaattaggctattgctttagtaaaccaaaagcatccagctcttatcacagtcatgctgctccacatgacattgggactgtctgtgaagttttctggttctcctttactttttgcactataaagtaaggcgtggataagccaacttttcctttgctaatccctccctcttttattgtttctgattcatgataatttagattaagactttattaaccttcatatttagttcatggacaattatttggataacttgttttgaaaataaggcagaagagaagaatttttagacaaagttacctaactttgtgatactaaactttgcttaattgctgagtgtcagaacactgagctgtctctgctcccttgtccatccttctccccaaacaccgcattgttgagtttgctgaccagaactggggattgtaactgtggctgtgtatcacatcttcactgcatgaaactcattgatgtctgattctgttatatactcattagtacaatgccctggccagctaggaagaaacctgtcatagatcagctgaaatattgcagtagcaattcagccttattatgggtcaagtattttatacaataatttggaatctaatccaacttatttaaagtgttgttttatgggatcatagctcaaaatcatctcttcctggccaagttgtaattgggcatctggtgagaaaagacttgggctagggccaggcatgtattccccaactactgtttgatgttaccattaatactgaccctttgctacaggaactccattaagtaggagagatttggaaattggaaatttgaaaactattatatttcaactcttttgtctagaagaaactcttagatgttagggtaatatacatctgatcctacttggttagtaaataatctcttcatgtagcatagctgaaatgaagtctttttctctatatcagattttttcgaaatgtggatacaaggtacttctgtgcatccggaaatagcaattagttcttctaggaacatgacattattcatagaacattgtttacttactgttctgtttgcccttgcagatgacctttctgcatgtaccatccttgaggtgacccttgttttcctctcagtgtgtcacttggtccctgacttatggggttatatattccagaggaatcttagctgtctgctattttctgtaaatactcttttttttcttcagtgtttattctgctacataatcggtcttcagtttcttaaatttatggttttttttttttaatttttgatgtctaatccagatttgcagtcctgcttgggttttcaatgtttttgtttctgtgccttcaattctcaccccagggtcaagttttattgctagatgtcattacaagtttatctcacattttttgccatctttcttgatattgttttctttaaagtcagtaaacaattccatttgtttttcatccttttattttctaaatgatctccagtatttggattgaaccatgttgtatctagagatagagtaaatcatttttcggtatcttgtttatgatgagattatgtaaaattgcttaatgtcatgtctaatatgttatttagttaagtagatatggctatagaatctatctgttagaaacagttttgcagctataactcggtcataggcatttaaatgtatgccttaaattggatttttgtatatcataaataagctttttttctgttgaagctcaaattttttttaacccactggaaattggtagaaaataaattaggctttgcttctacctatattcttatgagtagatagtggacaatgaaggcagtttccacgttgaaaactgtacaaaaatttgaaaatgtaaagtccacagtaatataaatgtattacatatgacaaattccctttaattccattaaatatgacaaaaaacaagacatgtcctatgtatcagccatgatttgttagctaacggaacggtagtaatgttctaatttctgtcttagcgtgcaaaaatgcaaacagaaaacctttttctgtgactttaaactctttaaccatcttttatatgcatctaaatacagtgagtagattacattgtagtatcaataatctcttagctccaaatactttttagagatctcatttttaaaaaccacattgttttaagaccacattgtcacattgtcttaatatctttgttcatcttcccatttgtgaaagatagtaaaaccgaagtaacaatttgaggatttttaatagcttcatgtactctgtgttcttgttttaaatatttcacaaatacctatcctaggagttgttccacttaacaaacttaattttttccagcttttataaaaatgtaatctctagtgtttctgcaatttcctggttattttactttttttactaaccaaaaaaagtgttctatatagaaccaaattcagtcttaacttcagtattactaacaaattttaaaaccatagccatctttaatctcccagtaccccactgtaggaagaatttgactttggaatattgtctcatttttcaaaggagcctgagaagtagttttggaaaatacctttttcttgggtgaactctagatgtaaccactgaaaatatctgaaatgaaacattctatcagcaagtggcataaacatcgaaaatgctgccttgtcacacataacagttctaacaagggctccttatgtcatgggaatcctactacctctgtttctcttcatatgagagcaagcagcagcactgaatttgtaagactatttggttgtggtttcctagaaggatttgtataaatgtcaggggttatttaatgctgaaagtcctgttaaatccattaagaattgtatgtacattcaattccccaaagaaatgattcattcaacaaacatttattgcaacctcttacttgttaggcactgggctcagtaatgtggagaatacaaagttaggaaagatgtggttcttgcctgaccttttagtaagaggttacttgtgttatatgccataagccagatacaaactaacagctacaacagtccaagggcacaggtagggactgggattatattcagcagtggtggttgaagatggagtcatggcagagacactgtttgaggtgttctttgaagaaggaataggaaggtattccaggcagaggggataacctgagcaaagatagagggggaaaactgtgatatgtttggggagttgaatgttaagtcagaatggctgaagcatgagaaatgacaccatcagcttgtgcaaaaaaaatgacagaaaaaaagagactggcaagaggaagtacctcttagaaagttgttgaagtattgaaggtatgaaatattaaggttttgatttagatggtggtggtgggaagggaaaactagcgatggaattgagatgcagatgaagccaacatggttaagtagaaagcagtggatatttccctccagcctactgaccttgtgctcatcttaacatcagatttctttgaagttgcagtgaaagtctgccatactttttgttttgttttgcattagatgctatcttgtccaccaacatatcttttgtgcctagtacacgttagggcttggaaaaatatttgttgaatgaaacatgagattgttgaaacactttgaaagagggagaataaatatgggctcaactgagaggtacacagagatctcttcatctgcagctgtactttcactcccagttcagtttttactcaaatatagatgaaaattgtatacacccatgtgccaactttcctcactcaaccacattttaacctagatttgatggcctgcaaattgctgatatttgcaaatttaattccatcccttagcattatagaaatgatatttggctaaatgctgttggatattctccaactgttacattttcagtgcttttacgttatatacggatttttttaaaaaattacttagtggccattgttaagtgttatttttaagataattagtgtgattatgtagtaatggtctagcattttttgtcttaaaatgtttgaagttgaattttacagcagatgggtagcttgcaaatcaaggtattcttggaagcataatgagtgctaataaggtgattctaatcaagtacaagctcataatcttcaaaaagggattttgtggaaaaaggtgactgcctagttcaaaaatatatatatttaaagtttaataaagaactcttgttctaaatacacaatgacattttgaaagtccaaaaagtttgaacatagaaagacaaagaaatataataatagagagggtccatgaattgacactttttaaaaaacccacaataactgtaatttagtccaagcaatatgcttttaaaagaaataggaaaaataataggaaagtaatttcaatatcgaagtttaagaaaggatctctaggcttatgtactatatcttggagtttgtacagtcagcccagtctcttagactttctccatgttcatctccattcctggataatgattgctggttttctgtacaggcgatcctgaggtcttggtgcaatcctcaataaccaagatatgattcaggtttggacaattgactctgctttcaaaaacagggaaggtgtctggaacatttgagaaaagtgtttcaacaacaacaacaacaaaaccttaaaatgatttttaaatatttagcagcattcagctggtgtcaacatttggcaatgatttccataattgtgactagcatattttaataggcaactgacagataaaacagaaccaagactgtctccccctttttcccaattcttgaggcctcactttagtggcatgtgacatttacttcatctttgaaatgataaaacatttaaatatgtttcacttatttctccccaaattttcctattgtcccactaaagaaatacctttaaaaagtgacattgcttccaagtcagagatttaaaaaaaaaaaaacagaaggaaagaaggaaggaggaaaggagggagagagggagtgggtgaagaaagaaagaagttaagagacacccattgagaaaggcttttcattctgaaatacttcagctccaataataatgtatttgtaacaaaaacataaggaaagtgtaatgaatagagtaacatactcatgaaaagagggtaatatagaagagtgggattcctccacccccaagagagaattgtttgtgccatttttatcgcatatttttcattataaactcctctgctttcgttgaagcaaaaatgaatagctgtgattaattatggcccagagaagtctcattctccccatggaacttgctcttcctcattttcaacagcaccactaaacatgcaccactagttacctttgatctccccactgttcacaacctccaagcaggcgtcaagtcctaggtcccccaccagcacaactactcatgcctctagttatgggagagagaagatttgtaaactccttgtgggcagtttccatggcataatcttcatttcttccatagtatctagcacagtttttacttttatgcaggagaggtattaaacagtatgccttcttttatcaggctacaggagcaaatgcaattcagtacattttcctatttagtgttgccagaaaactcacagctaccttttgggcccagctgcagcaattaaccttagtctagaattttgaagtttttgatacaattatctccattgttccacctttcccattatatcagtctttacagttactgtaataatcttacttcaaaaatatctttcttgaaggtcattttgaagccttttgggaagaatgtaattgtctaagtagtaagagagcaagtcaacaagagaaggggctaattccatttctgcatttattatttgcagcttataaggctatctgagtgattttcatttggacatgttaatgtattccaggcattccagtatggttaactgggggcctcagtttaaaatgggcttccagtgatactcagaagtaaaccagatgcagctggggctactcgtaaaacagaaaggaataaataacaaatacttgaaactccttagacgtttactttttttcattaggaaaaaaggagaaagggttgtatgagatgtgttttttccttacttcctcgctgcagggtgcaactgatgaacttgtattcagtgcttattttgaggtttagtaatctattgatacttcggcttttgatcatctgtgctgaaatgctgtggtcagcattaaattgtttgcctaatcgatctggaaagtattttcctccttttagcttgtctttttctaggtatgttttttttaggggtgaggagaaggggtaatgttctcaaatgattgggatttctgtagtgagtaaaggtgtgagtttattggagagctgaggggcagtttttaaagaatcctttattcgttcaaatttgggtacacagaaaacatttagaaaacactctggaaatgtttatacagcaaatgtaagcaacatacaatacagagctctcatatacatacttaccatcataactaatagccctactttgtaaacagaaaatgaatgtgtttcctaggagtagtagaatagattttgagaaggccaatccttcttcatgacctagaccggccttcttttacgtggctgctaacatcattactgatgtcagagatgtagaattaaggtgtccaaatttctttagtatgaccttttggaaactgaattatcagtaccataataaaatgcatagcaaataactaaatccattgtcggataggacaatattcccttagagcaggggttctcaaaaatgtggcagactagcaacatcaacttcacctggacacatttagaaatgtaaattatcacctcacccacacctactgaatcagaaactctgtggggaggcctggcactttgtgtttcaagaaactctcccggtaattctggcaaacactgaagtttgggaaccattagtttagagaaaaccataattggtttagcagggtgtcaattaaggatgatgtttcaaagcttcataattctcaggattctgtgttgttcctctaatgcctcctccttcctcaccacttgttcaaacggccctttcttgatatatattcagatctgttggaagggaaatgatgtctattctggaagacttaatgtttctttgggagacctattatattttccctccaaggagcatcacaatgctttttagctgagaaaaggctctgagaggtattgcatgaaagacagtttagttctgttaactgcgtgttagtgtagtttagttctgttgaacccaagaatttctgtaaatcctttgatcacagaaccctatctttgtggagcatagagaaacttatggaatgctacataacaggtgactgggcaagaatcatgctggtgtctaaatgtgtggaacccaaaagaaatgaagttattttaattatttgactattataaccctttgaaaggattagtgacttttttgtaccctgaaaggcgtattgtaggtgttgctagctgccacacatggaccttcaaattttcatatgtagcaactgtgagaacaaaagggtgtgtatatgtacacacacacacacacacacacacacacatagtatattcagacatttcacatttatatgagtcaatcttcacttccataaggttagcctattaaaatgaaaaataagaaaaatgaaaaattagctcaaacatttataaacagttttctaatgagattcaattttattattttaccaatttatttaaatgatatttaaaatcacttcgctacaatttttttttaatattttaagcaccattaacatcttttatagtctcttatttggctttgtctttctaacttaccaggaaaaaatgacttgcctgctttcttgttatcattttaatatatgttataagtaaaatataacagtacccatggcaaaattagaataaaaatagtaccaactagagtgtgatgctccatgcttttttatataatacaaatgactttgaatgtttcattcattatgattttaaagtggatgttcgttatgctaaatcttaaagaagcttgtgatggtaaaagagtgtctcttgactaggtaaactagtctcctaagtgggcactggcttattaccacttgaaaagaagcaataattattttctccttttagttatttacgaggatgagattaaagcttggatatgcttcctttatcctctgccttttcgcctagaatactactaagttgtgggaacagcgactgtttgacaataatatccagttctaataagagaagtgtcctcagtttcctaacattatacgtatataaattctctccctaggcacatagtaatttatattactcatataattggtaattactctatgataatatattacctcttttagggaagtagaatgatttaaagtagttataatctgtcaaagttattatacttaattctcgggaaatattttagttctgttgtaaagaactaataaagaaaaatatattttttacattttgtactgattttacttgcaaaacagactaaattttactttgttccttttttctttcaaagcacctagaaagtatgtaggggcaggaattatttctagagaagttaacacgattggagaataatttaccgatgatctaaaactaaatagaattaagggcacttgaatctcagcttagcactctttctaataaaatactgtgttcctattgaaacttaaattcatttcttcttgggaacaaatacattagaggacagagtatgaacagcctgtgacctgcttccgaaacagttgattcatataacagtgttgttgttattattttccctattatattgtctttagaactattagtatacttttggattctgcatcttcagttgtctagtcactttttattttttctgagacagggtctcactctgttgtccaggctggagtgcactggcaagatcatggtgagagacaggactagctggatttcctaggccgacgagtaatccctaagcctagctgggaaagtgaccgcatccacctttaaacacggggcttgcaacttagctcacacccgatcaatcaggtagtaaagagagctcactaaaatgctaattaggcaaaaacaggaggttaaaaaaaatagccaatcatctatcgcctgagagcacagagggagggacaatgatggggatataaacccaggcattccagctggcaatggcaaccccctttgggtcccctcccattttatgggagctctgttttcactctattaaatcttgctactgcacactcttctggtccatgtttgttacggcctgagctgagctttcactcgccatccaccactgctgtttgccgccgtcgcagacccgccgctgacttccacccctccagatccggcagggtgtctgctgcgctcctgatccagcgaggcacccattgccgctcccgatcgggctaaaggcttgccattgttcctgcatggctagtgcccggattcgtcctaatcgagctgaacactagttgctgggttccacggttctcttctgtgacccatggcttctgttagaactgtaagactcactgcatggcccaagattccattccttggaatccatgaggccaagaaccccaggtcagagaacaagaggcttgccaccatcttggaagtggccggccaccatcttaggagctctaagaacaaggacccccagtaacaatggctcactgcagcctcagcctcccgggctcaggtgatcttctcattttaaaaagctggggagaaacctaatgataaatcacagaatagaattgttgtgtttattttattggcatgtttacatgatgcagccacatattaatttgtatttgaaaccctttagttttattttgtgaataatgtttgcttaaccaaaaataaattgccaataaagaaaagaaaagaaagaaacatgacttgtacatttgaagcactgaaaaagtcaaaccctagtgcctagggccgcagatcttcacctccactttgcagtatctcaaaatatatctactttacggtcatttaactaaaacctcctctgaaactgagctttcggtggggtagtcttttgtgaaatggtgtgtgcagttcatgtgcgttctcatttgcctttgtccttaggggaatgaaatgcttcagaagaacactttgtaccattttgtgttaaggttgatcttttctcatcatttggagactttctctgctttgtgatagtgtcgaacctacagcactcaacttgtcatctgagtaaacttgcttctgaatggcactatggtgtttttaaaagattcttctcttagggaggtgatgatagtcatgaagttcacagaccacctcttttgttgagtcctacttctatcggttctcaatctccatgggatactgctggactgttacttttgtcaagtcatggccgtttatgcttaagccctcatgacccaactcctgataattggacattgcttctcccaaaccaactagcgaaatgctactgtgcaaacatttactaaaaagctgtgttaacagataacatgtttatgctaattgttctgcttcaggaattatggaaggctatttctaacatttggttacctagggccaggtacagtggccctcacctataatccctagcactttgggaggctgaggcaggtggatcgcttgagcccaggagttctagaccatcctgtgcaacacggggaaaccccatcgttacaaaaaatacaaaaattagctgggcatggtggtgtgcacctgtagtcccagctactcgggacgctgaggtgggaggattacctcagcctggggaagttgaggttacaatgagctgtgatggtgccactgcactccagcctgggcaacagagtgagactctatcttaaaaaacaaaacaaaaccaaacaaacaaacaaaaacaaacacattcaattgccttgacacattcaattgccttgtcttattcattctcaagccatccaaaatccctgggttttgaacaaaataaatttgccataaaattgtgctagtaactagtgtctggacatacctaacagccagttgatatgcagtctttgttataatcttagagggaaagtgtggcccagacagtataaatatttgaaccagctcattcctctatttagaactatcacagtattatgaagcacagtatcttgattgagtatgagctctggacacagagcacgtaggttcaaatcccagctctgctacttattagttatgtcagcttgggcatgcgtcttcacttctcagtgcccccgtttcctcaattgtgaagattaaatgagttaatgcatataaagcactttgaacaatgcctggcacgtggtaaatccacaacaaagttagccattaatattaaggtggacatggtgtgaaaaaatggaaaccagtttacagtattctaaaaaatctctcaaattagttttgtttctatgactagttttgtttttaaaattagtttatgttttatgactactttcatgatattaatagaaaatataattttacaggggcctcaacctggtgtctaaatgtgtatcaacaattgtctcatgccaagtaacatgagctaaagctgtatatacaatatctgcagcttattcataagtgatctgaattagttaacatgaaaaggatcatttgaccttatatgcaagagtctagtataccaagtcaatgcaatacatgaaacaatgtaaaaccaaattaatagtctagttatctttagtagaaaaatgagtgtaaaagattagcacactgatgttttacactacctagtttctttcgctctatccactttgtcaaaatctttgagaatggaatttgatttaccttatataacagacataaactgacttatttttttttcagaaagatgttttctgaagttttctaattttatcttgattttgagggaaagcacaatggagctagagtagatttattttatttatttttcttcaccaaaataaggattccgctaattaaaaggcactgactagaatatcaccatggcctgaatgaccccagaaatcttttcgtgcttaatagaaaggatgcacatttttaatgaacactacatccttagacatgtactgctcttctaataagtcttgttccagctgtttaaattgactaagggagtacagttcatagattttgaagctaactaattaactctctgttctttgctttatttttttcttgttttgggtgtggagatatgcatcctttggcagtggtcatatttcaacttcttctctgtaaggccatgagacatttatggttgaggcattgatttattttaaagcaaaaagcctccctttatcactattttctttaaccccatttctagttacattgtttgtggagggccttgtttagttctttaaatattgggaacagtttcatcatcattaaatattaactgctcactggaagcagaagctgagcttaattaaggttgcagtatttactaaattagactgggagaggaacattttaagacacacacatatatgaaagagagagagagagaaagaaaaataaatattttacagtaatctcagcagtttcattagagctttgtcaattgtgttcgcatatctgaaacatttcatcccaaaatgaaagttacattttggatgaaacttaacatacttggtagatattcaggccaggcagaatagatctttatttttagaagagaaagcatttgtatcaataccttgttttcatgtctgtagaacaaaaacaaacagtaagttggcctaattttcagatgctttttaaaagaatcacttggctaaaaatgccacttaaatacacgatacatttagagtttggaattttccctgggcatatgcctgatactctaaattacatacaattatattttatttgtaattgataattattatgggaacataacagttgtgcatatttgtgggatacatgtgatattttgatacaggcatacaatgtgtaatgatcaaatcagggtaattgggatatctatcacctcaaacctttatcatttcttcgtgttaggaacattccaatcctactcttttagttattttaaaatatacaataaattgttattaactatagtcaccctattgtgctactgaatactagaccttattccttctacgtaattgtattttgtacccattaaccatcccctctttataaaccccttctcactaccctttctagcctctggcaatgatcattccactctctatctccatgagttgagtgggttttttgttttgttttgttttgttttgttttgttttagctctcgcatattagtgagaaacgtgcagtattgatctttctgtgcctggcgtatttcacttaacataatgttctccacttccaatcatgctgttgcaaatgacagaattttgttcttctttatggttgaataatattcaattgtgtatatgtaccacatgttctttatccattcttccattgatggaaacttaaattgattccatatctcggccattgtgaataatgctgtaataaacacaggggtgcatctctttgaaatactgttttcctttaggatagatacccagcagtgggattgctggatcatatcatagttctatttttagttttttggagaacctccatactgttttttttttatatatatagtggctgtgctaatttacattcttaccaacagttgcctactttcctacaattttaataacaagttagcacaaaggtttcaatagaacttttggtgatgaaatgtatattttccctaacaaaatataaacttagtccatgcctcaaaagtattttaatggcagtccatgtcaccaagtaaaaactttctgcatggaaattccatttttggtgttaggttggtagtagggtaggagtgtgaggaaaatgcttattctgaagtggagacatttgacctcattgggggattgaaacataatttcacactgattaattcaccctgtaaacaatcattttggtacaatgttttacatttctttatctgaaagaagattcatgtttaacaaaagaggaactgattttcatctttgtaccgctaatttcaaaatgcagaggtaaatcaatagccatatctaccctttatataaagtttgagtggagagatatgtggctggttataaagacataattatttaatttattctgagcagcacactgagccctgcaaagataaattgtttaaatctgaacaataatcagtgcctttctcaccttatactcttcatatacatttgtaagatatttttgcaaattaaattcttctttgaaacttttcattttacttagagacaggaaatttaattttaccaagtggaaaccccaaggtttaaggttagtgcaaaactaaaaccatttggaattgaggagattgcccaataccttctgacttcccaggtttcagtacagcgaaaactcacttgagacccttaagtcatggaaagcctaaaataattagcatggtttcaaggggcagaagtcacaatgtaggaaagccagttaggcagagaaggcttgacgttcttatttcagaagttccttgactaaagccttcaaatgaaagaagaaagccacggcaaccatttggaaagatctgacgaaacttacagctttgaaaaggggtgttgggaaggtgattgtgggatgttactttgcaatcataggaaaatatccatcttgttagcttttgggagatcagggatgggcaaaaatggcatttcaacagaagagccatttttggggagttcactctatttttctatttaagagaaatcaaaatgaaaatactaaggaaaacttgacctgtaaaacaccatacaacttggttgaagctttagtttctttacctatagaatgaggaagttggattagatcagtattttcctaagggtgtactaaagagagatgttaacgggaatatgatgaaaaaaggggggatggtttgtgagttaaacaatgttgggaaatgctgggttaacaaaggtaaccaggtttctttactttaggacatgtgagagcctttatcatactcttgtgtattgtcagcctacaagagaggaatataaagtgacatttcttatacccgattgaccagtgaacccagcttttgaggttcctctcttgggattagttgtctgtggtacacactctggcaaatgctggactaaatgatctctaagagcctttccagctttactatttgatctttctatgatatgcccataaacatataaacttccccagagcagtacaattttactatttctgaccttactaattcttaatctttgatcattccaatgaaagagtctgcattcttaatgaaaaaataaatttaggactgtgtctagcaattgcttaaatgttcacaattgtaatgtgaggctattgtggattgccatttttctcgaatatattatttggttcattagaattagccatacctctctactttgtgctctcttttaatgtgagtaatcagggattgactgaaaaagatatctatgcaaataatggctattcatctgcatgctgtgaatctgtacctttatagcgcttatgtgtgcatatagaaacatgtgctaagtagttatttccctgcactttaatgattgacttttactcgaatttgagtattccaaagacagggctgaaggaaaaaaagaaaagattaaccacccctcacctctgcacacataaataaaaaccttaaaaaacttaaaagcctcatctttatgtaacacctcatatactcaaaaatctgttctgtaaattcggagttacgggtttaggcaggtattggtcacacaccatccccctcttcatcctagcctaaagggggagctccagcagacatcgagggtatttaaatatactgttgcgccaccggtgggtgggaaggtggagtggctgccagggtagcgagccgtgtgaagcttttggtgggaggagctatggatcaaaaattgctgtctccaacagtcaacttccttaaatttccttgcagctgatcaggtaagctggggctgagagtgtcttctactttactctgggcaaatgaaggcctgggagagcctgggctgattccatggagagggcttctaagaatcttaaggtaaagaggtaaaatgggttttcaaggatttgcctttattgagctcaacttatcaaggcagaagaacagagcgggagagggctgccagataacatattgtatggggcatacttatactaaaaaattttttttcactgtttatctgaaattcaaatttacctgggagtcctgcatatttatttgataaacctggcatctctagagaggatcctaagcagaagccctagctggggaataaagggggcaagcagctggtaccctctttgtcctggcttctaaatcgttgtggcaagtgagtggatggggtgtccagaaaaaggaggtaaagaagcctaggagcaggagatttgactaatgggtcagagagaaacacctccttatgttctttcttaatgaagtccatgtagaaggagctttttgaagttatatgattttctgtgtgttttatttcttagagtaacaaattcagtaccattactttttctctccctttttttccattcttgatgacattttatgttggcagctatcagctgctctaaagacagcgtctagtaatactttgcatgaggaatgccttctgacttttgataacttggtaccaatgtgcttcgttgtgtttgggttttaattttattctggttggctggtttgtaaatagatgatgcatttttgaagagcttataattgaccagtcattcagttaatatttttctacagtgatgtacggtattcgatgagaaccgaggtaaaaagtgtgtaagtggggtggaatagggcaggaagtagatttgggttattagtgaggcaggcttgctttcactgtgaacaacttctgggatttttagtgttatttgctgttcaaaaaatttctaagaaaaagatcaagctcatgatcatttgaaaataaatgtttaacgtaaacaaagctaagcgtgggtcatgaaggaaagccgcaaacatttttcttgtaagaaggcatatgcattagagagccacaagaaggccccacctgctgtgattttcctaaagccacctttgtcttagtagcttcagggaatttgacttgcggcttgttcagagaaattcaggatggggggtggggcagttggagaacgcagtttttttctaaactgaccctggaaatgcagggccctcctgggcaggcccaggtgctgattagatatggatctgctgctggctcctttattcgtccggtggggccctatatcctgagggcctttgtggccagagaccccttggaatcagaccagagtttctgtctctgggtctcatggattcatgtcacttctggttaagttatactaaattaccaggatgtttcagccgtaatggtcacatattcctcagggtctatattcataggaaaaaaaaaagttaggaactagctattttctggacctgaatagaataacggttcatttggaacagacaaccaggggcagcctcagtcatgtgttgactattgttctcttcttggagggagaagaaagaacttatgaaagaaaatagcaagagaagcacttaggtttctaaggtagacttagtgttatgccctataaaattattctcacaaacttcaacaaacgtgtatggcagggcggctattcatcaggcacacacacatccctggagattgaaagtggaggaagatgtagttctgccgttatacaggctcaaagtctaatagaggagacaagcatgcaaacaatttatcgatgtacacagcgataagagctacgataaaactgagtacaaggtgcagttggaagcacaaaggagggagagataaatggggacaggaatggggagacggttccaggaaaatctttacagaggaaaagtgatttgaactgagaatccatattgggtagtgaaagtctggaaacttggcttgtgtgcttactgagctgcttatgaattaggacaagtcaccccacccctttggccttcacattctctgtaagataaaggtgcacaagatgttccctacaatccgattcagccctaaactgtttccatcctgggaatcaagttatcttagtgggctatttcagaacaaaagtgtgattgttgagcccagtactccctttgtcattgggagatcaaaatgtaaaagttctctggagacagataggcaagaaaattcttctgctctcaccccagcttctcgcctattcaaacttgttatctggtttgcgccaaagtcattgccctgtgtatgtgtgtatgggatgtgtcaagaaaacagagttgggacagcatgaagaaggtgggtacagtgctggctgcaatggtggggggtacttggctggccctctccatgggggtcaacgttcagcctcattaattttgccttcattatatttaagaaatggtttattaaagacttttccctctaaatttcttgcctgcatctcacatttaacttaaaagttgtatgcagaattttaaggctgctctttgtgcatctatatcaatatttatagatgatacaatatttggaggagaaaatgatgcagattatccatttttgtaaagacagaattctaagaggaagaaagtgggaaatttgccagtagaatgccgatatctggctaataactcgttgtatgttgatcttgactcaggtttttcctagctttaataaatctgtgatgcttgcaggaactagccaaactggtacatatgatttgtaattctgaaatcactgttacttcctctgagaagccatgtctgtgcatgtaagtatgttacagtggggcactatcatcagaattatttcatttaatccattatgattaaaatggaataacaacatttttcttcatagaacaaatcatctcttgggtgccttgatttaacatttaacttttaactgttggcagtctagcagatcagtgagattatgtatttgaaaagtaatccagttataattgtatttgagagaacatatttaggattttttttttctctctaactctgtatgtatttgaagaagcaagtcattctgcaaacagctgtttctcttaagatactgtggctgacaaagggtaatttgcagcctcccaggttccttttcttattctgatgtatggtagggctttttctcatgaacatgaagtacatttcacagggtttttctaccacccagtgcatgggaagtcttgtgacagactctgactctcataactctctagacataggtgggatttgaatctctacaatgagacttttctctcttagttaaaggctttgtattcatttgggagaagcctgaaggtaggaagaaggcaatagattgaatttgggaggctttataaatgttctgcaatgtatccctttgtctgtcatcaacttcttgatgcagatgtacttcagaaatgtcatcggctattttctccccctgcttgctgctttttgagtgcatttttcaaagacagtcgatgggaaaggggagctggaagattcatatgattcataggtgtagtagcacttatttcagcagagaatcgctttcctattgaatcactttgctattttcttaactcagtaacacagtgaaagaccagatgagaatgacatgttttttaagtccaaaaggaaatggaaaaggagggaaattgaggcaagcataaatgagcttgcactctaatcgcttcaacgtttctttaattttgagtgtatatgggagggggagagagagagagttgattttcatgtcttgactccccttagctgctgattttagtacgtagcctgctctgccagaggatggcgactgttgtaggtacgtttacagagtcgtttaaggcatgctctgatactttgcactagtgtgagccaactctgaacctgtgggtctagattggaagaaggagggcttgggacaccattgacttggctagggaaacatgaagggtgatttttcagagccaagatggctgctgggctatcacaccaaactgttatagacccaatgtgatagggtaccttgtggcccactcagagtgcttaggtggcctacagaaatcattggaaccttcctagtacagagtcattgattttccaaaggacaaaaacaatagatgattacctactccactgggacagtccctccctaatccccactctatcccaaccttacatgctttaccaaagccttaattctatacaaggattaaaaaacaagtgttaacagatgtaaaaaaaacaagtttgttctctcccaaacaccaattaaagtattttggcctataattacgtttgggcctcttgaagaatgaacgctatgtagaggagatttattatcaccaagtgttgtgtgtacaaatatattatcctgagttctaaagtcgttttgaaaaaacaggggcatagttttcttttgaaatgttgtattgcacggataatatagatgttaaattacttggtctcctcatctattgtttggatagagaatacagatttttattttattttataagctttctggaacataagcagcagtctctggtaagatggtgttgctatgcatttgcattgttatagaattaaattatggattcggtcattcaaaatagaagctttataaatcaagtaaaatctcataactaagatgaataagtttctttaagtctcatgctgcctcatattccatactttagttttatagcccaacttgatataattttttaaagtgtaattctctttttttctatttctgtgtactgtttttgctctgctaaactgtcattatttcccaagaaaaagcttaagataagttactttatgtaaaggatagtgatataaaagcacaaaggcatgttcacttctttatctgtatattggcaggaaatgtgccaaatacagtgtgttctctccctccctttcttcttctctctctgattacattcaatgtagatgatattaaaactcaattgtaacaaatggtgaaattccaattattcttttttctttttttaacttatctaatgtctggaattcctgaatatgaaagacagtcttcattatatagttgttttggagttaaaaattgtgttccacgcttgtgtatgctaattgtctaaacaagctatctaggtggctctgcaatccttaagcaatgctgctgagctgcataatttattttccccactactgctgtctaactaccccaaagcataggaattagagtggtggccctaactgggagtatgcagtaagatgaaaaatagtcaaatgagaaggaaggtcagtaataagttatttagacctggttaggcagcagggtctccaaatgcagctgcaattggtaaaaaaaaaaaaaaaaaaaaaaaaaaaaaaaaaaaaaaaaaaaaaaaaaaaaagactgaaattcagaagagaggtcaggggtagagatagagatttaagatccgagcaattgtacaaatagatggaactttgaaacaacttagtctctccagggaaaagagattagagaggagagcaagaggatttagaacagggccttggggaaatctttaatgttagggtgtgggaggaggaagagaaaccctgaagtagaagtataaactagcatgcttggctgtggaagtcaccaagtgccactccctccatcagctgttaattctgagccagatcacctcagttatgtagatggagagtggagaatctaggaactgaagatccttgtgactttctgccttgcttcacattggtgggtgtaaaaagaagcttatggtctctcttaggggtacatttatggggaaaagaccccaattattgtgatttagcacacacaggggtctgcttacactcattatatatgttgaaattgcgtagctattcctaggctacttttaagaatttaggaggattaggttaacgtgattcttaactcatactaccaataaattattctttctccaaggtttgcatagaaatataaaagtacataaaactaagatagtatttgattttgtaaatcactttaatttaattaaatgtaaattgagcaatgggaaaaacaaaaagacaaactcgacagaaaacaatgatgtgtcttttaatttctcacactgactttaaagttatactcagcttcttgccagaggaggtaaaacaatagagccaccttgccctagtgatctaatatttaaaaagagccgttgcaatgcatctgggtttgcattatatgtagctctagaaaagttttgaaggacacatcttgattctcagtgaaattataggaatattttaataacaacataactaaacaatggagaagccattgcataaactgtgtaggcatcataaataaggaaaatgcagatagcatgtgttgaatgaaaacacttggtgaacaaactcatttttctctcgggaattcaggtggcctagcagcttgcactctttggtccaaaaacaaagttgcccttttgctccccaccttccccttccccaataacctcacctactgtaaagaatcttagcatctgtggaaaatagaattgtttgcagttgtgctttcttaaaaggtttatggtggacctagtaatccaaataagagagaatcgttagcttctttatatactgctcatgagttcaacacagtaataggtcacattgtgacaatgtgaccaacaactagtccagtgacatcctttgctgctacatagtaaaccataatcagcagccatgccaacatttaggtgacaccaaaagcatgtttgattccacggaactgacatactgtcctgtcttgaaagtgcttaacatcaataaaaaacattcaattagctgaggatccaaaatacactttggtttccatcatgcaagtgatctagggccattgtctccggaacctaaagaacaaaatggctgccgggcatagggatttattatttcattaacagactgtcagtgaatttcagggtgtttctcgccttatatggattcaagatgaagagttttggagcttagattgtccccagataatggagtccaaaatttatctatttgtgtatagttttaatttaatattttccctattcttcattgtcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttgtaagtcgcagctatattttgaaaattgccgataaagatcaacagtggaataacctggcagggacttggggaaattagttgcaacaggatttaggacacaaactaatatgttcattgacactacagagctgtgcacttgaagagagcagtcaggtgtgttgcactgaaaacctggctgcatgagttcactttataaaagaatatggataaaggagcaggggcattttaagataaggagagttgattattattacatggaaacctttgaattctaggacattaattcaaacaaattttcttgttctttgatgggggttttgttgctttttttttttttttttttttttggtgagacagagtttcactcttgttgcccaggctggagtgcaatggtgcgatctaggctcattgcaacttctgcctcccgagttcaagcaattctcctgcctcagcctcccaagtagctggtattacaggtgcccgccatcacgcccagctaatttttttgtgtatttttagtagacatggagtttcaccatgtccaggctggtctcaaacgcctgacttcaggtgatccacctgtctcggcctcccaaagtgctggaattacaggcgtgagcccggcctgttgttgcttttaaataaacgttttattttgaaataattttagatttacagaaaagttacaaaggtattaatagtacaaagagttcctgtattacctttcacccagttctccccactgttaacatcttatattaccctggtagatttgtcaaaagcaagaaactggaatcacacatcattattattaactaaactccagactttattcagatttccccaggttttctattaatgtaatctttctattccagtgtctgattcagggtaccacagtgcattcatttgaattttgcctcccctctcttctctgctctgtgaccatttctcagtttttcccaatttcccatgatcttgatagtggctttcccttaacttagctacagggtttccctatgcagaaattagtaagattatgtcattctagactaatatctactattttctggacttgcaagtttaaatggatcctttataaagtaattaagctatatctgttcatattgttctattgaaaattcatcttgccctatgccttaaaatataaactttcattttgcttttacacctcttagggagaattgaaaactgtcccttttctgctgtagttcttcaggcctcacatttagctcagtggtgcctcattctaattccagctggcctacttcctttaaactattaacaggataaatttgaaaatcctgttttacctttatttgttacccatttaatcagtgatacaatgaacatattgaaagttgaaatatgtatatagtatttagatgcaatgaaaatgggggaggacaatcagctgtcagtaaagcctatctcattataaagttaattctcagaattcaaggatatctgtgttgatatggaaccctttaatgagtacatctttatggataaatgcaaaaacagatgggagaggcaatgatgaatcactaaaggtttgcaccatactctttttccagaatgtctagacagatttaagtaaaataaatagatgtcatgttctgtactattagtttaccaaaaagttttgccttggaactcagattaattatgttggtaaattagttcctagaaggtgaactcctcaaagctcctctttgaccctcagtaattctttacatcgttgaactccttgcgcaaacgctttttctgggctttcacatactgacgtatctcagtccctccctacttctaagggcagagggaagataaagtcttttggatactgaaaattgttatgaacaaaaccacagagaagtgatcgtgcttggtaagtccagaaaatgtgagtgggtggggaataaagcaaggcagcttctattttttcccccagctttattgaggtataattaataaataaaattgtgtatattttaaagtgtacagcgtgtgatgatttgttagacgtatacattgtgaaatgagatgacatggatgaacctggcaggcattatgtcaagtgaaataagccagacagagaaaaaacaaatactatatgatctcactcatatgtggaaccttgaaaaaactgaatgcatagaaacagagagtagaagggtagttgccaggggatgtgggtgggaggggatgggggaagatgttggtcaaaggtatagcaagggagattttaactcacaattattactctcagcttctcatgggatgtctcaatttcaaactgagcaaagaataggaagcagatttcattatcagacacctgagcccagtggttcctacagagctggagcatttatcttttcaaaggtcgagggatagcttcagggtactagtgaaatgccttgtttcagggaatcagagagcaagaagtggggtaaagtaggggtacagagggaagccgttctattcagcctctgctagagtctctccattccaagtctcaacccttcaagtgttattgatcgtgctggctcacactggagaatagggagtagcttttttgagaatccagtaagaaatccattgtgctttccagcctcttcacttgtgctttctaatttgattctctatgctttctatgttagaatatgtttccctatcttttcttcaatgagggtaatttcagatttcagatgacggaagatgactgctatgattcacaggagtacaatttattttatagaatgttacaagatacaaggcattacttagaagacccaagggaacaattggaaattgcttctctaccttgtagattatttaatgatagctgttatgatgcgatgagccgataaatgattaattcctgcagttattatgtgtacaaaaatctaactccgagatggttgatatgttcctcttctatggtctaaggaagccactttgtagacatggtgtaattgagctagtgtgagcaattttaagtaacatttaccagtctgatttggaaaaaaaatttctttattgtggatcctgatattattacagaagtaatatatgattttacttaatttctctggtacctactctccctcaaacaactctctatcccttttaatcacccctacccaataatctgattcttgtctctaagatagtcatacttttgtttaagaaatttccagtcctgatatttgtaaggttgcatattaagacccatttgtatgactggcttgaacttcatgtctttccacaaagaatactttgatctgtttctaggataccagaagagcacatctgcctttgcagaattgaatatggtttgcttattataagcccctagataaagggaatgtcaacctaaatgcgatggtacctagagaacagattctgttgagtgtgactgaacaatgaataaaagccacacctagtcaatttgggtggaatgcttgctggagcaggcaagtttgttcactctattaaacaggtctgaattgacatttgccagtataaaagtccatctctgaaagcttttttttggctttattaaggaagttcagcaggtgaaacaaaaggtgtgactccctagtatttttcaatgcagtttaagagagattgttcctgatgttcccagcaaaaaagtataagttgaagtatccccttgccataatcatgaggcaaatacaaccactgtagaagaatattagaaagagtaggcacagtggattaccctgaagcaaagctaatgttttaaaattttggttttacaattagaaattttagttatgaggaaagattctccctactgaatgtggtgtatgtatttataaagtgaatatgatattacaggctgttaaaatgttttatttggacattttgcatatctacacctgtccatatccaaactaaaggaaaacctgggaaattcccctagtttctctctttgaatgtggtgattcacatggaaacagatcctgacacacaggtgaacttgactcagtagagtgtattcatttgattatttatatagagattgttgattcagcacatttgaggttgcattgggatgtgccaagtcctcaggttctgttgtatgctattcatggctggcattcctgtggctaagttaccgagttccaaaccatgaaggccataaacaagtcttcctctctaggttttcctttatctcaaattgaatcatctgatagctgcctggatccctctccacctttttacatcattttcataattctgtttaccaaatatatttctcataaacaggcttatatgtttatctaacattaatatagtaaggaacgaaggtgatgtaatgcttcagaaccaagagaaaaaaaataatagaaagttcaaataggtacgaggaagggagatatactaattaatgaatattatttttagactcatgtttttaatgttgtttttttctcttttactaaagggctacaatgtattatattacttgggtttatattacttataaacttaggactagaacaattttaagtgactggagataaaattggaaaatatttatttactttttaatttttttttttttttgagacacggtatcactctgtggaccaggctggagtgcagtggcatgatcatagctcaatgtagctgcagacttgtggggtcaagtcatcatcctgccccatcctcctgagtagctgggactacaggtgcacatcaccatgcacagtaatgttttttaaaaattttttgaatagaaatagaaatgtgatctcactatgttgcccagtctggtactgatttcccagcctcaagcaatcctcctgccttgacctcccaaagtgctggcatgcctggcctactttttaatttttgtaagtcagtcattaaatgatatagtacttgaaaacaagaggacaaatattcatattagacttacagttttttagttcacataaatttagtttattgactgaaatatttatgctataaaaaagagtagttttgtcatggctcttttattaacaattattattttaaaaggtgacccagacattatgtaggtttaatagaaaagaaaattatgtccatattctaaattaccagtctcatggtcagtacagaaattataacattttaatgaaggttctgcagcaggtttttcagttcacctactcatgtaatgatgaatgatggcatttagttctttcatcttgatgtggtgacattacatgttttgtaaatgatttttgcaaaattttcaagttaggaaagacaagcattatgtaattataaggttaatatgctcttaatataattacaacagtcatgatcatgtgaacttccgcattgaggttgaccaaatcatatcacagaagtgcctggagtgctaccatgccatgatcatctggattttactacattttctgaaagattagacaaaattttacttttaggtatatcaactgaagcctactgtaatctgtttgttcaactaacattgtttttaaggtgtacttaccctgagactaacatgaggggtttagggatgctcatttgcatggtttccttccaaaaccctgagaggggtcctagcaacgtgtttaaaatgtgtttgtaaaatttgcaaaatatattcgtgtgtttcattcttaaggctccacttccccacccagtggtctaagcttcagaccccacatatcctagatttgctcctcattgcaattactggtccaaagtagagtagttattcgggccttttgctaataagactgtgtatgtcacatagcttaaagcttcttttacgttaaaacaaaataaatcccctagcagtccctttgctgctttgccccatctctgttaatagacactgtgaaatctgcttttttcaaaagttgaatgaaaatgctacacttttgcagccaaacagaggacacttgtacatgatatcttctttattttattttattattattatactttaagttttagggtacatgtgcacaatgtgcaggttagttacatatgtatacatgtgccatgctggtgtgctgcacccattaactcatcatttagcattaggtatatcttctatagtgtccagtttctttgatagtcacaaatctcaacattctccctttatcatcctttatatattcccgtgagataaattacatgtaacctcctctattttgtgtccttctcctctggggctggttagctcagttagttggagcctggtgctaatgagaccatggtggcctgtgagcttcactgttcgtggtcacagtgtaagctacagccagctaccttgagattgcttgctgttgatcacaaatgaggtgaaggctgggagtttggtgggctctgtgaatttttttttttttttttacctgcaggttggtatggctcagtaatttgtcaatgagaggagaccttatataaaaacctgtggctgccctaccacctgataattaaagtggtacccccaagcatttctaatttgccttaatatcctgtaatcatctgttaaatattcatttacacccttctttccgtggtcttctctcttgaaccactctggataccagtcacattagcaattcattaatcacctggattatacacattgtgaattactttgtgtataaaaaggtgtgaattactttgtgtattacaaagtgtataaaaaattactttttatacactttgtaataaagttacatatttttatctatagtatcactaaatcacttttttttagaactcttaattaggtaccttctagtatggatttagccactccaattttaaaaatacatacacatatgggattcatgtatgtacatatgtacatatgtatgtataaaataccctgtgcttttcatactgtttgatctagcaattcatatctttatcaaaagacagcttaggactagccatctgcctaaagtcttcctcagtggagaacaagactgaaggatttattcaatttctttgccaccatttttgaaactacttttacttctttttgcactctgatttttaaattgggttgatctatttagtaaatcaaaaattaattaatggtttaggaatccctttttattgaattcagtaagtattgagcatatactctgtgacaggtatttaaatgagtaaagggtggataaaaagatgatcaagaaacaaactctaccctctaggaattcgttatgtaacaaaagtaagatgttggatgaatattttctggtccccttaatttctgatttgtacctgattcttcatatttttgtagctttgggcctttcttttttcaacatagaattatctttctattagccatgcaaggttctgttttggtttgtgttgttttgatggtggtggtggtggtggttgtggttggtcaaacccttgataattttaaactcttagcctacctatttatctaactttcactgacatgttcataaatagtctccaggtttcctgtgggttccttgctttgctcagttcttcctatttatctcccaaaaacccacattttgtttataccctttgttaaaactagataaccacttaattctttgaactacttcaatgaggtatgattgacacacaaaagctgcacatgttcaatgtatacaaattgatgactttggagacaaacagatgctcatgatactattactacaatccatgccacaaacttgattttttaaaaaataatctttgtttcctactagaatactaaagttaattgaattgccattattattacacggtggtcaccaacaaatttttaggtcaattcctgttcacctcctcaggaacaatgtcaaagttaccctgcttataagtgtcaatcatttgctctcttcctaggtgatgtgctgatctgtgtttaggtactcctttatgattcctggcctgctgttgtatttctcctcccagcaaatatgggtagctctgaaccatgacttgtgttctcatttgtgttattctttatacctcttatactcacaatcacctattgatctttcaactaacctgcctgccttcaatggttcctcttacttggagaattctctgattaataagatcagaaaatccaggtctaggtgaggacaatggttcacttttgacccatgaactttttttttcttagctctctctagagccatggggacttattcattaacaagtacgattagtacttaaacaccactatcagcttgcatctgtttttaaagttaactctcaattattgagaaactaattaactagtctggaggttatgtgggtctcctgcagcctgcattttggccacttcagtccccacggaacattactcaaggagtgtggaaatgaccaagcaaatactgtgaaagagagattattcaattgtactctgtgtgaaagtgaagtctgatggaaactaaaattatggatttcagtgcattttgggattatctaaagatagaaatatgcatgatgaccgtaaaaagagccttccttttatattatataaatgcttgcaaatgagcaataaaatgaagatattatgacgctagtaaaatttatgagtgctatttttcttgtattaaaattgggtcaacaaattgttaccaaatgtttacccttctgtaaaagaaaatatctagtcattcaactctagacaggaactcagagatggaaggccccgattattctgttgaccttaggccaggattttgaaatattttacattcatccaacaataattgtaattgatcttggatatttttgaggtaactacaaatagatctaggctattgaggagacacaaagattgatttggcataacatttaattttcatttatttatactagcttgagaaataacctgttaagtcactgttcctaaagtgtgtgtaaactagacatttatttgaggcatagttttgcattgaattgcattgcctcagaatcctttaagagcaatctgtggtggcttttaaaatttttacctttacaggattccaactactatttccccattcttagtcacggagtagtgattgttctataaacaaatagttaaaaatcctaatcctaatattagtaactatgtaaaagaacattttagtgaataccttagtattggtttacaaagccaaacattttcaatttgtggaatcttgctacaaatactaaattcatatacatatatattcatatatattcatatatatatgaatatatatgaatatatatatgaatgtatatatgaatatatatgtatatatgtatatatgaatatatatatgaatatatatgtatatatgaatatatatatgaatatatatgtatatatgaatatatatatgaatatatatatgtatatatgaatatatatgaatatatatatgaatatatatatgtatatatgaatatatatatgaatatatatatatatgaatatatatatgaatatatatgaatatatatatgaatatatatatgaatatatatatatgaatatatatatgtgaatatatatgtgaatatatatatgtgaatatatatgaatatatatatgaatatatataggaatatatataggaatatatataggaatatatataggaatatatataggaatatataggaatatatatatgaatatatatatgaatatatatgaatatatataggaatatatataggaatatatatgaatatatataggaatatatatataggaatatatatgaatatatataggaatatatatataggaatatatatgaatatatataggaatatatatatgaatatatatgaatatatataggaatatatatatatgaatatatatgaatatatatgaatatatatttggtgctttactcctgaaagcgttggagaatttcattttttgaaatcatttagaaccaaggtcggtgaactttcttgtgaatggctaaatataaatattttaggctgtgaggttcaagatgcaaagttgagggtattatataggtacttatataacaagagaggaaacaaatatctacaattttttgtaatacagctctactaatgagcacaatgaaatttgtggatggacactggaataagagtttcctataattttcatgtttcactaaatattattctcttatttttttcaatcatttaaaactgtaaaaaacattcttagattgctggccatacaaaaacacaggcaggctgaatttggcttatgggccctagtttgcagagccttactctagaacagagattcttaaccagtaagtagttcataaccccacaccaggggtgagtgtcgtggggtccttgaacttgctgagatcacaagcaacattttttgcatacatgaatttttctgtggacagagtctgcagcctttatctgactcttggagaagtcctggactcaaaaaagattaggagccagtgttgtctagatatttcgttaatttttaggacacatttcctgagtgtctgatagttcctaagcaatctgcaagtcactgggaactcatgggaatttctactgtaggagctaatactgctagagacatggggataaatagttgtcaggtgatcttattcataaagtctgttgccaccaccattcttgctggttgacaacactcagaaagatgaaaatttacacctggttatgggagggacagccgtctcttttcaagtatttagtaaataatttaggttggaatttaaatatctgaaacatttaagtgttcagaccatttcaggctgtaaagataaatcagagtcagtatagttaaaaccttttcctttacaataaaaattaacccacagataggttcatgttagctcaactgacatcaagggctgagatatatatagagacaggattaaagttgcttattaaagctgagcttctgagcttgcaggctgcttgacttaacccatggctgttagtcaacgctaagcccttgaatgttcaaattcatgaaatggagtagttaccctggggcagaggtggtggtgagaaaacagaaatgtccaactgaaaataaataagccactcaggagttcctgcctctgccccagtattgagaatgggatagcttgcttcttctcaataaacagtgttatagaatgcatttcatactcaaggaggaaatagttataagagctaggatactaattttaagatctaaagatagcatagtttgtggtgaaaccttagaaaaatctaaatactttcagtaagccctttacattttatatgtagaccaatcattaatttatagcctttttttccatacacttggagcatataacaaacctaagaaagtttaaaagtattccaaagaaagcagaacttagctaggagaatttccctggtgagtcacctcaaaaaagaaaagaaaaaaattacagaagtaaaaagctaccataaacagaaagcattgctttcaaatacattaggcttcaatattgttgattgatcagcatttattagtgattaataactttttaatctggaaaattcacccacctccaggtctttctttcagttcaaaaattaatagatacaataatggtcctgctcatttttgtaaaaggcaagagcaaaaagtatgcaggagaatgggctggtggcttcagtgagaaatttaccaggaaagtcagagacaacgaaaagtcaagtgaagagcactatcgtgtgcttcaaaaatggactctttctcatcagagattcttggtgatcttgagacaactatgaatcattacattgataaagtctgccttattgcggaagcatgcctgggtggctgtttccagaagatttccttctcattatataaaatcatgtcacatcagctagttcctgagcttcacatctcattccatgacaagtatcccgtattcctgtagtctattacatcataagagctagttagactgggtcagcccttggctatttgcccccagactttagagtccttctcctgactacaccatcatctttcctggcacctggcgttccctttccacttaaggctcttggcaaccatgtctttcctactcaccctcgtgagtcttgccagttttttggtgccagattctttctgcccttcctaatgtcccaatcagctaatttgataaactcatctaaggtagaatgctaatgggggagtgcttccttctaagctgaatatggtttataacagagtcttcttggaatgctgtgtgggtgacaatttcaagtctgtgtgggggtgaggcaatgagtatacattgcccttcactttatattccacaatttgtatttagacttgtttctattaatgtgacttagcaggtatgggcacagtttggcaaatgcaacagattcgggggttttttcaagtgaaaaaattttataaagcaagaaggaacacatgcaattagtaatacacaatgagacaccaccagtttcacaataactaacttgtagagtcattattagaaatatactacatttagtcatgatttattattcattcattaagcttttaaaatgtatcattgagtatatctgtcaaccagtcattcactaagtgttgggtactataggggagatgagaactatcaaaggaataaaaccacattgacaagaaaagatacccacatgtggaacaaactggaaaacagcaaagtgataaataatatggcaacagataataaaggaaatacacatattaaactttttgaatccaggatctttgaaaatagaaaaagcagtaatagctttttgcatttctgaggttttttttttttttacaagttactctagtttgtgtaccatataatcctgttatcttatctcttcctgcctaacagggattcttgtagcatttctagtgccttcttttgaactatgaatatcatctggccccctggataaagacaaggctaggcaagtcagattagcttgtgaaacaggacctctaggatgactacagtaaacaataatttcttgtacacttaaaaataactaaaagagtataattagagtgtttgtgacaccaaggaatgataaatgcttgaggtgatagatactccatttaccctgatgtgattattacacacagtatgcctgtatcaaaatatctcatgtaccctataaatatagatacctactatgtacacataaaaatttaaaaaacaggacctctgatttaaaaaaataacaaaatataatggaccatactaaactcattttaggtagatattaaagcactcactttttctaatttatcactttcttcctcaactccttgctgtgttccataattgtcagtgggccaggaagacagaagcacagccagtatttggtagtacaggtggggcctgtggtaggacaggcagccttacagccaagcagtattgatggtgaagaggaaagaggaaggaaagggactgaatgcaaaggccatgcctgtgtaaggaaacaaagaagattgtccatatgtgtaatgtcattggtgacatggtttttagggaataaagaaagagttggaggaaacacatttggaacagactagcagtgagatttaatttggataattcatgactgttaaaatcatgtggcttattttatgagcttaccaataaagttagtacgtaaagagatttgttggtttaaaagcaactcctctatgggaattagtatgaggctaaaaataaatcagaagaaaacaatagtaaattttgatgtggcataagtaattttgatgtttctgaaagaatacctctttgtgtaatgacaggaagaatctttacctctaacatctttttttctcttttaaacatacagggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtatttgtgaacatatatataaatacctgtagaatagatattaaccttacacataaagcagtattctcagagcccagtgtgttgttttaaataagagaacccaaatttcttagcttatagggttgttaaacattttagtactgcaatcataccttgttataaagtgcattgattcacctgtatggtaggtcaaacaatatgttaagtgtacccagccatagactgtgcgatggcacaggaagcctctgtgggaatgttccttttacctaggctccagctttcagaaacagattactatatttgttaatgagtctctacttgctagaataatcaaagtgggaaaaaagtagacaatataactctctacgattgcagaatgtaaagctatatgaacacagaaggtaaattagtctcatagtgcctcaacttttttctccattttgagagtgatgtgctaggcagtaaataaccccgatgcctaagaaaagaaaatctgaaagaaatttcaaacagctttttgatttattgaagtccttcattcttctattgttattctttgtacattgaaataactagtctttccttacaaagtcagctccatttgcagccgcttaaatgcctagtaatgtattgtaatataatctgattgtacatataactcagttatggttcacaagttgactttggaaaaccagtgcattatggtgtgataaagactcatcttggacttaaaaaaacactaattatgcttaaggctgtgtattaactggagaattaaaactggttttcagtaatacttttttaaacatttttatttcaatgtaaggacaacctccttttggggagaatagaatttttttctgggaatagaaattctgtctgtttatatctcatagtgaatatggctttacattattctttatctttttagatttgttcacacataatatattcaatgtatatataattactgttacattcactagcaaaataaataaaagccagtcagcttccagtcatcagtgtgatgcgtgtgtatgtgcatgtgtgtgttctaaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggtaagaaaaggcctgcacttgtggcctgtttcagagtaaatgctttgtatattcctcaatttgtctaatatcctgtaaccatactcatggatggtcatgagaggaccttaatatgaacagtcaaggttataagctggaaaagaaagaacctatttattctactttatttactaagattttctaaagataattatttaaaagccttactaatgcttttaacctactgtgctctttctcccattttcagagtaagggtaaattatataatttaaacagtaagttatttttgagtgcttttatagtttcactaccctcaatatcctagagaggcagaaagttgcctctgctctgtgagccactttcatgggccctttgctactaacatccttaatgcctttcaaaaacacagcacttaaaagatagggtattaagtaggttgtaatttcctaaaggttaaggccacttttcctctctagaggcatagtatcaaggacagcagcctgcttagtctggggggaaatttctacgtggttgggagcagaggcctgactttggttttttttttttttttttttttttttgttgttgttgttgttttgttttgttttgttttgtgggggtggttgtgtgttttttgttgttgttgtttgttttgagatggagtctcactctgttgcccaggctagggtgcagtggcgtgatctcagctcactgtaacctccgcctcccaggttcaagcaattctctagccttagcctcctgagtagctgggactagaggcgtgcaccactgcttctggctaatttttgtagtttttatagaggccgggtttcaccatgttggccaggctggtcttgaacttctgatctcaggtgatcctcctgcctcaacctcccaaagtgctgggattacaggcatgagctaccgtgcgcagcccagagtcctgacttttaagttgctgtagaaagccagttttgggggaacagttagtgctgcttagtaatactgaaaggtaggaagcaggaaaaatatttgtgtaacactgcagtgtgatcactgagaaccaggaattctcgtgacttaagtttgccacagctgtccgttgttttgatgtgctgcttgctatgtctttctttttctccctggacctttccttgtgtaataaggcataacagccccagtaaaggacaaaacccacaggaaacctcatgttccctgggtgtggaaaaagcactgacatgaccctgaagcccaggagatgcactgtgagctaaatctcctcacaaacattcatagtttggactcccatgacagagactttgcctattcacaacagagagacacttattttcaaacatccctattaagaaggttttcctcataccgagttgaaatttatcttgctgcaactggaacttcacaaaagaagtcagtccctattccaagtgagagtgactctcatgtctcctgtctaagccaaatactgcaaattgctcccttttcctggtagtttatggtttcaaggacacagtaccatttttggactggctccactttttgtcagaactgaactcattacatcgtgaaggatctgagcaccaaagtagaacaaacttactttctcccttgatctgaacaacataatctgttaatgaatgttaaaaaagactttaccaaattctttttgtcttaaatgcttttgaaggggtaattataagctatgaaaatagcttcatatgcatctgtccatttctgattatttgagtgtgtttgatagaatgcataggttacaagtcagcctcaaatttccacgtagagagctaaatattatatcataggccttcaattgttacttgtgaatatcaatataaaattcccttttaagtaactgatcacagcagggtcttagcagtgagatcaagttggctcataagaatttgatagaggtaagattaaataaaggagggcttcatgaagaaattcaagctttttatatttttaaggattcatagtggacatgctttataaaagagacatttttaccttgttcatgtatatagctcaggttgagttcacagaaagcagcttgtatttaaaaaaaaaaagagagagacataaagggttgatacttagttcatccacagtctcacacctcttcggcaggtttatgagtttaatagtacaatcaccacccaattggaactgggcactgacccatcaggataaaccccagccataaataaacaagcagtactaccttaccagcgtctacctgttgaatgttcatctaggtttcaccccaatttgtagtttactagggaacataactggttctgatgatcataccatgctgccaactttcaagagagagaaggggacactccccgtttataccaaagggaaatctttttaacaaccagataagtaggtcttctgtcttagttaaaatgttcagcaaaaccattttctcccaatggtaataaaaggcattcgaaatgatagattttgttttatggtttatgattttagtactgacctttgccatctggtctgctgggataaatttggaaattttatatctctaaagctactcagtttattttatctcactcttctagcatgcttttctttatttaggtgaaatgaaaagcagatctgtcacagtgtgtgcactgacagtagagttcccaaaagaaaatagagataccttgagacctttgttatccacaggaacgaggtcatggcattacccttttggacacatggtaggatagttactcaacacaagcattcctgtttccttaagaatttggagcatacctaattgttgttgctgggacatgttttttaagtaacgtgcaatttgctgagaaaaaaaaaatgtaaagtaatgttaaacttctccaaagaatctgatccaggggcaagtttcacggagtattataagcacagtgggattttgaaagaactgtagacatgaaaggatggtttaaaaatgctaataggttttagaattaaaccttacaagaacttaacaaagcaaatggtacataccgaaatggacagcaagcctctataaataagaactgcatatattttgctaactatctacatagtacctgcgtgaggtaggtcgtgggggaggaaatattcatttgctttttccttacatgttagttaggaaatatataattataggacttgaacctgaagtctttgtataaactggattttattttatggggtgacagtgtcagactctgatctaccaacatctgttttatcacctatatgccatttatgtcctagatctgtattggagttttaacaggcagaaatctctttcctgctatatctgttgcttctgctaatctcatttttatagattcatagatgagtatccctgagatattaattataaatgattgtttactgtagtagctttctgtcatatcctgcccaaatgaggtctaaattagtgaagttgaaaacctttttttttttttgcatttttttttgttttgcactactgctcatgtagttggactacctctttttttttttttttttttcttgagacaggctcttgctctgtcactcaggctggagtgcagtggtgtggtctcagctcactgcagtcttgacgtcctgggctcaagcaatcctcctgtctcagcctcccaagtagctgggaccacaggcatgcaccaccatgcctggctactttttctattttttcagagatggggttttgccatattgcccgggctggtctcaaactcctaagctcaaacaatctgctggtctcagcctcccaaagtgctgggattacaggcgtgagccactgtacacggctgtgaacccccttatctctacatttggttaccttgctgtggggccactgcttatccagtgtcttgcccaatgcatacccttacggaggattcccaggaaataccttatatgactggtgcttgcttggtttgagtacatttgttactttctctagtactagtaccatctctccccccacaggccctgcagcctggtacactgcaactgataccaaagagatcagcactggaaaagcccaatggtgccaccccggtctttaatcccactgttttccactgccaacaggctctgactaacctgcagctcccacagccggcatttatccctgcaggtgagaacacagctctaggcactgcagcgagtttggtgatgttgtgaatgtatacaatgcaaaacagctttcaaagagcttgtataggaggactgtcgacatgtattttgattaaaaataaaacaaggaagttatgcttatctgctagtatctagaactacttgtttttctataattcatgaaaattcatggtttgaaatcaaactaggaaaaagtatcaacatttttctttttagcatttgttggtttttgcttatgattaattcacttggttcagtctcaaactaattccttgactcttaggtatcactgtcacagacagtagagtgctgtcaaataaaaaggcaaaaactcccagcttcgatattatggaaatgcgttgtcaatatgtctttgatatgccaaaggtagttaaaataaaactaccctaagtgcataatatagtataatatagattaaacagatagttttagcctgtaactcctgaatcagttaatataaaatacatagcagtttatattttctgacattttgcagcatattttgttatctcctacattcagctatatttaatagcctgttttacatgaaattgaacagaaaatgttaagccagaaatttgttcaattagatatcatatattggggggaaactaattttcttccagtggtttagtagtttaagaatgagcatatagtctcttaggaataaattgaaaattctaaccattgagagtacagcagttttttttttccatttttttttttttttgacacaatggtaaatgcccaagattggaaactatttttaaatgaaaataacatatgttttaaaaaataatttagaaatccttgttaatacccagacttgagaaaacttattggttaactagtaaattaatcagttaattaattttgaaaggtaccataaaacaccagtctttagttactagccacagcagtccttcatgccatcatttaaattatacaatttgtatacatttatatgatagtttctgagaggaaatatggaattcttcagcactttcttacatcccttataataagtaactactgatatctaataatttagatattttctcccaacctaagaaaaacacacataatgtctacagagtaaaagagaaaaccagtatgagttgacatgactttattcctagcattttttttcttcaaaaattgtggtaatttacctacacattagatcactctaccttggctacttccaatttgtattatagctgtggaatgaattcagtagccctggaagtctagtcaaggtggttgaatataataaaatgtatgctgttcatcatagtttttcttaatactacagttactttgtttccaagtttgaattttttgccagatttggccaacataaaatctagtttcataagcaaaaatgtcagaaaaattccctttcccttaattagtagcaacataaaagcctgtccagctaagaggtctctcttaatggaacctctttgccatatattcatagtcaagtcctattgactatgagacagtggaggagacagtgttaacagattaatactctaaatagaaacacggacaccagatacgagattctggagcatatttagaaaatgatatgtgtaataaattaaaattctcttattataaaaattatttaggatgtatttgtccacaataaatatgtaatttaagtgagttaattcttttaaagaaaaattatagctgattttgtacctaagaatccaagaattattttgattacctgggtttgtgaccttaaaactaatctgtaattgtaaacatgggagattgttggacttgcatgtgctgagtaattgatattgcaaagaaataatctttctgttaaaatgtatttctatcagtaaatccttaataatcaaatatctcttttactttccacgcttttctgcgtggtgtacagggccaatactgtgcatggcacccgcttcaaatatt

SEQ ID NO: 3720 - DNA, 213015 bp, human
ggtagaaatcttcaatggtggggtcatatttctcaatgaaagtcccagtgacaaactgcacagtaagggcagatttgccaacccctccactccctaacaccactaccttgtattccctcatgagtctcaccttcaccaactcctaccagagggggggaaagatcaccccgctagctgtggcgcggctagacgaggcggaaggtgggcggaaatctgcgaactggggaggagagtgcagaggagcagagggcccaaccggggaagaagaggaagttacaggagggggaggggaaagagcgtagagtcggggagggtggggaagggatggtaatgcccttcctataggaactgcagcccgagcagggggcgtggggaggagggcgagcctgggaaaagcccggcgagggtggcgaggaggcgcgtgcccccgggagggaaagggtgggggctgcggcgaggggaccctgcggcgaggcggacgtcggaggagcccgcagcccggggctgcccggcactcctcccccgcccttcacacaaaggggcccagggaccccgcttcctgctcgcgcagcccagccggctcaggcctgagggctccgttccagttaccgctgcccgggcgggtttctgggccccggctcccgcgggggtcgtccggcctgtgaaggggagaaggacgcacattacccggctgacccccgccccgaacctgcggcgccggccgccgcctcccccaactcccacccggatcaagctactgccgcttaccccgccgtccgcacccgcccggccgccggggaggctctgtcacgccaaggccatggccacccgctggctcctctgtctctccgctgccccagcgctgctgctcgccgcggggaaagaagcgggggccttccgcggcggccgcagggactccaggcgaacccacctcttttttttctcacccaccccccacccccacccccacccccacccccacccccaccaagcacacacccggaagggtttccctgacacactggctgaggtgccccagttccccgagactggacgggatcacttccggtggggaaagtcccacctcttcggggcgagccgggtggcgctggagccgcgccctgctgagcgagcgagccggccggggacggtttcgggtcgggactccggcttcgggaacgggcctctggaaacctgcgacgtcagtccttacccgcccgcggctgccgcggaccgtcccacccccaaacccgtagaagcccctccgacctgcaacctccagccgcccggccctaggacttgagcggctccctggccggtgcggaacctgcgggctaataatctagcgaccgggagaacgccaaacatccctggactagaagttgcaggggaaatcaaacagcccagaaagtttattctccttgctggtatttcttccacttgctattttgctgagagatgcatgcaaactacccttagactttcagatgcagtgcgttttacttagccgtgcctgacaaacacacagaacttttaccgtctggtagatccgccttgactttaccagcgaatactaaagtcacttaaaaaaaaatcacaaggctcgaaaacagcagcattagaagtagactttatggtactctgctcagctatgttctcatttgattccaaccactacacggcagaaaaggtaaccaatattcaagaaagatttgattggaaacggtttaggcctaaagactaatttattttaatcgttgattatgtataacaatttgcttggctggctcttacatgctgaagttttgttttaaaggccatcctatgtagtctttgaaattcaaaagcaagtagtaactctggtgttagattctaagtttctatttttagataaaattgttacttccgactatctttccctttgctagctttctatttgtaaactttgtgtcggatccacagagccccagggccaggagtctaggctgtattttaggtgtgtcactttcttttcaattcaagcatgtacccagaaacctgcgagactcagtggccagcctagcaaaaatgactccaaattcccttacttacaagccctaaatggccaaactctataaagagatttattactcagcctaaattgttggacattagaacacaggcgaatcatagtagtgtgaggtcccactgtccctccctgagtattccccaatgtcacttacagtcttcaaaggagagtttagttcaatttctccttgacctcaggccggtgccatctctccagcgaagtccccagctctggctccagctggcctgggccctgtgtcgtatcagaggcactgccctctgctggaaggggtttggtctgtgagttatgagtttccccacaggtcactgctcctttcacacgtgctgttgcctgatttggagctctgctgctcatctccctgcctagctgtctccagactgtctggtgggattcacagccctccaccagccgtgcttgtaactgagtctggaaattcctcttctgatccagccagtgttgagcaatcgtggcaagtctttgctctattactaaactgtcaaagcaaggagttctttttcaggtcatcccacctgttggcaattctaatatctctgaatgtgttggtcatgcttaggagagagttctttgtttctccacgcagtgaaacatactcctcccctcagtacagcgtcctgtggggtcactctcgtcaactacagtggacaaatattacactcagtctaaagatccttctaaactttcttaggaagggtattcattacagcattgattaggaaatcaaacaattggaagaagcttaaatgtccttcagtaggtgatttttaaaagtttcatagctctctatatctattatctatcatctatctatctatctaccaacctacctacctacctatctgtattcacagaataggatattatgcagctactttaaaagagaaaagcagatttgtaagtgtttatataaaaagatggccaagatatattgtagggctgaaaaagcaagatactgaacaaatgtctagttgctactgtttatgtaaaacgcaggtgtgtaatagttacatagccattcaaatctgaaacaaagtaattatgggtgaggactattatgaaatggcttttatttctccatattttaatttataaacaataattgggaaaaaggaagtaaatataactttataatatttttaaaggaggaacaaaagaaagttgttgatcttggttttgtaaaaaaaaaaaaaaaaaatcctgactgtctaggggtcagtggacaggtccgcccaatttaaacaaattccctacccttgcttgccctccccaaacatctctatacttagaaaagtattttcacatacattatctcattagactcctgttgtttgctagtgtactctcattaagcaatgagggtataaagagcaagcagaagagtgcggcctggcagttgagagctaaggctctgaaatgagacagaggtgcattaaaattgcagctccgccacattctagctctgtgtccccaagcaagtgatttcacttgtctgagcctctaactcctcacttgtaaaaaggagataagaagttaacgtgaaaatgtaatgaggtattacaggtaaagtgcttagcacagtcccttgcacattataaagcctcaataaatgctatttggtttttatttaaaagatttaatgaattgttaatttttaaaaaatagcaaacatgggggtaacaaaattttaaaagctcaaatatctgcaagtggcacgaaaataataattcagttactcttcacaaagatatttattgttaaaagcttcttatgtttttcaggggggaacattattcatatgtcagtgtatcaatctaccttctatatatatttttaaaaattactgtactacaaaagtaatcaactgtacacactattttttaccttgctttttaaactttaattaattaatttttttaagacagtgtctccctctgttacccaagctggagggcagtagcatgatcatagctcactgcagcctcaacctcctggactcaagggatcctcccacctcagcctcccgagtagctaggactacaggtacatgccaccacacacagctaatttaatttaatttaatttttttggtagagatggagtcttactatgttgcccatggtggtctccaactcctgagctcaagggatcctcccgacttggcctcccaaagtgctgggattaaaggcatgagccaccatgtctggccttcttaatttttatttcatggctgtatcataagctaattagccagctcccctttgaaggacactgattgcttctaggtttttgcactaaacgccttggacatatatcattgtcagttaatgtttagggtgaatttctagtaattcaataattgaaacaaaaggcacttgcacttaaaattcttctggtaagtattgccaaattgtccttcagaaaggtcacaccaattcacattcccaccaatgcagtatgaccgtatcattttataacctcacagtaggtattactaattttagcattttatagtgattgttacttgctttagggtattttcaggactaacaaatgcagggcagcgttttagaaggaatttggacttcagagccagacagtcctaacactgcccttttgcaagctacacctccattccttcatttgtaaagttgggcataatagcagtatctaactcatagaataataaatgagaaatccattcaaagcatttagccttccaaatattaattgctcaataaatagaaactgctcaagtaataattttctactccaaaggcttgaatatgggaagaggggaatgggaggacttctctagagatcatgcccttgagattcacaacttttgctttaattctgcatcaacctcctttccaaagtattgctcaggcattattttaaagaacacaacccatttttaccatagtgtgaagaaaccacagtgtatgcactatatgcagataatataagtaatagggccataatctcattttttgaaattagtttggcacaagtttaaagtgctggatgtttgctacaggcaccagttgcttacttatccctttcttcttttcgagttgttacctccttcagttgcaatccttggagccaccaactgcctgggatattttaccctaacttccactctccaaatgagccgtcttgccttctaggtcctgggaaaaaacccatggctatccatctactttctatacatggctatctattttccatccaggctcttcccttctcttttgctagaagttgctcttgaattaccagaaagcttgagccagtaatgtcctcagtctttgcctacagaaatcttatttcaatgctttagggaccccattgatatcagctaaattgtcctggattctttctagctcctaccctctaagattccaatcttctctttcaaatcctgcctccagctacaccaatcattagttaatcattagttctgcatgtcaggctcccccagtacacaaaaccaattttatacctttattattatcttttttctcatgaaaataatgttatttgcaaaaaattataaaagtataatcccactacctggagaaaattgctattaacattttagtgtctttcacaattttttttctggagagagttaaagaacattttttttttgtaaactaataatgggttcatataaatttgtgaatggcttctttcacttactgaaacatcatgtctgcataaagcactaaaaaatactcatgtatccctcatcccctacatgagtaagccttttttcctatagctttagctttcctacagcatcaatgagaatttaatcacattcaattttgctcacctggaatccttcatccaatcaatgagatttcactagaggtgctgctgaccacagaggacactaccccaacctggccaggcagacactcctacaaagtcacaaatttgtgcgactgctgacaaagttagtttctcagaactgagaggcgtactaaatagggatgtgtttaaaatagatctgaattccttaacaatttttccctctccacttcatccttgatttgaaagatagtagttagaaaattattttgtaatctatcaagtaccaaataaatttaaagaattagtactaataataactatactcccatactcctaatatatgtacatcagaatcacctggaggtgatgtgaaccacagacggccaggtctcaaccccagagttttttattcagtaggtctgggtcaggatctataatttgcatatctaagttcccagatgacactgttgctgctggcccagggaccacattttaagcaccactgttctgtaaagcggtaggacattatttggggctttcttgcttgatactcattaatgtatccactcattcatttatcacacagttattgaattcctactctgtgccaagcactttactagcatttttgaggaatatagacaatacaatcaacattacagtatagcgtggcacatcctgtgatacagatatcggccagggtgttatgggagacttaggaagggtatcagggaagatttcctagagaaggtgattgggcagtaggcaaggaggccagaagaatcggtaggggctagaaccataggggaaagccttgagtagtaagctaaggggtttgacttttcccctggaggctgtaggaagccatggaatgtgtttttacaaaggtcttaattgcggtatacaaaatcaggggctagcgacatccatgccaggttcaaccattggctgtgctgcatatgtagcctgaggcaagttacttcttaccttctctgagcttctctttcatcatgtgtgaagggaaaatattaatagatctaccttatttgggtattgtgaagattaagtaagaaaaagtgcctaagtacccatcatatggtaggtgtttaacaaatggtgattatgatcaggtttaagccatagaaagaaatgacatgtaagacatgcttctcaggttattaaaatccatttgaaattgccaagctagtctcaatatcaaggccatatttgatgtgaagattaagtaagaaaaagtgcctaagtacccaccatacggtaggtgtttaacaaatggtgtttatgatcaggtttaaaccatagaaagaaatgacgtgtaagacaggcttctcagattattaaaatccatttgaaattgccaagctagtctcaatatcaaggccatatttgatgtggtggcaagtcggatgatttaatcatgtaatgataatagtttatcttgtcttttgttttgttttgttttggagacagagttgctctgtcatccaggctggagtgcagtggtgcgatctcagctcactgcaacctccgcctcctgggttcaagcgattctcctgcctcagcttccccagtagctggggctacaggtgcatgccagaatccctggtaatttgttgttgttgttgtattttttagtagagatggggtttcaccatattgcccaggctggcctcgaacttctgcgctcaggcaatctacttgcctcagcctcccaaagtgctaggattacaggcttgagccaccacacccagcctgatgataatttcttgattacagattatttgcgaggcactgtgcaaagtgatttatgcacatcatttcatttaatcctagcaataaccttaagagttaggtattattattcccaattttacaaacaaaggaattaaggctcaaagaagttagtttgtacatagtcgaacagttgggtagtggtagagtttgaattcaaacctaagttagtctgagcctatcttatattagccaccttgttccacagaaagcagttttgtttctttgaaggacagggcagcgaatgggcagtgaggcaaggttaaagaatctagactttattaccctgtttctctgccctcgagtaagactgactgttcatactgatttcaagtgccctctggaaacatgcctctataacctcccaggggccccttgaccttggatctgtggcacctggtactgaacctgaggtggtcatagttactttccaaagtgctctggaacatttacaacaaggagcccccttgttttgacactaggacaatattagactctgtaagaggaggcattggggtaagcctagttatttttaatgctgctattactactattgtttattgagcacttgccacatgtcagaaattctgtacttcaatccttacagcaaccctataaggcaagcacattgtcatcatcatctctagtttagagatgaggaaactgaggctcacacaactaagttcacacagccggtagatgcagattcaagcagaaaactcgttcattcatttttacaaaccttgcattttcatttcttcctttgcctctgtacctataacaccttcaaacacagatgtaatcctcctgaattcttttactgcccacaagttttatttaccacatagtttaagccctatttttaatgatgtatatacaaatcgtgtttctcctcaaaattatttcatgccataaaaagtcactcttccctccctttatttacaaattcattcctctttagaaatgagcacttataataattacatgcaaggccaaatttttactgtttagtgtaaacccataatgtgaaattgagaatggttgaaaagcacggttatgaaaacatcgtggactccagactcatcccatacaatttccaaggggaatttattctaagtactttaaaacttacaaagagttgaattctgaactacttgggcctctatgcactcttagcaattcccccagcagggaaccaaaaatgagaatagaaagaaattgcctcaacattgaattcttagacatttagaaggcctggagtctgaatactttaaaaggctgttatttaaatgtgggaaatgatgtgaaaagtataatgtaaagataagataaatattgtttgctaaaataaatcatcgggtttttttttgtcaaattcatggcaattttaaaatcctgttaattctatttatttttttcttatttggagcaggtagctgaatatgcagagttctggcactaggtgtcagcaaaagattaaactaaaaacacccactttgggtttttttcttttcttttttctttctacacatatatatttgagacagggtctcactctgtcacccaggctttagtgcggtggcatgatcatagctcactgcagcctcgaactccctgggctcaggtgatcctcccaactcagcctccggagtagctgggactacagccatgtgccaccatgcccagctaattttttgtatttttttttttttttgtagaaatggggtattgctatgttgcctgggctggtctcaaactccttggcttaagcaatcctcctgccttggcctcccgaagtgctgggattacagtcatgagccaccatgcccggcctaatcttccatatatttcaaactttataaaaataaaaataaaatacatagtctggattttaaaaagaagagacaacacacttccttgttgccatgacaacgtcagcatgagagaggctgggttgctgctgctcaagtaggcaccttacagagatcctcatggctcaaggaattcaatgtaagaccgtttgacctttagcattgaatggctggggactcaattttgtgtcagctagaaagctggggaatgagaagtttggagggttggatggggtggtgaggtacactcctgtaaaccagatcttaaaagtctaaatattaaattattttacatagaaatgtagtgttcaagccaaccacagtgcttgtgcagacaaattcagtggatgcttttcccacatgacaagattaacaaaattaacttagaggctagctttgagaacccaggctgatcctaagggtttctcaaacttactatgttaattttagcatatcatagggtttttttttccttttaatatccagagctttccccccttcttgtgattcctgtcacagtaaatggtgttaccatccagcagtcattgaaagtagaacttagggtattgttttaggtcattcttgtgttgctagaaagaaatacctaaggctgggtaatttataaagaagaggtttaactgggtcaaggttctgcaggctgtacaggatacatggcatgtgcatctgctggcttctagggaggccttggggagcttttacttatggtggaaggtcaagcaggagcaggcaggtcacacggggaaagcaggagcaagaggaaaagagcaggaggtgccacacactcttacacaaccagatcttgcaacaactgactcactatagcaaggacagcaccaagccatgaaagatctgcccccatgatccaatcacattccaccaggccccacctccaacactggggattacgtttccacatgagatttgatggggacacagatccaaaccatataaaatatcactcttaactcttcctttatcctcatttcctataaccaaacaacccattaagtcctgccaagtctacctccttagtctttcttacatccgtcatatcctatgtctgctctagtgtgtagagggactggagaaacatttgtgtgacaactctttcctgaatgctgtaatagcctcctaaatcgtttgtatgtctctggtgttttctgcatacttttaccagtgttatgaaacaagtctgtttgaaacaagtctaactacatatttctgctgatttcaacaactctctatcagaaaaagcccaagtttatacgcatgaaatataaggtcttctatattcttattcctgcctaccttccaagcacatctcccaccttcacatcctttatgttctagtacaaataaaatcatcatggtttcagtgaatttgcacccagtcttatggctttaaataccatcttacatactgcagactcccaaatttacatctccagttcagactgctcccatagttctagatcaggggtccacgacctctgggccatgggccggtaccggtctgtggcctgttaggaactgggtcacacagcaggaggtgacttgtgggtgaggaagcattaccgcctgagctctgcctcctatcagatcagcagcggcattagattctcataggagcatgaaccctattgtgaacagcgcatgcgaaggatctaggttgtatgccccttatgagaatctaactgcctgatgatttgacatggaacagtttcatgctgaaaccatcccctgctgtcgccccccacctccccaccctctatggaaaaaattgtcttccacaaaaccagtccctggtgccaaaaaggttggggaccgctactctagattcatacttatactatagttccatttgtattactcagacatctcagatttaacatgtccaatgctgaatcttgataaccacctctcctcagaaatgaacacatgcctctcctgcagtcagtcttcctttctttctctttctttttctttctttctctctctttctttctttctctctctcttccctccctccctccctccctccctccctccctccctccctccctccttccttccttccttccttcctctctctctctctcactctctctgtctctcagacaagatcttgctctgttgcccaggaaggagtacaatggtgcaatcatggcttactgtagccttaacctcctgggctcaagcaatcctcccacctctgcctcctgaatagctgggactacaggcaagcgtcaccatacccggctaatttgtgtatgttttgtagagatgaggtctcattttgttgcccagactggtctcgtactcctgggctcaagcagtcctcctgcttgcaccttctgaagtgttgggattacaggcatgagccaccattcccagcctcccttctgcagtcttaaaaatctcagtaaatggcaactccagcttccagttgcacagactacactcttccagtcatcctagagtcttcttttccccttatgccatacaatccaacccatctggagatactgaagttcttatcttcataatatgtccaaaatgtgactatttcttaccacacccactgctaagaatctggcccaaaccaccattttcacttttctggatgattattgtattcttctaattgctcttgctgtttgtgaacttagcctccttcaatctattctcaacgcagtagccaaactgatcccattatagccacaaaatcctacagtaatttctcatctcactcagagcaaagtcaaagtccttacaataatctaaaaagcactacataatctggctcttcataaatgatagatatactcttacactagcctctgtacttgctgtgccatctagaacgttcttcccccagattctcagtttccttcctttcttcagctgttttactcaagagctcctactctgtgtaacattgcaccccctcctcatgcaataccttcaagtcttatttatttttttctcattagcacttacacttttctaatgtactatgttctttagggattttaatatgtttcccctattacaatgtaaactccacaaggatgggtacttttgtaaattttgttcactgaatatcccatggtctagaaaagtgcctgcaacgtggtaggtgttaaatagtgatgatgttattaaactgtttacacagttctgtacatattttatttgcatatgccttatatattacctctgcccagagggctttcccctatcttcatttttccccgctatggattggcagcattcttttttcttaaaaaaatcagctttattgaaatataatttacacaccacataattcatccacttaaggggtacaattcaatgatagtattatgttacagagttacgcaaccatcaccacattttttttcttcaaattctattttaagttctggggtacatgtgcagcatgtgcaggtttgttacataggtaaacatgtgccatggtggtttgctgcacagatcatcccaccacctaggtattaagccccgcatccattagctattcttcctgatgctctccctacccccaccttcccctctgagaggccccagtgtgtgcgtcaccacaattttagaacatttttatcacttcaaaaagaagccaggtactctagctattgtctctctatctccattcctgcagccctaaccaaccactaatctactttctgtctctctagatttgcctcttctggacatttcatataaatggaatcatataatatgtggttttttgtgactagcttgtttcacttagcataatgtttctaagcttcatccatgtgatagcatatatcagtacttcattccttttcatggccaaataatattatattatattatattatattgatataccacattttgtttatccatttgtcagttgatgtgcaattgggttgcttccaccttttgactattatgaataagactcctgtaaacacttgtgtacaattttaaaatgtggacaaatttaaaatgtgttttcatttctctctctctctttttttctttttgttcttttgagacggagtctcactctgctgcccaggctggagtgcagtggcatgatctcagctcactgcaacctccgcctcccgggttcaagcaattctcctgccttaacctccagagtagctgagattacaggcgtgcacaaatcatcccatcccctaggtattaagcccagcatccattagctattcttcctgatgttctccctccccccacccatgcgtggctaatttttgaatttttagtagagacagggtttcatcatgttggccaagctggtcacaaactcctgacctcaagtaatctgcctgccttggcctcccaaagtgctgggattacaggtcatcatgcctggcctcatttcttttgagttgagaattgctgagtcatatgacaactctaggtttaaccgtttgaaaaactgccagaccattttccaaagtgaatgcaccatttcacattcccaccagtagtgtatgagggttgaaatttctcctcatcctctccaacatttgtcattatctcactctttgattgtaatcatcctcatgggtgtgacatggtaacacattgtagttttgatttgcatttccccactgactaatgatattgagcatcttttcatgtgcttattggttatttgtatatctcttttggagaaatgtctagatcctttacctattttcaaattgggttctttttctttttatcattgagttgtaagagttctttatatatcctagatataagtctgtattaatctgttctcacactgctataaagaactacctggtactggttaatttatgaagaaaagaggtttaattggctcacggttccacagatttaacagaaagcatgactgggaggcctcaggaaacttacgataatggcagaaggtgaaggggaagcaagcaccttcttcatatggtggcaggagagagagagagcaaaaagggaagtgccacatacttttaaaccatcagatctcatgagaactgactcactatcaggagaagagcaagggagaaatcctccccatgatccaatcacctcccaccaagtccctcctctgattaaacatgagatttgtgtaaggacacaaatccaaaccatattcaagtcccttattagacatagatgatttgcaaatatgatctctcattctctaggttgtctttgggttgatagtatcttttggagcacaacattttttaagtatgatgaagtttaatttatctatttttttctttggttgcttgtgtttttggtgtcgtatctaaggatactttgccaattttgaggtcatgaatatttaccttataatttcttctaagagttttacaagtttagctcttacatttacatctttgattaattttgagttaatttttgtatatggggtgagtaagggtacaatttaactctttcacatgtggctaactagttgttccagcagtttgttaaaacaactattcttccctgttgaatggtcttggcaaaaatcaattgaccataggtgtatgggtttatttctgtactctcaattctattctattgttttatgtctatccttatggcagtaacacattgtcttgattactactgctttttagtacattttgaaatcagaagtgtgaatcttccaggtttgttcttctttttcatgattattttggctattctgggtcatttgcaattccaagtgaatattagaatcagctagtcaatttctaaaaggaatccacctgagattatggtaggaattgcattgaatctatagatcaattcaaagagtattgccaccttaacaatattaagtctattaagtcttctcatccacaagcatgggatatttttcaatttatttagatattctaaaatttattgaacaatatttgttagttttcagagtgtaagatttgcacctcttttgttaaatttcttcctaaacattttatactttttcaatgctactatgaatggaattgtttcttaatttcattttggactgttcattgtaagtgtatagaaataaaattgaattttgtatattgattttgtaccctaaaaacttgctgaatttgcttattagttctaatagttcttttcagattccttagcattatctacatacaagatcatgtcatctgtgaatagacatcattttatatcttcctttccaatcaggatgtcttttatttcatcttcttgcctaattgccctgcctaaaacttccagtacaatgttgaataaaaattgtgagaacagatcgatatcttcgtctgattttccatctcctggaaagcatgtagcctttcactactaagtacgctgttagctgtgggtttcttgtagataccctttatcaatttgaggatgttctttctaattctagtctgtggagtgttttttaaaatcatgaaatagtgttaggatatttgtcaaatggtttttctgtgtctactgagatgatcatgtaattttcttgttttgttgatataatgtgttatactaattgattttcaaatgttgaaccaaacttgcattcctgtgataaatctcacttggtcatgatacataattcttttttggattttgctggattcagtttgctagtgtttgtggtgaatttttgtatccatattcataagagatattggtctgcagtggttttttttttagttgtgatgtttttgtctgttttttctctcaggataatattggtcccatagaatcagttgggagatgttccttcctcctttttaatttggaagagtatgtgatgaactattattaattgatcatcacatgtttggtagaattcaccagtgaggctatctgggcctaggtttttctttgtgggtagttttgcctttttattttttttttaactacatcaatctcttacttgttataggtctcttcagattgcctaatttttcttgagtaaattttggtagtttttgtctttctagaaatttgtccatttaatctaggttatttattttattggtagacaactgttcatagtacacctttataatccttcttattcctgcaaggtctgtagtaatgttcccttttttgcctggctaatatatattcttcctctgagatccaattcacacaccatctatttcacaaagctttcttttacactcctcctacccccacccccaccccaaaaatctttctgaaataatattcaatacccctcttcattccctcatcatatcattttacagactgtattatttcctctttattatgtctattttcctcctagactgtgagaaacttgaggaaagaaactttggtcttaatgacacaagatgcttaatgaatgtttttggaaattaactgaaattagtgactgttatcaagctcccttagcctgatgcatctatatccactattgaactacatttgctactcagagtaaatattcctattttctcatcagtgtcccctcttattcttattactgatctctccctttgcctttctccacacttgtataatatgatgacctctctccctcatccacaagttgccaagaacttccttaaaaagctaaatctcagttttccatattccacccttctaaatcatccatggttcattgtaaaatctctggctgaaaaaaaaacataaagagccctaaactcatgaaaaggtactcagtctcactccgtaataagaaaggtgtaaattaaagccacactgaaatactgtttttcacctatcagattggcaaaagacaaaatgtttgataatacaagtagcaaagaggaagagaaggaaagaaacttgtaaccatcaagcaactacagtggaccaggcacattacaggaagtaagctattgatttcctccctctccatcttttacgtgaatttgccagctaaaatgaagtatgtacaaataaaatacattttgcttgaaaagtaagttatttctggacacatatttgtgtatcagaaaagataagtgtttcatattaagataaggaaagagtgtgaattaggttcaactatacataatttacagatagattataaatctttttccctgtctcttgccctgtgctcctcctaatcctcattagttaatgacatcaaatgagaatgcatgcaatttaggaaacgatagtagagagtacaaaaggggatttcagtaagttttcagacaacctagaaagttcagcctcctttcagtgtgatcaggaaagactgaactatgaacaggattccagattcatctaaagttaaggtcgaaatttctaaaagtggggctgtggatctcttagaggcttgtaaatccctacattgaattgtctgtacacaataaatagatctggtatatatgtgcaatgctttaaattcatattgatgttattgtgaagaataaaatataaattcacatatgtttacaaacaaattttaattttttcattttgcaaaagcagtacatgctaattgtcaaaaactatggactggcaagaggaagaacataaagttcacctaaaattctaccacccagaagtaaccatagttgtatattttttgatagaaatgatttagatttacagaaaaattgtgaagatagtatagagttccaatataacacacacctagtttctcctattattaacatcttatgttagcatggtacattcgttttaattagtgaaccaatattgattcattattattaactgaagcccatactgtgtttgaatttccttagtttttacctaatgctttttctctgttcagagatcccatccaggataccacagtcgtcatacctccttaggttgttcttggctgtgacactttctttgattttccttgtttttgatgacgttgacagtattggttagatatttgtagaatgtttctcatttggatttgtctgatgttttttgtaatttgacagaagttatggagtttgaggagaaagactatagaagtaaagtccaattctcatcagtaaaatgccattcccatcacaccatatcaagggtgtgtacattacatatatgtgcgtacatgtacgttgtaattatatgtgtatgtatatataattacatataattacaatgtacatactattttgtactctgctttcacttaaatacctggcacgaaaccctttcatgtcattaacagcaacatattaatatctacaagttcattttaaaatgttaatgattccagaggagatttatgtctccatgtctttcctcaaatgatggattctctgggtctacttcctatcatgtgcaagacagtgtcatttgtttacattatagaagtgggtctgattgtagagtttgcatcctagactccgacatttctctttgaggctgtaggttgggttgggttttgtgagctattttgaatattttgaattcctttcaggatcagtgataagtgaggaggtaagagagataaatacagaggatacgctatgtagagaattcagaaaaacaagagacttttggatttattatctaaagggagataatccaattcagagtcactacctgagatactatgggaactgacagtctccaaaggctatgttttgctaaaccacagcatatttccacgaattaggacacaagggatggtaaagatttgtggcaatagatatttgcgtcatttagaaatgtcaactagggggccgggcgcagtggctcatgcctgtaatcccagcactttgggaggccgaggcgggcggatcacgaggtcaggagatcaagaccatcctggctaacaaggtgaaaccccgtctctactaaaaaaaaaaaaaaaaaaaaaatacaaacaaagtagccgggcgtggtggcgggtgcctgtagtcccagctactagagagactaaggcaggagaatggcgtgaacccaggaggcggagcttgcagtgagccgagatcgcgccactgcactccagcctgggcgacagagcaagactccttctcaaaaaaaaaaaaaaaaaaaaaaagaaaaaaaatgtcaactagaactcatggtattttttatgaattgaaaagtgaccccaaataactagctaatttgtactttgtggtagcattttattaaatattaaaatttggttcttctgggtggaattttacctaagataattacaatatattataatttaaaccaacactgtggttgaacccaacgtcatattttgagtgttactgccaattggacaatgtttacttactaccccctatgggttagaggtaaactaactagattatttgtttgggcttatctctgcttatgttgatccaaaagatgtcattaatttctgctaacattattgtttgaatgaagtgaaattaagggtgtgttattatgactaatacggtgaatgtatttatttatttattttaagtatttgacactgactcctggggattacaataggagattctgctggcttttgcctacatatcaagaaaagtatgtatgcagtatcatgccaggaaatgagtggcagaggcttggactgggaacattataccaattgtaatgtatttgcagcagtaaaccagaggccaggggagttacaaaaacaagactgccaactcacaccgaatgtctatgcaaataagcaattgagagatcttagtttatttattcaaatgtggtatgctgacaacagcagtggactgagaagtatgaagttctgagtttggaagcctcctacaacaccaactccctgtgtaatcaagactcatcacttcctctttctgagttttcccctcccaaggctctttctagatctagcagcctatgaatcctatgattctactaggtgtgaggcattaggtgctttgtgagagccaaaattgtataagacactcttaaagttctttttttggaggctgtatatttttaatagaaatattaaaaatttatctgtcattgtgtcacactctgtcactgtgtcacccaggctggagtgcagtagcacaatcatggctcactgcagcctcaacctcctgggctcaagcaatcctcctgcctcagcctcctgagtagctggaactacaggtgcacaccagcagacatggctaatctttgtattttttgtagagacagggttttgccatgttgtccaggctggtcttgagctcctgggctcaagtgatcttcccacctttgcctcccaaagtgttgagattacaggtgtgagccactgtgcctagcctcaagttctctctctctttttttttttttttttgagacagagtctcactctgttgccaggctggagtgcagtggccagatcttggctcactgcaacctctgcttcccgggttcaagtaattctgcctcagcctcccgagtagctgggattacaggtgtgtaccaccttgctcagctaatttttgtatttttcgtagaggtgggttttcaccatgttagccaggctggtctcgaactcctgacctcaaatgatccacctggctcggcctcccaaagtgctgggattacaggcgtgagccactgtgcctggccctggcctcgagttcttaaaaatcaaagtaaggagttgaatattccatagatattctgcaaatatttgctcccaggactcaagaaggccccaagaactgaggcagagacagagcacataagtggacagttacacaattctaacaatgaagcaaggctacaatatttgtcttagcttcaattccatttattttgctccaacgatctatctatacacagctgaaaattagtgataacattgtctcttatctgttttgtgctgctataacaaaatgccacagactgggtaatttataacaaacagaaatgtatttctcacacttctggaggctgggaagttcaagatcaggtgctaacatctcgtgtctggtgagggcctatcatgcttcctcacatagcagaagagcaaaaaaagagcaaacccactacacgaaccctttttatagcagcactaaacacctcccattaggccacacctcccagcagtgttgcattagggattaagtttcaacatgcatattggagggaacaaaaacattcaaaccatagcacattggtttaaaaccaatataccagaacttaagcatgtgtatcatctctttgaagtaattgaacaattattcaaagacacttggaaactgcctacataacctgtggcgcatattcaaatttacttggttgggaatagccaaccaagtaaaccaaacatcacttagagccaaatgaagtgaatatgatgagtgatagactgggtgcagtggctcacacctgtaatcccagcactttgggaggctgaggcaggtggattgcttgaggccaggagtttgagaccagcctggccaaagtggcaaaaccccatctccacaaaaaatacaaaaattagccaggcgtgatagtatgcacctgtagtcccagctaattgggaggctgaggcaggagaatcatttgaacctgggaggtagaggttgcagtgagccgagactgtgctactgcattccagcctgggtgacaaagtgagactctgcctcaggaaaaaaaaaaaaaaaagagtgatagacctggtccataaattttgagttaaaaatgaagtatgattattaagaaatgagattggttttcttgaggtcctcataattggctctggagttttttgtttgtttttgttttgttttgtttttgacgtagtttcgctcttgttgcccaggctggagtgcaatattttactccttccccttgttatctttgtttagactgatgagcttctctgtgcaagggtgcctttttggagcaatgtccccattcggtccattgatatgaaccacttcattgaatgtcttagacggtaagtagtaacagctgctgtgcttgcttgtcaaaaggaaatttttcagagcctggacttttgtaatatatggcttctttctgttttctatagctaccaggagaaagtaatctttctctggagccatcccagaatgtagatcaaattacatcagaatacatagacattgacttactggttagtcaatcacataatcaatgtgaaaaaaatgatactgtgcatttttgtaccacacattttacttcttctgtgttcattcaaatatggtattgcattcagaccatctaccaattatctgaagggcagtaaggtagacatttctatccccatgtgaaagacaagaacacaggttcggaatgattacataaattacctagggttagatagttattattttattattatatagatattagatagttattcttttcttggttgtaaaaaagatttagaagcctagagactagttaaaatatttttttttcaggagctaagacgaatatacaatataggtaaaacacacttgaagctcaataaaacaaaccaaccacataacaaaagaggggaaccctttgtagataactgacaaatgtgaaagtgttattgttcatctatttattaaatcaatgaaaatttatttttataaaatgaatcaggctttcagccctgattcttgcccagagtttgaaggtgagccaggctctgtcacattatgataatcagtttctttgactaaaacatgacgagggacagagagaatgatacttgctttacttactcccttggggtactgtgaagagctttgccagttgtagagatctacacacaggtaaagacttaattaactcaacaaatgtttattgagtgcctaccgtgtataatgcacaaagggaaatattcatctgccttcaagaaactagtagcctgctacagcaagaataaaatgtataaaaatgagaaatgtgaggtagaaaatcctaagtgccaaaatagaggtaacatctctgaaaatattacagttactacatttctgaaaataagtaggtggttactggaattgatcaataaaatgattacaactataaaaatgatctttttaggcatgcagctttagcatcccatttgctttattcccagtacttaattaaatcattttcacttgacaaacatttattgagcaactactatgagctggtccctgtcctaggagctggagataaagttaaaaatgcatgtccttgctctcaatgaacttatggtttagtaaggagaaacaaacatgcacaataatgataaaaatttacaggtgcagtgggggatagcataagataagcagtggttagttctagctgatggtggagtgagcaaggatctgggaaacttcatggagaaggttgtgttcagtcttgaaggagagggaggactccctgaagcaggcaagaggcaaggagccatggatatctctggcagagcgaagggcatgaatacaaacacaaaggtgcaaagagcctgggagtgagggcaactgtaagtggtttccgttggcactattgaagtaggctgagggaagagaagtgcaacggaaaatatgaggcacttgttgatttctttacaactttgcccagattcaggcctataaccatccttcaatctgaattccttttgttttatgtaatagcttcaagtctgaatgatatggtttggttctgtgtcccaacccaaatctcatattgaattgttatccccacgtgttgagggagggaagtgattggattatggggcaatttcccccctgctgttctcgtgctagtgagtgagttctcatgaggtctgatggttttataaatggtagttttcctgtactcactcacgctctctctctgccaacatgtaagatgtgcctgcttccccttccgctatgattgtaagtttcctgaggcctcctcagccatgcagaactgtgagtcaattaaacttctttcctttataaattacccagtcttgggtatttctttacagcagtgtgagaacagacttatacactcacccacacacagttgaaaacacctgcatttgaaaaacaaacaaacaaacaacaacaaaaaaagcaaaaaaagttttgtttccaaaatgtattacaagtattttccatgtgaacatggtgcggaatggcacaactggacttggggtagtgcattactctctactgcatattcatccaagctggttaaaggctttctgtgtgaacttcttttcttctaggaaaaaaggagtctgaaaatttttaattaaccattcaggtttctagagctctgaaacagttgttagctcactaaatattagtattattctaaaatgtttttcaactaaagtctgcattttctgtgtttccattccttttttccctcactctgtggcttcacttgctatattgctttcaagtttggcgagaatggatcctttcccttttactgtgggccagctattctgtgttagagctcaccggaataaatgcttggtgcccctaagaagccatgttcatgctcttttgtgatatactccccaatcaaaattggaggcctgcctgtatctgctgttgactacaggctatcttgcatgagtatcattcctgccttttgaacaggagctagtctagcgcaatagtcatttgccataggggaattccattacctttccttaccaggaggatggattctgtctggtgtttacactgaagatgggggaaatttaattaaattctttcaagtgctagatttacttacactatcaatttactgctaaaaccgccattctcattttggagaatgagaataggaccatatgtcttaaacttatcaactgtcagcacttccagtaatagttttctgcttagaatcaaagaaagatttgggtttttgagttcccaaagccctctagttagaaccttgtggacctcatgatttggaactgaatttactatacatttttgcccactggaatgagttttgcaataaatctagtatcttatttggaaaatgtcttggggtaaagtttggcagcttcttcaaagagtagttcattcctcccataattgcctggtgaagactatgcagaaattagattaaacaacaccactgccaataaatcatccaggtgtttggccaaataacaaaatactggactatggggaaagctagtgaaagctaggataagtacacacaataattggcataaaaataaatcagtataaagagaaacagggtaaaaatttcagatgccagagataaggcattcttaatcctgtccaaaaattgatattatgggaaaactccccttgagtttcagtttagttcactatttgaaggtggaaaagaaatacatatggatttggttgggaatttgtttacaaaatgtttgacacttggataaaagctgaaaaaaatctatcaaaaatctaatgggacatgaaacctgttctcaagtagcttataacatagttgaaaagataagacttccacacttggcatcattaaagcttgcaatgatgagtgaaatgcatataacttagtgtaaacctgcatgatacagacacgcatcaaaagctatggaaattcaggaaaagaatcaaaggattaatgaggagctcaagtcttaggaaaagcttcatgaggtatgtgtgatttatgtagactcagaggctaggcacagtttggctgcacagaagggagagagaatgagatattctgattgaaaagggggaagaaaaagagcaaaagcatgagagatggaatgaaattggtgggcagaaggcaaagaaaaggtcagactacctagggtagagtatgtgacaaggctggcatggctgggtagactcagacttggcaatgcaggctttagaagttagtttgagttccagaggcaaagagccatcaggatccattgagcagcatagtgacatgatgaatgcagtgttatgggaaaattagaccaggatttatgggattacctatggccatccagatggcaaacacaccagttgcaaagattcttacttgccggtacaatgaatgtgaagggaaagaggctgaaggctggcatgaaatcaggctatgatggaggctcagatcaaccagaatgaattcagatggagggtacagatagtttccactggcatatgagagaggtgagatgaaatattctgatatagagtacccaaaagaaactaagagggtaaaagaaactaaggagaattagagagctggaatagtgaaggtccattattatctagcccctgcctctgactccaacttaattttcttttttttaattttattattattatactttaaggtttagggtacatgtgtacaatgtgcaggtttgttacatatgtatacatgtgccatgttggtgtgctgcacccattaactcgtcatttagcatgaggtatatctcctaatgttatccctccccctccccctacctcacaacagtccccggtgtgtgatgttccccttcctgtgtccatgtgttctcattgttcaatgccttcctatgagtgagaacatgcagtgtttggttttttgttcttgcgatagtttgctgagaatgatggtttccagcttcatccatgtccctacaaaggacatgagctcataattttttatggctgcatagtattccgtggtgtatatgtgccacattgtcttaattcagtctattattgttcgacatttgggttggttgcaagtcattgctattgtgaatactgccgcaataaacatacgtgtgtgtgtgtctttatagcagcatgatttgtaatcctttgggtatatacccagtaatgggatggctgggtcaaatggtatttctagttctagatccctgaggaatcaccgcactgacttccacaatggttgaactagtttacagtcccaccaacagtgtaaaggtgttcctatttccccacatcctctccagcacctgttgtttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgttttttcttgtaaatttgagttcattgtagattctggatattagtcctttgtcagatacgtaggttgcaaaaattttctcccattctgtaggttgccttttcattctgatggtggtttgttttgctgtacagaggctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaaggctttaatccatcttgaattaatttttgtataaggtgtaaggaagggatccagtttcagctttctacatatggctagccagttttcccaacaccatttattaaatagggaatcctttccccatttcttgtttttgtcaggtttctcaaagatcagataattgtagataagcggcattatttctgaggactctgttctgttccattggtctatatctctgttttggtactagtaccatgctgttttggttactgtagccttgtagtatagtttgaagtcaggtagcataatgcctccagctttgttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttcacgataatgattcttcctacccatgagcatggaatgttcttccatttgtttgtatcctcttttatttcattgagcagtggtttgtagttctccttgaagaggtccttcacatcctttgtaagttggattcctaggtattttattctctttgaagcaattgtgaatgggagttcactcatgatttggctctctgtttgtctgttattggtgtataggaatgcttgtgatttttgcaaattgattttgtatcctgagactttgctgaagttgcttatcagcttaaggagattttaggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagaaggcatccctgtcttgtgccacttttcaaagggaatgcttccagtttttgcccattcagtatgatattggctgtgggtttgtcatagatagctcttattattttgagatacgtcccatcaatacctaatttattgagagtttttagcatgaagggttgttgaattttatcaaaggctttttctgcatctattgagataatcatatgttttttgtctttggctctgtttatatgctggattacacttattgattttcatatgttgaaccagccttgcatcccagggatgaagtccacttgatcattgtgggtaagctttttgatgtgttgctggattcggtttgccagcattttattgaggatttttacatcaatgttcatcaaggatatttgtctaaaattctccttttttgttgtgtctttgccaggctttggtatcaggatgatgctggcctcataaaatgagttagggaggattccctctttttctattgattggaatagtttcagaaggaatggtaccagctcctccttgtacctctggtagaattcagctgtgaatccatctggtcctggactttttttggttggtaagccattaattattgcctcaatttcagagcctgttattggtctattcagagattcaacttcttcctggtttagtcttgggagagtgtatgtgtcgaggaatttatccatttcttctaggttttctagtttatttgtgtagaggtgtttatagtgttctctgatggtagtttgtatttctgtgggatcggtggtgatatcccttttgtcattttttattgcgtctatttgattcttctctcttttcttctttattagtcttgctagcggtctatcaattttgttgatcttttcagaaaaccagctcctggattcattgattttttgaagggttttttgtgtctctatttccttcagttctgctctgatcttagttatttcttgccttctgctagcttttgaatgtgtttgctcttgcttccctagttcttttaattgtgatgttagggtgtcaattttggatctttcttgctttctcttgtgggcatttagtgctttaaatttccctctacacactgctttgaatgtgtcccagagattctggtatgttgtgtctttgttctggttggtttcaaagagcatctttatttctgccttcatttcgttatgtacccagtagtcattgaggagcaggttgttcagtttccatgtagttgagcggttttgagtgagtttcttaatcctgagttctagtttgatggcactttcgtctgagagacagtttgttgtaatttctgttcttttacatttgctgaggagtgctttacttccaactatgtggtcaattttggaataggtgtggtgtggtgctgaaaagaatgtatattctgttgatttggtgtggagagttctgtagatgtctattaggtccacttggtgcagagctgagttcacttcctggatatccttgttaactttctgtcttattgatctgtctaatgttgacagtggggtgctaaagtctcccattattattgtgtggaagtctaagtctgtaggtcactaacgacttgatttatgaatctgggtgctactgtattgggtgcatataaatttaggatagttagttcttgttgaattgatccctttaccattatgtaatggccttctttgtctcttttgatctttttggttgaaagtctgttttgtcagagactaggattgcaacccctgcctttttttgttttccatttgcttggtagatcttcctccatccctttattttgagcctatgtgtgtctctgcatgtgagatgggtttcctgaatacagcacactgatgggtcttgaaggtttatccaatttgccagtctgtgtcttttaattagagcatttagcccatttacttttaaggttaattttgttaagtgtgaatttgatcctgtcattatgatgttagctggttattttgctcgttagttgatgcagtttcttcctagccttgatggtctttacaatttggcatgtttttgcaggggctggtaccggttgttcctttccatgtttagtgcttccttcaggagctcttgtagggcaggcctggtggtgacaaaatctctcagcatttgcttgtctgtaaagtattttatttctccttcacttatgaagcttagtttggctggatatgaaattctgggttgaaaattcttttctttaagaatgttgaatcttggcccccactctcttctggcttgtagagtttctgctgagagatcagctgttagtctgattggcttccctttgtgggtaacccaacctttctctctggctgcccttaacattttttccttcatttcaactttggtgaatctgacaattatgtgtcttggagttgctgttctctaggaatatttttgtggtgttctctgtgtttcctgaatttgaatgttggcctgccttgctagattggggaagttctcctggataatatcctgcagagtgttttccaacttggttccattctccccgtcactttcaggtacagcaatcagatgtagatttggtcttttcacatagtcccatatttcttggaggctttgtttgtttctttttattcttttttctctaaacttctcttcacgcttcatttcattcatttcgtcttccatcgctgatgccctttcttctagttgatcgcatcggttactgaggcttgtgcatttgtcacgtagttctcgtgccgtggttttcagctccatcaggtcctttaaggacttctctgcattggttattctagttatccattcgtctaattttttttcaaagtttttaacttctttgccattgtttcgaacttcctcctttaccttgtattagtttgatcttctgaagccttcttctctcaacttgtcaaagtcattctccgtccagctttgttccattgctggtgaggagctgtgttcctttggaggaggagaggcgctctgatttttagagtttctggtttttctactctgttttttccccatctttgtggttttatctacctttggcctttgatgatggtgacgtacagatgggtttttggtgtggatgtcctttctgtttgttagttttccttctaaaagtcaggaccctcagctgcaggtctgttggagtttgctggaggtccactccagaccctgtttgcctgggtatcagcagtggtggttccagaacagcggatattggtgaactgcaaatgttgctgcctgatcgttcctctggaagttttgtctcagaggagtacccggctgtatgaggtgtcagtctgcccctactggggggtgcctccgaattaggctactcaggggtcagggacccacttgaggaggcagtctgcccattctcagatctctagctgcatgctgggagaaccactactctcttcaaagctgtcagacagggatatttaagtctgcagaggttactgctgtcttttgtttgtctgtgccctgcccccagcggtggagcctacagaggcaggcagtcctccttgagctgtggtgggctccacccagttagaacttcccagctgctttgtttacctactcaagcttgggcaatggcggccgcccctcccccagcctcattgctgccttgcagcgtgatctcaaactgctgtgctagcaatgagtgaggctccgtgggcataggaccctccaagccaggtgcgggatataatctcctggtgtgccgtttgttgagcccgttggaaaagcgcagtattagggtgggagtgacctgattttccaggtgccgtctgtcacccctttctttgactagaaaagggaattccctgaccccttgcgcttcccgggtgaggggatgcctcgtcctgcttcggctcacgcacggtgagctgcacccactctcctgcccccactgtccggcactccccagtgagatgaacccggtacctcagttggaaatgcagaaatcacccatcttctcgtcgctcatgctgggagctgtaggctggagctgttcctattcagccatcttggctcccccaacttaattttcatgtatgctccattcatagggaactgcctgtggttccttgaaatcaatgttttctcatctttcgaggctttttcccagaacaccctttctctaatttttttccttgcatttgttgtaagcagaatggccctccaaagatatccaggctctaatctctggaatctgtggatatgctgcattacacagcaaaagggactttgcagatgtaattaaggttaaagtcttcaaagtaagggagattatcctggattttccatatgggcccaatttaatcacatgaagccttaaaggcatagagctttctctggttggagtcagagagatgtggctggagaaatcagatttgaagtgtgagagaaactcaaatctgtttctgaaattgagaggcacatggaaatcatgagaaggaacaaaagtagcctctaggagcaaagactggcctctgactgacagcgagggaatgagggacttcagtactaaaacttcaagggactagatttggtgaacaacctaaaatgagcttggaagtagattcttcccagaactctagaaaggaatgcagctgctggacaacttgattttgatcttgtgaggctcatagcataggaaccatccaaaccatactgtaggcagacttttaacataaagaactgtgagataataaatggatgttattttaaggcacaaattttgtggaaattgttatggcagccattgaaaatgaatgcatcatcctttaacactcagctccaaagtcatgcttctgggaaggctttcttaatcacagcagccaataattattgttcagtagggcttaggagcagtgtggtggccatagccactggagatgcaaataaatactaaaaggagactgaagggttagaaggaaatatcaataatagacaagctgattcatcctagaggactttggagaaggtcagaaattgcaggcattaagttctgccccactaatggaatataacttccaatgcactgtctagttcactcttaagcaggaatggatagccaaagatcaccagttatttgaaggaaaactccaatttgaaaaagagagaccaaaacaaagatgaagaaagaaaacaaatataaacaatgttaggtgtggccgacaaatacgtgaagaaaagctcatcatctctaatcattacataaatgcgaatcagaaccccaatgagacagcatcttatatcagtcagaatggctattaaagtgtcaaaaaacaacagatgctggcaaagttgcagagaataggaaaacttatacactggtagtgtgaatgtaaattagttcagccactgtggaaagcagcatggagatttctcaaagcagtgtggagatttctgtttaaaacaaaactgtcattcaacccagaaatcccattactgtgtgtatagccaaaggaaaataaatcattctaccaaaaagacacatgtacatgtatgttcactgcaatactactcaccatagcaaagacatggaatcatcctaggtgtccatcaacagtggattggataaagaaaatgtgccacataaataatagacacatagaacaatggaacaggatggagagcccagaaaatatgccacacacctacaacaatctgatatttggcaaagctgacaaaaacaagcaatggggaaagaactccctattcaataaatggtgctggggtaactgactagctatatgcagataattgaaactggacccccttccttacaccatacacaaaaatcaacttgaaatggattaaagacttaaatgtaaaacctaaaaatataaaaatcctggaagaccatctagaaagtaccattctggacataggaactggcaaagatttcatgacgaaaatgccaagaacaattgcaataaaagcaaaaattgacaagtggaatctaattaaactaaacagcttctgcacagcaaaagaaactatcaacagaataaacagacaatctacagagtaggagaaaatatttgcaaactgtccatctgacaaaggtataatatccagaatctgaaaggaatttaaacaaatttgtaagcaaaaaacaaacgaccccactaaaaagtaggcaaaggacatgaacagacacttttcaaaagaagacatacatatggccaacaagcatatgacaaaatgctcaacatcattaatcattagagaaatgcaaatcaaaaccacagtaagataccatctcacatcagtcaaatggttattattaaaaaataaataacatgctggcgagttgcagagaaaaggaaacacttatacactcttggcaggagtgtaaattaattcagccattgtggaaagcaatgtggtgattcctcaaagagctaaagacagaactgccattcaacccagcaatccctttattggcatatacccaaaggaatataaatctaccataaagacacatgcacatgtatgttcattgcaatactattcacaataacaatgacatggaatcaacttaaataccaataaatggtagattggatagagaaaatgtggtacatatacaccatggaatactacagagccataaaaaggaatgagatcatgcctttacagcaacatagatggagctggagaccattatccttagcaaactaatggaagaacagaaaaccaaatactacatgttctcacttgtaaaggggagcccaataatgagaacatatgaacatgaagaggggaacaaaagacactgcagcctacttgaggacggagggtgggaggagggagaggatcagaaaaaatacctgttgaatacgtggcttagaacctgagtgatgaaataaactgtacaccaaactcctgtaacacacaagttcatctatataacaaacctgcacatgtaaccctcaacctaaaataaaagttaaaagaaaaaaagaagaaaatatggtacatatacaccacggaatactatgcagccatgaaaagaatgaaatcatgtcttttgcagcaacatggttgcagatggaggccattatcctaagcgaattaacgcaggaatagaaaaccaaataccatgagttctcacttataagtgggaactaaacactgaatacacatggacacaaagatgggaacaatagacactggggactgtttggtgggggagaggaggaggggagtatgagatgcaaagccacctattgggtactatgctcagtacctgggtgatgagatcatttgtacaccaagcctcagtaacatgcaatttacccatttaacaaataggcaaataaatgtaccctccagaacctaaagcaaaaggagaaaaaagcctgtaatcccagcactttgggaggctgaggcaggaggatcacctgagctcaggagtttgagaccagtctgggcaacatagggagaccccatctatacaaaaaattaaaacttagccaggcatggtggtgcatgcctgtagtcccaggaggctgaggtgggaggattgcctgaatcctgccagtcgagactgcagtgatacatgatagtgccactgccctccaacttggacaacagagtgagacctcatctctaaaaataaaaggaaaaagttctgagaaagtgattattttcacccatgaattttatcctcagctaagctatcaatcaaatcagagggtagaataaaaacattttcagatatgcaaagtctcaaaaatgttacctaccatgcatccttattcaggaggtggtgctcaaccaaaacaacgatggaaaccatgggagagattcacaaaacagggtgctatccaggagacttgggacaggaatgtgcaagacgacagctgtgcagcaagctcagaaagcaaacagttcagactggagcagaccagagggcccaaagggggacatttctaggggaaatccccctaaacccaaacaaacaaaacaatagccaaacagagaatctaaaagctttgcttatgtgaccatgtgaacattttgctgaggcatttgacaagactgttggcaagtataggaagatttggttacaggttcaaataaactatgcaaaggaaaaagtgaatcgtgtaaattatttacttttattttattttacttttagaaacagagtctcactctatcactcaggctggagtgtagtggtgcgattatagctcactgtaaccttgtattcctgggttcaagtgatccttccacctcagcttccctagtagctgggagtacaggcatgccccaccacactggctaattaaaaaaaaaaatgttgtgtatgtggagacagggtcccgctatgctgcccaggctggtctcaaactcctggtctcaagtgatccttctgcttctgccttccaaagtgctgggattatgggcatgagccacggtgcccagccagtcattatcttttttaaaaacagaaatggtacaaaaaatgttatcacagtatacttcttggttcagtagtgaacaatattagcatagtcataatgatgcaaattttaaaatgtgatatataactctattggtagaacagagaaggggaggggatttgtaagcaaattgactcctcatctaccattacaagatggcaatagattaattataatggatcaaaagacaacaatgcctgcttgttatttaacaatatgaaagtaaatgtcagaagaaacatttaaaaaattgaaagtaagatggggcaagtgtgagggcagagggagaacaaggagacaggagtcttgctttttgttatagcataaaccttttatactagggtaatataacattgtaattcagtatatattatttagttaaaaatcatgatcagtttgaaaaagagtcaatggtggttaaacataaggtagaggttatattcacccccattttctgaactgtctgctcccatacatcctgtggtttcctcctggccataattggagaggaaagagcctgaaaagctctttcacactgagatcttagtctactacaatccagcctgggcaacagagtgagactatgtttctaaaagtaaaaaaatatttatgaaataaaataaaataaaataaaataaaagtaaatgatttaccagattcattttttcctttgcatagtttatttgaacccatgaccctaggcacttaagggtctatcccttcaagaagagggtactggaggtaaaatctacaatttttttaaaaggagtttggagcaggtcaatgctaagcaagaaataatttctaaatatggatatacaggcatttgtacatgttctgaccaaaatggggtttggtggtttggttttaatgggtgggcaggtgacatactttctttctttcttttttttttttttttttgagacagagtcttgttctgtcacccaggctggagtgcagtggcgcaatctcggctcactgcaagctcctcctcccaggttcacgccattatcctgcctcagcctcccaagtagctgggactacaggtgcccaccatcacaccggctaattttttttttttttgtatttttagtggagacagggtttcaccgtgttagccaggatgatctccatctcctgacctcgtgatccgcctgtctcggcctcccaaagtgctgggattacaggcatgagccactgcgtctggccacaggtgacatactttctagtggggaagctttcactttgttctcaaatagagcaatgtaataaaaccaaacatttgtattgcatttataaagtactttcacctaggtcatcttatctgagtcccataaggccaaggtcatccagctaatgcatgaacaaagatggagcagcactaggatcccagaccggctgccagggatcccagcctctgtaccacttcattgaagtgccctcactgtccttagaagaatcactcagccagcaaactagtgatgcacatgccccagctcctcccagtatccctccaccaacttgccctgctcactgcctcttttctttctaagccctaaacaaaagtaagcaaaggaaaggcagggacatcagaaaaaggaaggcaaacagatgaggttaggtggagaagcagagaaggtaaagtaatccccaggtccctttctgcttggtgactggaatcacaaacatggcacctgtgtacactcaacgctcatctcatcagattcacagacctgaatccttttcactgctaacactcaaggcagaagaagataggcattaaggatcacgtgtactgacagaaacacacaaggaagggcataatcattgccccttgatagcaaaccaaccaaagtgcaaatgtagtagtcttctcacagagtgtatcagccttcccagcaagaaactaaaaattccatgcagggtctgccccatcagggattctctgattgccttcaaccacacacctggcaagttggaggtcatcctgaacaatgtcccaatcagcatctcaagaaaacctgccaatcctagcctggagcctgggaagtttccccactatgggaatattgggagaaactgagcttgagaggtgaaaagaaatgagtgatgagaactttgctccaaagttctttaaggggtggcccctgggaatgcccagagacccactgttttggtcagccttgggaatctaatgtgttaatctttgccccactagtggctgcattttcacaagcaggcctccctgtcaagctagggcagagactgatggtgcctgaagcctgaacagtagggatgtccctgctgcatttcttcttttccccaatagcttatccctccccgtgttccactttgtgaccaatggaggaggccatggatcccagattactccttccctccatcttgagaaaacaaagggatcaatggaaacaaatacattgaagcgttaagaagaatctcagaagccttgcattttaacagaggcatgagagagcaaatctttacccagaactcaggacaatgacagcctatggctgccctcaaacctatagaaattgagagctagcagaaccactggaaatcacctgtctgcatcctcattttacagaaggcgaaactgaggtccacatagctgaagggatttgctcatcatccttaaggagttagtggcagagaaccaaattcccttgccagcaggccaagattctttgcagttaaccacaccatctttaactcatagttcaaaacaaattccttagaaacaaactgttggagaacagttcattcataagacagggtttggtagcaatgtacacttttctgtcttctatgtagaaacgaactcttggagaccagttcattcataaggcagagcttgatagcactgtatatttttctgtcttctatgtaaactatcaggaagttcattcattaagtaaagtagtaagtgaatgtgtagtatcagatatggggaattggccgggcctggtggctcatgcctgtaatccgagcactttaggaggccaagtttgggtggatcacttgaggctaggggtgtgagaccagcctggccaacatggcaaaaccctgtctctactaaaaatacaaaaattagctgggcttggtggcagacgcctgtaatcccagcttcttgggaggctgaggcacaagaattgcttgaacccgggaggcagaagttgcagtgagctgagattgtgtcactgcactccagcctgggctacagagcaagactctgtctcaaaaaaataaaaataaatttaaaaaaagatacggggaattcagagaccttggaggagttcataatctaatggaggagaaaatgtagaaaggatgattaaaatgcagtgtgattattgttggataaggtgataaatcagagttgttgagattctgtaagtgcatggaggaggggcacctcatcctatctgaagaagacgtcatagaaggtttttcagagtagctggtgtccaaatcaagtcctaaaagtgatgggacaagaataatgaacaattcagatagggtataactgtaaagaaactcactctccagttaggaggatagataaataaaaaccctctgtgctaagggctggcagaaaggtaaactcagggatctttgggaacacagaaaaggaattactattggacataggggcagggaatggggtggccgggtcacctttacaatggtgatgacgcctgagtttggtcttcattagcactgaccaaggtggcttgatagaaggctgaagacagactatgggcccgagtatacagaaaactatcccctgtgttatgagtgaaggacaacatactgtgtattagggttcagactaaatttctgttaatagagattcaaacaggatagaaatttctctttgtctcatgcaacaaatagagggagaacaggtaggctgctttgctccaaacgatcttccagagatcttttactaccttttgtagtgccatcatcacctagaatattgtcctagtctgcacagtcaaaactagttcattaccactatgttagtgttttagcctctagggggaaaggggaaaaaaagaagtgcaggacaaaacatttccttttaaggaagcaactcagaggttgcaggcatcactttcacatatgaacacagtgacatgaccacacatagctgcaagggaggttgggaaaagtagtctctattctagccaggttccttactaagtcttagggatttatgttactaaaagaaataaatagaaggaatggacagtgggtggtggggggaagtaacagtatctaacacatgctaatttgtttccccatgtacagggaaaggcagttttagagaggaaatagttaaatgatagactgcagagggtcttagccatggacagttaaagagttgcagtgtctcaaggttgctggtttgggtaatggacaagctaagagtatgtccaagcgttctgaattggcgacccccccaaaaacttagcaggccaggacaaaaagatacaatccttgataggagtgtcccagatagagttactgctgtctttaagctgtgttgctcaggcctctactcaattctactttgcctgacttgaagatgtcaggctagtctctctgcctgttctttaggaagaacatcttcaccagatagagaagtctgacagggctatctaaatatttctgaaccggtccagatcattgctgtcattctctgaggttggcatgccaagtcctcagcatcagtacaaagacattgctgtacactcacaaccagatagaagcagaggcttgaacaggatcagtccactgagatgaggtataaagcaggggcaggcatagcttcaagcaagtgatcagcacttcttggcttgtaggtggccatcttcaaccagtgctttcacatggtcttccctatgtatctgcctgtatccaagcccccaagcactggaagaggtctgagacctcctggactacagggaacaaggagtcagggtggggaccagagcaggtgcagaggattatgagctatgatattcaggtaaggaagaagggaaggtgactcaaggagcagtaatcccagggcttaagctttatctcagaatgcaggaaagaaagagggtatgcttctatctcagaagacaacttttcccaaaccatgttacttccattgtcctctactctgtgctcaaattagaaaattgagtatcatcctagacttgttcctcatcatcttaacatatcctatttataagtaccaaatgctatctattctatcttctaattttctcttgaaacaattcagttacctccagcccttctaccattactttgtccaattttccaaagccctcctctcctggattactgcaacagctttctcactggcctgcctgactccactcttgctgccctccaacccatctgtcatgtgctaaattgtgccaccttccccaaaatccatgtgttgaagtcctaactcatgatagctcagaatgtgactgtatttaaagatagagtctttagagaggtaactaagttaaaataatgtcattaggatgggcccaaatccaatatgatggtgtccttacaagagaaaatttagatacaggcagatacatagggaagaccgtgtgaaggcactggttgaagatggccacctacaagccaagaagggaggcctcagaagaaaagagcaccaataccttggtgtcaaacttccaggctccataattgtgagaaaataaatttctattatttaaaccactcacttgattttggggtactttgttatggaagctcaagaaaattaacacatcatcctttacactgcctacaaaatgactcattaattacaaagttgatcatgtcactcctctggttaaaactgagacaaatgggacaaatgggattccatcaaactaaaaagctcctgcacagcaaaggaaacaatcaacagagtcaaacgacaacccacacaatgggagaaaatatttgcaaactatacacctgataagaggttaatatccaaaataaataaggagctcaaacaactcaacagcaagaaaacaaataacccaataaaaatgggcaacagacctgaacaaacatttctcaaaagaagacatacaaatggctaataggcatatgaaaaaatatgtcaacattgctaaccatcaaggaaatgctaatcaaaaccacaaataaaatattacctcataccttttagaatggctattattgaaaagatatagaataagtgttggagaggatgtagagaaaagagaattgttgtgcactgttggtggagatgccaattggtacacccattatgtaaaacagtatagaaggtcttcaaaaaattaaaagtagaactacaatgtgatccagcaatcccactactggatatatatccaaaggaaataaaatcagtatgttgaagagatacctacactcccatgttcattgcaacagtattcataatggtcaagatatagaatgaacctaagtgctgatcgaagaatgaatggataaagaaaatgtggtgtacacacacacacacacaatggaatactattcagtatttaaagcagggaatttgcaacaacatagatgagcctggaagtcattgtgttaaattaaattagctaggcagagaaaaacaaactacatgatcttgcttacatgggaaattgaaaaaagtcaaactcatagaagcagagagtagaatgatggttgtcgggggctgggggttagagatattggtcaaacaatacaaagtgtcagttatgcagactgaataagttctgcagatctaattatgtcatagtgagtacagttaataatactgtattatatacttgaatatgctaagtgagtatattgtaaatgttcttactgcaaaaaaaaaaaaaaaacatacatgctgtggctcatgcctgtaatcccagccatttgggaggctgaggcaggaggatcactgaagcccaggagttcgagaccagcctaggcaacatggtgaaaccccgtctccataaaaaataaaaaatgaggcaggaggattgcttgagcccaggaggtcgaggctgcagtgagctgtaatagcaccactgcactccagcctgggtgacagagcaagcaagaccctgcctcaaaaaaaaaaaaaaaaaaaaaaagacatacaataaaataattaactctatgaggtgatgaatatgttaattagcttcattgtggtaatcatttcacaagatatacatataccaaaaataactcaatcagcctggtacagtggctcttgcctgtaatcccagcactttaggagtctgagatgggaggatcacttgaggccaggagtttgagaccaacctggtcaacatagtgagaccctatcccttaaaaataaaagaaaaaagaaactcaataaagctgaaaaaagaaacttaaagctataagaaagctccccctaaagctccctcaatgggcttctgctttcagtcctactaagaataactagaaaatggttgtttaaaatttttaaaagtctctgtaaaggcatagaaagctgctgaagcaatcagcattggaggggccaagatttcaaagaaggttgaaccactgaaaggagagctacattttccccgtgggctttggcaagtttggggtgtatagttagagattgagaatctgggctttggccagacagagggccactgctggggaatacgggaaaaacagaacttttgatggttattgagggctgggttgagaggccaagaccccagtgaaagggaaaggaaaaaaaaaagaatatgacacatgtcgagtgttttttgatgagactaagaagctaagcaggaagcctcgagaaacagtagcattttgggcagtctcactatgctgagtaatgtaaggatttgattttaatatctgccaggaataagagccccattgaacacacaagattatcagatgatagctctgaaaggtaatgccttaggagcagggaccaggggctttaccaacattgaacctgaccttgattcagcttagtcactgatttggtaaaggtgatctgcccctacttgatctgcctaacagagaaaacagtaaattctctctgagggaagatagcatcatctggagccttttaaattatttatacacaattggatggcattcattgaaaactttctaggaaatataagagatgaggccatatgactgaaaacctagaaggaaaaaaacagacaataggaaaaaacccatgggtgatccgaatatataagttagcagacaatgcatttctaacaactatatattcagataatagaggaaagatggtgaaaagaaatataaaaaaggaaaatttaatccaataattggaatctataagtaatcaaatagaaattctaaagttagaaaaaaaccctaaaatctcaatagatgtgtttaatggatgattgtacacaacagaatagaggattagtaaactagaagacacgttagagtaaagtatttaaactgaagcacatagagaattaactaatagaaaagtaagagtataatagacaggtgagatataaataaaaggtttaacatagttttaattggagttccagaataaaaagggaggaagggaaaatgagcagtgacgatatatgaagacaccgtgaattttccaaatctgatgaaaggcatcaactcacagattcaagaaggtctgtcaaccccaagaaggataagtgcaaagaaaatacacctaggcccatcataataagacttttgtaaacaaagaaaaggagaaaaatcataaaggcatccaggagaaaagaaacattgtagttggctgaataatggccacccaataatatcagatcctaatcctggaacatgtgagtgttaccttataaggtaagagtttttgcagatatgattatgttaaggatctgaaaaatggagaaattgttctgaattatctaggtgggtcccaaatccaatcacaagtgtccttataaaagggaggcagaaggagatttctcatacacacaacaaaacaacaacaacaacaacacacacacacacacacgagaaggtgatgtgatgacagaggcagtgaatggagtgatgcagctgcaagcaaaagaactccaaggcattctggcagtcagcggaagatagaagagacaaagaacggattctcctttagagtttccagagggagaataaagttgccaacatcatttatacagacttctggcatacaaaactgtgagagaatacatttctgttgttttaggcccccaagttgtagtaatttggtacagcaaccacaggaaactaatacaataatgacaagaatgacatttgatttaacagcaattttggaagataaagaatagaatcctcacaaccatcctatgaaatgaatcctccaccatttccgcattaagtttagaaaactgaggctcggagactcaagtgacttatccaaggatcacatggcggagacgggattcaaggtcaggcccgtcttattcaaaatactatttttttttaaacgtactcaccatcgtatatagcttttcatactccttggcatggtatataatccttctgggtttggttccttcctgcctcttctgtcttatctctcaccacatcttctttcagactctgtagcctatcattgctgaactccctgggattcctggtgtctttgctctctgcttggaattttctttccataccctacttccacacaccatcacttggctaactccaacttgttcttggaattcagcttaaatgagaactttcactcagaacgcctttctctatgcttcaagatttagttagatgtctctctgtcctcccacaatctcctattttcatctttatcacaatgccaatcttccttattagactggaagctccttgaggccaggggtcatgcccagaatgatacttggtacagagtgggcactcagtaattgctgaatgagtgatacatggcttttcagaattgtggtggtggaaagcactgagttttaagccacatttgtctgataattagaataagggtaaatttgtagttggagggatatttggaacagcatgaggtatgtctgggataggtggtgattttaccttattactttccccttgtgtcacaagcctccatggagcttgctctagtttcttcaggtggttaggtagaacatgctcccatcctggtcctgttacaggcgcacagagaatttaaatttaattttttttaaatcctaagttatgaagaactcttgggttgaattatcacttggtgcccaataccatgcagactcattactctcccttccagttgtacatacgtgactgcaaactccaaatattgtgaccatagttttcccgctaaatttggacagttggttggggtcagcttccaaagctcatatatgtgtcagagatacaaagacataagaagtgattataaaatacaggatcgggaaaaagttaaataaacctttgctggtactccaaacctgagtttcttcagccaaaactacagtaggaaagataatgtggttccttgaggaagtgccacaggcagtagaatgttagagcaagtagaatatcaggttgctcttttcaatacctagtctccacagatggccctcaataagccactcttcctgctctttgcaacctagtgttgtctctctccacattgactctagggtggcctgcgactgtcaataacaaatataatgcaacagaaatgaagttgtgagagttctaatcctattatttaagaggactgacagttttcactccctgtcttttatgacaggggtccccaaccccaggccatagactcagggtgagccatgggcaggcaagcattgccacctgagctttgcgttctgtcagatcagtgggcagcattagattctcatacgagcttgaaccctattgtgaactgcacatgtgagggatctagtaggttgtgtgcttttccttttttttttttttttttttttgagatggagtcttgctctgtcacccaggctggagtgcagtggcataatctcagctcattgaaacctctgcctcctgggttcaagtgattcttctgcctcaccctcccgaggagctgggactacaggcatgcgccaccacacctggctaatttttgtatttttagtagagatggggtttcaccatattggccaggctagtctcgaactcctgacctcatgatgcatctgcctcggcctcccaaagtgctgggattacaggcatgagccaccaggcccagctggttgtatgctctttatgagaatctaactaatgcctgatgatctcaggtgaaacagtttcatcccaaaaccatccccccaaccccccctccccctaccccatgccatggaaaaattgtcttccacaaaacgggtccctggtgccaaaaaggttggggactactgttcctttcttggcaccagggaccccggttttgtggaagacacttagacaatttttcaatggacaggatggagtgagggtggggatggtttcaggataaaactgttccacctcagatcatcaggtattagattgtcataagcagcgagcaacctagatccctcacatgtgcggttcacaatagttcacaataggactggtgctcctgtgagaatctaatgctgctactgatctgacaggaggcagagctcaggctttaatgctcactggcctgctgctcatgtcctgctgtgctgcctggtttctaagaggccatggactggtatgggtcagcagctcgggggttggggacccctgttttagaacacttgctttgggaagccctgaaagaattctggttcccctgctggagagaccatgtcaagaggagagctcctgagactatatgtaaataaagagagggccagccatctcagattcccagttgagcctctggatgactccaactgccatctaactacactgcctgagtgagatcagcagaagaaatttctggctgagcccagtcaatccacagaatagtgaaacaaaacagatttatgtttagccattaaattttggagtagtttgctaggtgacaatagatcatagaaacactctttttcatgactgcctcataccctacactatgagatagggtaacagaaatctgatttccaaactttcctgaacccacaggccagctttacttgtcagaaacctgttcatctctccatggaaaagacatagctcctgaatcatccacacttctgtgtgaagcaagcctcagtacatcttcctaaaagatagtattccaagtctcttgagttgtgcatgaaaagcttcagtcccagaccttgacatttctggtatcaaaaagcaggtgtgaaaactctttggatgactcataatcaatcatccaaatgggtggcctcctccctctacgtgcctgcctgtccagaagcagataactgctcaatggtattgcctttctagggaaccatatccacccaccaccatcataaacccttagaagtcttggtttcactcaaaaattctcacatatgaatacatgatgtcatcctgaggtttgcatcagactgagttcagattgcatatttttccacaagcatcattctgctgcaaagttagaagatgtattgctgctggctttatttacttatttttgtttccttgacaagagttctgcttcaacaggtcctgtgaaaacattaatttatggctataataatttcgaataatattctggagatagctggtaggcatattatccaagaagaccacttttatatagtgaccttccttgcattgttttatttagaatgcacatctttatttttataaatacagccaactcaattatctaggttaccgaaagggcaaagtggtgcaaataatctaaaacgctggggcgaaggtcatttgtatttgttttgcgaatgtattatagtttatttttccagcagcagcaggtgttcctaattatggttttctttaggctaatactggaattagctgacacactctgagtgtgtgtgtatatatatatatagaatatgatatataaaaaacatgttgggtaactgagcagggagaaccgacccaagactcaagctgtttgatgtacaatttgcctgcaaagtcttaatttttttttttttggtaacttacctgtcagatttcacacattaaatgagaactgttcctcaccttgatgggctgcataccaactctaaagacgccataatttttctgacattctcaaaatttctatttgtgatttacctccttttcctcagtcatgggagaatctgggcttctgtatcagcctgttcattgcaacgtctgtccctgaaggactttgggggctgggaggaatgcactgggatcagaatgagactgcagggcttcagccaccatctgtatctttgactcccaaattcatatccctagcccagacctccctcctgaactcaagtggtgtatacatcttcctatttatctcccccagaatgttccacaggaccttcagctgaactcctcttccttactcctttcagaatctccacctcctcctatgttcattacatcagtggctggtaccattatccatccagtcctcaaactatgaattcaggaatcattcttgccttctccgtctccattcttcctcacattcttcagttcttgctgattttactcccttattttcgcttgtgtctgcttacctgtttccatcctcacttccactcagaccaaacacctatcacctcgtctgttccactaaaacattttttttttttttgtagcccaggctggagtgcagtggcacgatctcagctcactgcaatctctgcctcctaggttcaagcaattctcgtgcctcagtctccagagtagctagggctacaggtgtacatcaccatgcccagataatttttgtatttttagtaaagaggggggtttcaccatgttagccaggctggtctcgaactcctggcctcaagctatctgcccacctcggactcccaaattgctgggattacgggcgtgagccactgcgcccggcctcattcagacacttcataacttgctttcttgcatcaaatcttgctccctgcccccatctatcctccacagagcaaagacacagaagggttgttctgatacctatatctcaagtcactcctgtgcttaaaatcccgaatgtcttctcattgcccttaaggtaaagtgcaaaactgttacctagcctacaaaagtcctgctcaaatatgacccctgccaacagttatgtctcttttcccttgggtctccccactttcctcccttgcttctccccacctcaaccatgctctagttttttctgtcttagcacatgccaggctctctagtctctgggcctttgtggggagctttccctctacagtttcctttcactttcctcttcatctggctaaatcctcctcattcttcagatctggataaaagtgtcaccagctcagaacaattttctctgaccaccccccagacttttaggtctctgtttcatgctctcctagtaccccggacttctttgtagcactcctcagactgtaagtaccacaaggggtcaggacaggcatgtattaattccctgctcaagttgttagcactgtggtggaaacggaataggagatcaataaatattttctaggccaggcacagtggctcatgcctgtaatcccagcactttgggaggctgaggtgagtggatcacctgaggtcaggagttcaagactagcctggccaacacagtgaaaccccatctctactaaaaatacaaaatttagctgggcgtggtggtgggcccctgtaatcccagctactggggaggccgaggctggagaatcacttgaacccagaagggagaggttgcagtgagccaagatcacaccactgcactccagcctgggccacagagtgagactctttctcaaaaataaataaataaatattttctaaatggccgactaaacaatgacctcctaattggtctgccttccttcagggtcttccctcctgacctattttatccactctcagcagagcgatctctaggcctagaatctaaggtacagccccaatcaaatcactttggagcttaaagaaaagtcagttcttgccctcacctaccaaatgaagtctgaaggcttttgtatgacatgacattaaggtgttctgtaatctggtcctaaactacctgaccaaccttatttgtccatcttgttttctgcttagaagaaactccagattctagtcaaatagaattgcatgctatttcctgccagtgcttcacgttttctagcctttgtgcctttacttctggtgatccatcctcctggcaagccctcactgcatttctgcctaagtcccatctctccttcatgatcctccttaaaagtaatgtcctctctgaagcttttgcaattccccctggcagctgaaaatgacccctgctccctctgaacatcccagccctttctacctccctgtggcatcgatcctattatgtgcacgcaaggctcattctctactagactgcaaaccacaagggagaagagcttggtcatttctgtatgactgacaggacttgggcaacactagaggttagggacctgtttggaggcctaccataagttttataactttgtacacaaagtgttttctaaggaccagctgcttagatatcacctgggggcttggtagtaatttacaatcttgagcctaccagatttagcaaatcagaatctgcattttaacaagatccccaggtgatccacatgcacattaaaatttaagaagcagtgcactgttttattacacaaggtaagagcatccgtaaaagaggataaacaccacatcttgtaattctgtgctctcagacatggtatcaactttcatatcagccgcacagtgtgtgtttctctgcttttgaatcaccagcccaatttccttcctgctcttagtttggaaccttccccttcttcaaaaacatggaaggatccctgtcttggtcaagggaaccctttctcctatgagaaagctgtggatgcacaaagctggccccaatcagaaagggaggttatgattccttacagcttgccataatttatgtagtctctggccaaggtgtgagtcaagcctcgtgtcctctgttaaacatcagtgcaagaatgccacggaatgatgtcaagtgagcttttgagctaaccactcctagaaacatctggcgctggcagaggatcatgactatgaatacagaggaagggaacacttgagcaatttgaattaatcacagttttaagtgtcttgtacaaaatgtttttatgttttgatctaaataggcaaacaactaagcaatgctttcctaggttttagaagagaggtaaagatcccattgaaatgacttttttccctctgcactttctctttcctcacatcattcgaacaagaataaccttctcttcttccctagggctcccttaattattaacacagctgtgcatggtgttcagcgcccaccttgtctgtagatgctgataggtcctgtaaaacatattatctcgcttctttacagtacactgcagagaaacttgataattggaaaaaccctcaagttcaggcaaagcagctaaaactagaagtggcagaacctgctgcttttgcctcaggcatatatttgctgctaaatcactgctcctaaaaactcctctcatttgagctccttggcttctaatcagaaccacacccagagtgagacaggagtggtttcagactagcttctgtctgacactgggaaagaaaaataaaactgtctttctgccactgaagtaacagaaaaataagggcttgctggcaacctccgtgtcacaggcctctgactgcatttaatcagaaatgtctattgttgaattgagctttgctggccaaagaaataactgttttgaattagaaactgaaagatgatgaacaggccactgatggaagctattcttcccctgagaaagttgtccctagacgagattgtgaaatagacgcatttcacattttctcttaaactgtctctccatttgctgggtgtatcagttagggttctctagagaaacagaatcaataggatatatataaagtgggggagggaagggagaaagagaaggagagagattgatttagagttggctcatatgattttgggaattggcaaattcaaaatttgtagggcagaccaggagctgcaaactcaggcaagagttgaaatcacgattttgagttagaaattctagggcaggccagcaggctagaaactcaggcaagatttctatgttacagacttgaggcagaatttcttctacagtataccaagacaattctggcatttcaacttcatttcgtatgggccacattttattcaaagtttcatgcaaccggtcaaactactagactgggctagggtcaactggtcttactgactgaaggctatgcaggttcaaaattgttggtctggaccataaggaaacatggtagggctccctgtgaaattagaaagccaggaaggtttaaaagacaggggtatttgtctgaccactctaacttgcacagaaggagtctctgtggccatgtcaagagagccaaactctcagatatcacatccttcaggagacgtccatgataggcagtgactcaagaactactctaaggccttactttgccttttaagccaagacagtttggccctccctgttctgtactgccctatcctgactgactggccatcccctctgaattagaagagtacttactggtcttttcttcaatgcctgccgcttgtctgaagcacagtgaccccacatcctctctcccagccacatgcctttgttggccttctggtcatccagcattctgcattgcagtgtcctggacaggcttaccctctccctgctcccaaataagcttgttctacccttccatgtgttcaaaccttgttgccagctcatggagcactggatatctctttgacaaagtggagaggcaacatggtatgaataactgataatctacttatatttatttattcaatcaacaaataggtactttagtgtatcaggccttgtgctagaggctgggaagaaataagtaaatctgacatagttcttgcccacaatgtactcatcatctagttaaggagacagacaagcagttgaacacaaacaattgccatacagtgtaagaagaataatggtagaggtatgttttgagaacagttgtagcagagagaaaaagtgagtaacgcttcatggcctgggagagtggagaggatttcagctgcttcctgagaagtaagtagtagttcaccaagtaaacaaggcaaatgaaacatgccagagtgaggtaacagcaggagcagaggcacagttgtgtactcatacacagcttattggaataatggagacaagtcaatctagtatggctacatatgacatggtgcatgccagggattggacatttatgtaggagtaaagctctggtgttccgggcaactaaccttgtacttaatgctaagggcaacagaaagctatggaagttttttcttttcttcttcttttgtactaacagctttactgaagtataatccacattccatacaattcacataaagtatacaattcatggttttaagtatactcacaaagttctgccattatcaccactgtctaattccagaacattgtcatcactccaaaaataagccttatacagtcactcctcaacttacgatagggttacatcctcaacccactataagttgaaaatttcataagttgaaaatgcgtttaatatacctaacctactgaacatcatagcttagcctagccaaccttaaacatgttcagaatactcacattagcctacagctgggcaaaattatctaataccatgcctattttataataaagtattgaatattgcatgtaatttattgaacacgatactgaaagtaaaaaacagagtggtcgtattggtgctcaaagaatggtgtctattgaatgtgaatctctattgcactgttgtgaagttgaaaaataataagtcaaaccatcataagttggaaactatctgtactaattaccatccaccccccatacccattaccttccagccactggcaactactaatctatttatacatttatatatttgccaattatggacatttcatatgaatggcatcaaacaatgtgtgatcttttgtgactggcttctttcatttagcatgttttcaaggttcatccatgttgtagtatgtatcagtactctatcccttttcatgcccaaatgatattccattgtatggatgtacaacatttcatttatccattttatcagctgatggaaatttggttgtttatactttttggctcttatgaataatgctgttataaacatttttacaattttttaatccatcccctcaagcatttatcctttgagttacaaacaatccaattacattctttaagttactttaaaagatacaattaagttattattgactataatcatcctatcgtgctatcaatattaagtcttatccattctttctatttattttgtatgcattaactatccccaccttgcccccagtctcccactacccttcccagcctctggtaaccatcctgctctttatgtacatgagttccattgttttgatttttagatcccacaaataaatgagaacatgcaatgtttgtcttcctgtgcctggataatttcacttcacttaatgatcttcagtttcatccatgttgttgcaaactattggatctcattctttttttatggctaaatagtactttattgtgcatatgtaccacattttctttatccattcatctgttgaaggacacttaggttgcttccaaatcttagctatcgtaaagagtgcagcaacagaggagtgcagatatctctttgatatactgatttcctttcttttgggtatatacccaaaagcagtgagattgccagatcgtatggtcgctcaatttttagttttatgaagaacctctaaactgttctccatactggttttactaatttgcattcccaccaacagtgtacaagggttcccttttctccacatccttgtcagcatttgttattgcctgtcttttggataaaagccattttaactctggtgaaatgatatctcagtatagttttgatttgcatttctctgatgatcagtgatgttgagcaatagagtaccttttcatatgcctgtttcccatttgtatatcttctttggagaaatttctattaaaatattttgcctattttttgaccagattattagattttttttcctggagagttgagtcccttatatattccggttattaatcccttgtcagatgggtagtttgcaaatattttctcccattctgtaggttgtctgttcactttgttgactgtatcctttgctgtgcagaaggtttttaacttgatgtgatcacatttgtccatgtttacttgtctgtgcgtgtgggcttactcaagaagtctttgcccagaccaatgtcctggagatttttccccaatgttttcttgtagtaatttcatagtttgaggtcttagagataagtctttaatccatttttatttgatttttgtatatggtgaaagataggggtctagtttcattcttttacatatggatatccagttttcccagcaccatttattgaagagattgtcttctccccagtgtatgttcttgacacctttgtcaaaaatgaattcactgtatgtgtgtggatttgtttctgcgttctctattctgttacattggtctatgtgccagtaccatgttgttttggttactatagctccatagcataatttgaagtcaggtaatgtgagtcctccaattttgtcctttttgcttaggctacctttggctattctggatcttttgtggttctatatacattttacaattgttttttctatgtctatggagagtattattggtattttgatacagtttgcattgaatctgtagattggtagtatggacattttaacaatattgatttttccaatccatgaacatggaatatttttccatttttggtgtcctcttcaaggtccttcaccagtgttttatagtttacattatagagatcttttacttctttggttaagtcctgggtatttaattttatgtgtgactattgtaaacgagattacttttttaaaaatgtcattgtcacattgttcactgttgtcatatagaaaggctactgatttttgtgtgttgattttctatcctgcaactttattgattttaacagctctaacagttctctttaaagtctttaggtttttgcaaatgtaaaatcatattaccagcaaacaaggataatttgacttcttcctttccaatttgggtgctctttatatctttctcttgtctgattgctctagctaggaatcccagtactatgcttaataacagtggtgaaagtgggcatccttatattccagatctgagtagaaaagctttcagtttttccccgttcagtgtaatactagctgtgggtctgtcatatatggcttttattatgttgaggtatgttccttctatccccagtttttttagggtttttatcatgaagggatgttgaattatatcatatgttttttcagcatcaattgaaattatcatatggtttttatccttcattctgttgatatgatgtatcacattgattgatttgtgtatgttgaaacatccttgcatcccagggataaatcctacttgatcatgatgaatgatctttataatgtattgctgagttcagtttgctactgttttgttgaggatttttgcatcgatattcatcagagatgttggcctttagttttctatttttgatgtgtctttggttttagtatcagggtaatactggcgttgtcgaatgagtgtggaaatattcccttctcctctattctttggaatagtttcagtagaattggtgttcgttcttctttaaatatttggcagaattcagcaatgaagccattgggtctcaggcttttctttactgggagactttttactagcactttgatatcattacttgttattggtctattcactttttggagatcctcctggttcaatcttggtaggttgtatgtatctaggaatttgtcaatttcttctagattttccaatgtactggcatatagttgctcatagttagccactaacaatcttttgaatttctgcagtatcagttgtaatgtctcccttttcatttctgattttgtttatttggattttctctcttatttttcttagtctggctgaaggtttgtctattttgtttaacttttcaaaaaaccaactttttgtttcattgaccttttgtatttttttatttcaattttatttatttttgctctgatttttattatttattttcttctactagttttgggtttggtttgctcttgcttttctagttctttaagatgcatcgttaaattgtttatttgaagttttttctcttttttaatgtaggcatttacagctatacatttccgagtattgcttttgctgtatcccataggtttcggtatgctgtgttttcattatcatttgtttcaagaaatatttcaatttccttcttaatttcttcattgacccactggtcattcagaagcatattgtttaatttgcatgtatttgtatagtttccaaaatcctcatttttaatttctagttttattccattgtggtcagaaaggatgcttgatattatttcatttttttaatgtttcaagacttgttttgtgtgatctaacgtatggtctatccttgaaaatgattcctatgctgaggaaaaaaaatgcatattctacagctcttaggtgaggtcatgttttcctggatggtgttgatgctagtagatgttcatcagtgtctgggctttgagggttaggtatttattgtaatcttcgctgtctggacttatttgtagcatccttcttgggaaggctttccatatagttgaaagacgtgggtgttgtgatctaagctgtatctgctttaggggacaccccaagcccagtaatgctgtggttcttgcagactcatggaagtactgccttgatggtcttggacgagatctgggagaattctctggattaccaggcagagactcttgttcttttcccttactttctccaaaacatacagactctctctgtctctctgttctagccatctaaagctggggctggagtcacacaagcacccctgtggttaccaacactgtgactgcactgggtcagacctgaagccaacgcagcactggatctcacccaaggcctgctgtaaccactccctggctactgcctatgtttgctcaaggccctggggctctacaatcagcaggtggcaaagtcagccaagcctgtgtccttcccttcagggcaacacagtcccccgagccccaggtgagtccagaagtgccatccaggagttatggactagagtcaaaaaccttagatgtctacctggtgttctattgtattgcagctgagttgaccctcaaaccaaaagacccagtccttcccactctttcctttcctttccaaaggcagaggagccccaccctgtagccagcatcaccccaggccatgaggagtactgccagagtagtgctgatgttcctttaaggccccaggtctctaaagtcaacttgtagtaaatgctgcctggcctgggactcacccttcagggcaatgggttcccctctggccaagggcaagtccagaaatgctgttcaaaagtcaagtcctggaattggggaccccaggagcccagttggtgatccacccccttgtggccatgctggtacctaaggtgtaagacaaagtccccattacttttccctctgcttttctcaagcagaaggagttttgtgccataaccaccacagctcattaggtgcacagtctcacctgaagacagcaagtctcagaggctcagccaaggcccttgatgtagtacctgggtgttgctcctggttgttcagggcccaagggctcttcagttagccagtgatgaatgctgctgggactgggtcctttccttcaaggcagcgggttccctcctggcccagggtgtgtctacaaatgttgcctggggactagggcctggaacggggtgagggggggtgcccttcttgacactggccagtgcccaatcctgctgtggctgagctggtatcttagatgtaagacaaagtcctccccactctttcctcccttctcaagcagaaggaaggggtctcttttggatcaatgacctgtgcagcttggggttaggggaggggtgatgccatcagtcccttggctgctccagctggtgtctcagtaggtcatgtgccccccagtccactgtctctgggcctaattcagcacgaggacttgcctaggagttgcagtcccttatggcctagactgtctttcaagtgtacttggagacacagtgctgtagccctgggtggtgaagtttgtaggcactcaagttcagacccacctgggatcaatgattcctctctggctagggctggtttaagtactccttccatgggtgggcaccagctgagtttggtttggttttcctttctgttctaacaggacagcactgaattcaatgattcacaattgctatgctctctcttccccagtgcccagagttgttctccgcaccacgctgctgctgctggggtgggggaggggtggcatcggctattcaggattgttttttctatctcttcagtgcctctttcagcgatatgaggttaaaaccaggtactatgagtgctcgccagatttcgccagatttttggtccttaggaaggtgttttttttttctgtgtagatagttgttaacttggtgtctttgcaagggagacaattggtggagttttctattctgccaccttgctctgccctttgcccatttttacaaacttttgagttgacatgttttcatttcttttgcatacatacctaggggtggtttttctgggtgatatgctaagtctatgtctttgaataagtaccaaactattttgcaaagtggctatacccttttacattcccaccagcagtgtaggagagttccaatttctccatatccttgccaatacttattatctttcttcttgattaaagccatcctattctagtgggtgtgatgtggcatgttgtccctttgatttgcattttcctgatgaatttgatgttgagcatcttttcatgtacttattagccatttatatatctttttggagaaatgtctatccagatactttgtccaacatttcattggattatttgtcttttacttattgagttatgagttctttatatattcttgatgcaagctcttatgagatatatgatttgcaaatttttctcccactctgtgatttgtcttttcagtttcttgatggcatcctttgaagcacaaaagtttttatttggatgaagtataatttatcaatttttaattttatggatagtgctttgggcattgcatccaagagctctgcccaatctgaagtcacaggattttttttcctatattatcttctaaaagttttatagctttagcccatacatttaggtctataatccattttgagttaattttttaatacggtgtgcattaataatctaaactcctctttttgcatgtggatatccaattctcctagaccatttgttgaaaagactattctttctgcactggcttgtgttaccatgtttgtcaaaaatcaattgaccataaatggactctcaattctatcccattgatctctttgtctttgtgacagtactaaactgtcctgatttctaagttttaaaacaagaagttttgccttttcaaagttgttttggctattctatatcctttgtatttctacgtaaattttgggatcagcttgtcaatttctacacaaaagcttactgtggctttgacaggacttgaattgacattatacatcaattttggataattgccgtcctgacaatattgagacttccaatccatgatcatggattctgtctcctttatttagatctttattttctctcagtaatgattataattttcagtgcacatatcttttgttagatttacctgtaagtatttcacatttttgatggtattgtaaatggcatttcaaaactttaatttctgagtgtttgttgctagtatatagacacaattgaattttgtatactggtcttgcatcctttgacttttcttttttttttattatactttaagttttagggtacatgtgcacaatgtgcaggtttactgcagcgctattcacaatagcaaagacttgggaccaagccaaatgtccaacaatgatagactggattaagaaaatgtggcacatatacaccatggaatactatgcagcatcctttgacttttctaaactacttattagttctttttttatggattccttggaattttctacatacagggtcatgtaatctgcaaataaatacatttttacttttttcttttcaatctggatgcattttatttatttacgtacttactacactggcaagaacttccaattaaatgttcctgaaggacattagaagtgctattccagtgaatacatgaaaaataagaaacagtcttattgctgatatggagaaagttttagtgatctggatagatcaatatagccacaacattatcttcagccaaaacccaatccagggtaaggccctaactaaattcaattccatgaaggctgtgagaggtaaggaagctgaacaagaaaagttggaagctagcagaggctgattcatgaggtttaaggagagaagtcatttccataacataaaagtgcaaggtgaagcagcaagttctgatggaagttgcagcaagttatccagaagatctacctaagataattgatgagggtggctatactaaacaacagaatatcagtgtagatgaaacagctttctattggaagaagatgccatataggagtttcataactagagtggagaagtcaatgcatggcttcaaagcttcaaaggacaggctgactctcttattaggggctaatgcagctgatgacttaaatttgaagccagtactcatttaacattccaaaaatcccatggccctcaaaaatcacctaaatctacctgtgctctataaatgaaacaacaaagcttggatgaaagcatgtctgtttacagcatggattactgactattttaagcccactgtttgagacttgttgctcagaaaaaagattacttcaaaatattgctactcattcacaatgtaccttttcacctaagagctctggtggagatatacaaggaggttaatgttttcatgactgctattataacatccactcggcagcacatggatcaaagagtaatagcaactttcaagtcttattatttaaaaaatacatttcataaacctattgccgccatagatacttattcatctgacggatctgggcaaagtaaatcaaaaacctctggaaaggattcaccattctagatgccattaagaatatgattcatgtgaggaggtcaaaattattaacattaacaagattttggaagaagttgagtccaaccttcagggatgattttaaggagctcaagatttcagtagaggaagtaactatagatgtggtagaaatagcaagagaactagaattagaagtggagcctgaacatgtgactgcatcgctgcaatctcatgataaaaatgcagcaaataggagttgcttcttatgaatgagcaaagaaagttgtttcttgagatggtacctattcctggtgaagatgctgtaaacattgttgaaatgacaacaaagattttagaatattccataaacttagttgataaagcagtagcagggtttgaaaagatggactccaattttgaaagaagttccactgtgagtaaaatgctatcaaatagctttgcatgctacagagaaatctttcatgaaaggaagcgtccatcaatgctgcaaacttccattgttgtcttctctgaagaaattgccacagccacccagccttcaacaaccacctccctaatcagtcagcagccatcaacattgaggccagatcttcctccagcaaaaagatgactacttgctgaaggctcagatgatccctaccattttgggcaataaagtatttttaaatcaaggtatgtacattgttttgtagacataatgctattgaatacttaatagactacagtatggtgttaacataacttttatttttaaggataacctaggatccaattgccatttatttcaagagtgccacacggacaggagacaactcaataaattattaaatacttgcactatttcagtatttgtatgtaattgtaaagataaatacattgtgtatgattcctctgcttctattttgtttgattttcctgataatccatcttgagcccagagaactgtacttgcatgtacttcctgtacttagcaaaaggaaagcattcaaaggaaggacagttaaggaaggaaattagtagatggtacttggcaagtatagtaaggaccaatttggaaggtccagctgaattttgaagattttgtttttaatttttttatttcaatagctttaggaatacacatgagttttggttacatggatgaattatatagtggtgaagtctagaattttagtgtacctgtcatctgagtattcaaatggtatacattgtactcaataggtagttttttctccctcactccactctcacccttcccccttctgagacgccaatgccagtataccactttgtatgcctttgcttatgcatagcttagctcccatttttaaatgagaacatgtggtattcgattttagattcctgagttagaataatggcctccagttccattcaagttgctgcaaagggcattattttgtgcttttcaaatggctgagtagtattccatggtgtatatatacagcattttctttatcaactcattggttgatggggacttaggttgattccatatctttgcaattgtgaattgtgctacaataaacacatgtgtgctggtgtctttttgatatagtgacttcttttcctttgggtaaatacccagtagtgggattgctggattgaatggtagatctacttttagttctttgagaaatctccatactgttatccatagaggttgtattaacttacattctgattagcagtgtataagtgatccttttttaccacatccacaccaaacttttttttttgtactttttaataatggccattctggctggagtaaggtggtctctcattgtggttttaatttgcatttccctgaagattagtggtgttcagcattgttttcatatgttttttggccatttgtatatttttctttggagaaatgtctattcatgtcctttgctgactttttaatgggactttttttgtttttttgaggttttcttttttgtaaattctggatattaattctttgttggatgcatagtttgcaaatattttctcccaatctctgggttatctgataatttttaaaaattttattattattatactttaagttttagggtacatgtgcacaacgtgcaggtttatttatttatttttattatactttaagttttagggtacatgtgcacaacgtgcaggtttgttacatatgtatacatgtgccatgttggtgtgctgcacccattaactcatcatttacattaggtatatctcctaatgcgttccctccccactcaccccaccccacaacaggccccagtgtgtgatgttccccttcctgtgtccaagtgttctcaatgttcagttcccacctatgagtgagaacatgcggtgtttggttatttgtccttgcgatcgtttgctgagaatgatggtttccagcttcatccatatccctgcgaaggacatgaactcatcattttttatggctgcatagtattccatggtgtatatgtgccacattttcttaatccagtctatcattgttgggcatctgggttggttccaagtctttgctattgcgaatagtgccgcaataaacatacgtgtgcatgtgtctttatagtagcatgatttataatcttttgggtatatacccaataatgggactgctgggtcaaatggtatttctagttctagatcattgaggaatcgccacactgtcttccacaatggttgaactaatttacactcccaccaacagtgtaaaagtgttcctatttctccacatcctttccagcatctgttgtttcctgactttgcaatgattgccattctaactggcgtgagatggtatctcattgtggttttgatttgcatttctctgatgacgagtgatgatgagcattttttcatgtgtctgttggctgcacagatgtcttcttttgagaagtgtctgttcatatccttttcccatttttttaatggggttgtttcttttttttcttgtaaatttgtttaagttctttgtagattctggacattagccctttgtcagatgagtagattgcaaaaattttctcccattctgtaggttgcctgttcactctgatggtagtttctttggccgagctgaagctgtttagtttaattaaatcccatttgtcaattttggattttgttgccattgcttttggggttttagacatgaagtccttgcccatgcctatgtcctgaatggtattgcctaggttttcttctagggtttatatggttttaggtcttacctataagtctttaatccatcttgaattaatttttgtataagatgtaaggaagggatccagtttcagctttctacatatggctagccagttttcccaacaccatttattaaatagggaatcctttccccatttcttgtttttgtcaggtttgtcaaagatcagatagttgtagatgtgtggtattatttctgagggctctgttctgttccattggtctataagtctgttttggtaccagtaccatgctgtattggttactgtagccttgtagtatagtttgaagtcaggtagcatgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcatgataatgattcttcctacccatgagcatggaatgttcttccatttgtttgtatcctcttttatttcattgagcagtggtttgtagttctccttgaagaggtccttcacatcccttgtaagttgggttcctaggtattttattctctttggagcaattgtgaatgggagttcactcatgatttggctctctgtttgtctgttattggtgtataagaatgcttgtgatttttgcacattgattttttatcctgagactttgctgaagttgcctatcagcttaaggaaattttgggctgagacaatggggttttctagatatacaatcatgtcatctgcaaacagggacaatttgacttcctcttttcctaattgaataccctttgtttccttctcctgcctgattgccctggccagaacttccaacactatgttgaataggaaaggtgagagagggcatccctgtgttgtgccagttttcaaagggaatgcttccagtttttgcccactcagtatgatattggctgtgggtttgtcatagatagctcttattattttgagatacgtcccatcaatacctaatttattgagagtttttagcatgaagggttgttgaatattgtcaaaggccttttctgcatctattgagataatcatgtggtttttgtcattggttctgtttatatgctggattacatttattgattttcatatgttgacccagccttgcatcccaaggatgaagcccacttgatcatggtagataagctttttgatgtgttgctggattcggtttgccagtattttattgaggatttttgcatcgatgttcatcagggctattgggctaaaattctctttttttgttatgtctctgccagtctttgttatcaggatgatgctggtctcataaaattagttagggaggattccctctttttctattgattggaatagtttcagaaggaatggtaccagctcctccttgtacctctggcagaattcagctgtgaatccatctggtcctggactttttttggttggtaagctattaattattgcctcaatttcagaacttgttattggtctattcagagattcaacttcttcctagtttagtcttgggagggtgtatgtgttgaggaatttatccatttcttctagattttctagtttatttgtgtagaggtgtttatagtattctctgatggtagtttgtatttctgtgggatcgttggtgatatcccctttatcattttttattgtgtctatttgattcttctttcttttcttctttattagtcttgctagtggtctatcaattttgttgatcttttcaaaaaaccagctcctggattcattgattttttgaaggtttttttgtgtctcttatctccctcagttctgctctgatcttagttatttcctgccttctgctagcttttgaatgtatttgctcttgcttctctagttcttttaattgtgatgttagggtgtcaattttagatctttcctgctttctcttgtgggcattcagtgctattaatttccctctacacactgctttgaatgtgtcccagagatcctggtatgttatgtctttgttctggttggtttcaaagaacatctttatttctgccttcatttcgttatgtacccagtagtcattgaggagcaggttgttcagtttccatgtagttgagcggttttgagtgagtttcttaatcctgagttctagtttgatggcactttggtctgagagacagtttgttataatttctcttcttttacatttgctgaggagtgctttacttccaactatgtggtcagttttggaataagtgtggtgtggtgctgagaagaatgtctattctgttggtttagggtggagagctctgtagatgtctattaggtctacttggtgcagagctgagttcaattcctggatatcctcattaactttctgtctcgttgatctgtctaatgttgatagtggggtgttaaagtctcccattattattgtgtgggagtctatgtctctttgtaggtctctaaggacttgctttatgaatctgggtgctcctgtattgggtgcatatatatttaggatagttagctcttcttgttgaattgacccctttaccattatgtaatggccttctttgtctcttttgttctttgttggttgaaagtctgttttatcagagactaggattgcaacccctgcctttttttgttttccatttgcttggtagatcttcttccatccctttattttgagcctatgtatgtctctgcatgtgagatgggtttcctgaatacagcacactgatgggttttgactctttatccaatttgccactgtgtgtcttttaattggagcctttagcccatttacatttaaggttaatattattatgtgtgaatttgatcctgtcattatgatgttatctggttattttgctcgttagttgatgcagtttcttcctagccttgatggtctttacaatttggcatgtttttgcaggggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggttgaaaattcttttctttaagaatgttgaatatcggcccccgctctcttctggcttgtagagtttctgccgagagatcagctgttagtctgatgggcttccctttgtgggtaacctgacctttctctctggctgcccttgacattttttccttcacttctactttggtgaatctgatctttatgtgccttggagttgctcttctcgaggagcatctttgtggcattctctgtatttcctgaatttgaatgttggcttgccttgctagattggggaagttctcctggataatatcctgcagagtgttttccaacttggttgcattctccccgtcactttcaggtacaccattcggacgtagatttggtcttttcacatagtcccatatttcttggaggctttgttcatttctttttattcttttttctctaaacttctcttctcacttcatttcattcatttgatcttccatcactgataccctttcttccagttgatcgaattggctactgaggtttgtgcattcttcacgtagttcttgtgccatggttttcagctccgtcagttcctttagggacttctctgcattggttattctagttagccattcgtctagtcttttttcaaggtttttaacttctttgccatgggttcgaacttcctcctttagctcggtgaagtttcatcgtctgaagccttcttctctcaactcgtcaaagtcattctccatccagctttgttccgttgctggtgaggagctgcatttctttggaggagtagaggtgctctgatttttagaattttcagtttttctgctctgttttttccccatctttttggttttatctacctttggtctttgatgatggtgatgtgcagatggggttttggtgtgtatgtccttcctgtttgttagttttccttctagcagtcaggagcctcaggtgcaggtttgttggagtttgctggaggtccactccagaccctgtttgcctgggtatcagcagcagaggctgcagaacagagaatattggtgaacagcaaatgttgctgcctgatcgttcctctgcaagttttgtctcagaggagtacccggctatgtgaggtgtcagtccgcccctactagggggtgcctcccagttaggctactcggggatcagggacccacttgaggaggcagtctgtccattctcagatctcaagctgcgtgctgggagaaccactgctgtcttccaatctgtcagacagggacatttaagtctgcagaggtttctgctgcgttttgtttggctatgccctgcccccagaggtggaggctacagaggcaggcaggcagacctccttgagctgtggtgggctccacccagtttgagcttcctggccgctttgtttacctactcaagcctcggcaatggcggtcacccctcccccagccttgctgccgccttgcagtttgatctcaaactgctgtgctagcaatgagtcaggctctgtgggtgtaggaccctctgagccatgcgtgggatataatctcctggtgtgccgtttactaagaccgtcagaaaagcacagtattagggtgggaatgacccgattttccaggtgccgtctgtcacccctttccttggctaggaaagggaattccctgaccccttgcccttcctgggtgaggcgatgcctcgccctgctttggctcatgcttggtgcactgcacccactgtcctgcacccaccgtctgaaagtccccagtgagatgaacccggtacctcagttggaaatgcagaaatcatccatcttctgcgtcgctcacgctgggagctataaactggatctgttcctattcagccatcttggaaccgcttctatctgataattatttcttttgctgtgcagaagctttttagtttaattaggtcccatttattcagttttgtttttgttgcatttgcttttggggtcttagtcataaattatttgcctaggccaatgttcagaagagtttttcctaggttttcttctagatttttaatggtatcagttcttagatccatcttgagttaaattttgtacatggtaagatatagggatctggttttgttcttctacatgtagctatccaattttcccagcaccatttattgaacaggatatcttttccctaatttatgcttttgtatgctttgtcaaagatcagttggttgtaagatgtggctttattcctgagacctctattctgttccatcagttacatgtctacgtttttaccagtaccatgctcttttggttactatagccttgtagtataatttgaagtcaggtaatgtgatgcctcaagatttgtttttctgcttaggattgctttggctatttggacttttttctggttctatatgaatttaggggatttttctaattctgtgaaaaaatgatgttggtattttgataggaattgcattgaatctgtaggttgctttgagcagtgtggtcattttcatcgtattgattcttccagtgcatgagcatgggatgtatttccatttgtttgtgtcatctacaatttcttgcagctgtgttttgtaatactccttacagagatgtttcacctccttggttaggtatattcctgggtattttattttttgcagctactgtaaaaggaattgagtcttgatttgtcattcagtttggtcattgttggtgcatagcagtactgctcacttgtctatattgatgttgtagcctgggactttaccaagttcatttatcagatttaaaagtgttttggaggagtctttagggtattctagatataagatcatataatcagaaaacaaagatagttcgatttcctcttttccaattgggatgccctttatttctttctcttgcctgattgctgtggctagaacttcgaaatgtaacttttatatgcactcagcaaccaaaaacattatgttgctcactttattgcaatatttgctttatggcagtggtctgaaagcaaatccacaatatcttcaaggtatgcttatttatgcaggacatcctttgttggataagtttgaaggtggagagaccaatcaaaagatgattgtcgtagcacaggtgagagagatgatggaggctgtgactgggttgttgctaatgcagatgaagaaaagtggatgaattgggcatctataacaaatgctgaaaccacaaccatttcagttttccagttgagaggttatgaggtcagatccagcacagtgtatgtagaaacagaaaataagagatatcttagagatataactttgaaggaagtctcaaagacttaatgccagggagaattagagcatattgagggtgcgggagactgatttgtggtctcaatcattagggagattgaaggaccagacaaagaaatgaggagcaaaggatggagacagggtgtggggagaagtgaggagggggacagttttgggaaaattttaatgatgaaaagtcagaggatatccaaatgaacatgccccataagcaattggaaatgtaggtctggagctcaggagcaagaaaacactgcaaacgtaatgggacaaaagatctttcacatttatatttaggtagagatgtatccagagacctgtagacgtctttggtattactttttttaaaaacaaacatgtgatcatccatagtctctaatacttatctacaaccccaagaaggtctttcgttattgttgttttatttttgtttttgtttttagggagttgggtatggagtgatcatgtgggaaggaacatacggacaaggtaaaagagtgtgggattggggagaaattgagaacaagagaggagaaaagcacataaagcatatcagaagctgctcccaccaccatctctctaaagctatgattgagatgctgggccaggttgagtgattgtgttaattccccctccctaccccattttcagtgaaagtttcacctagcttcatgaataactgtgtcttgctctgtctcacttgctttggccttgtctttgtccttctctgtctttgtctctcctagtttccttatcgagctttccctcgggggactttttcattcttcactagcccaatatttcatccttgggttggttcatgtttctccaaaatgctgacagctccatcagagaatgcaaggatgaattgccacaaatatatttctgaactgccactagatggcagtgtctgggaactttgttaactcggtctaggcattcatgagtgcctgactgctgagtggtagggagtttcatttgattattctgcttttaggccgttgcaaccagttgctaacacaagtgctagacttagctggatctctttctccatgatagaagaaaattcatgtttgtaaagcacccagggctggaaaagcctgttctttaagagggttagcgttttcctctacctcaattctcacacaagttcctagcccttagattccttagattcccttttgttcccccttcagctgttgtttgttgtttggtttcattttttatgcaaatatatttcctccttccccagctttgttagtaagttggatcaattctctttcctctttttgaggatggacttgtagaatcatctgctatcaaagcttgaagaactcttagatgtcgtcgagtccaatccaatcatttacagatagagaaactgaggcaaagacaggagcagaaacttgttcaaggccatataaaaattcaaggcagaatcctatgggacaatctcatgacatacttgtaataatcaacaaaacaaccagaagattatttttgatccattaattgtggatctagcacaatagaggaaggggagggagacaggaggtataggacatggtgcctgttctcaaggcacttagaatctaggtgggaatatagacttttacacaatgaaaaagaataaatgcattgtgtgataaggtaatctaagaaaaaatgctaatgtaggcaagtggtacagggattcagaggaacaacagctctaagagaaaacaaggcaatgggtgggggtgaaggtgaagctgggagatgagaaattcaaagattattattattcagggatcaaggcctaataagtaggcctgacaagtagagggtaggggtcaataagaagtaaaagataagactcagtgataggctgggactgtactgtacaggctcttaaatgccaggctaattcctggtaatgctgaacagaaactttcaaatgctttcaatctattttctatttacggtggtaactttctgctatgtttgattccccaagaagtagcctctttgctctgccgtgcttttccccattagtctcatgttgccggcccagcagaagggagatgaagtagagctgaaaaatcagtctggggcttatttccactacagcttttccctagtgattcaatcaagagtgacctggacattctccaatcctaaacccatttcattcattttatttccattctccacccactcatgggagtctgagcacctggcctctgcatcccacaacttcctttgtcacaagggctttccagaaggtttggagagctcttgacagctgagaaacacctatagaaggtgagcatgacttcatgcaaatgaaagaggcctccatacaaaacagctctttaaaagcagtctgaacgtaggaacaatccaagagccctttcaaattgtcaagagcacatcagtgcccaagcatcttggccagccacatttcaaagccaagcaatgccaccctctccccttctcaactctccctttatactcccaaatggcttgaggtctttctaccaggatacagtggatacctctgcctcagcaccttccatctggctttcttcccgccatttgctgtcttctcgtccccacagaatgctatatctttcctcttagcctctgcttagtatacaacctgacacagtaggtactcaatacacggtgttcttttccttcacaaggaccttagagattatctaggcctgaatattatggagccacctaatggaccactgggggtagggatcattgggaaataaggaaatactctgacaattacagtcttcatttctgtaactggtcacatggttgtagttggaatttataactaccttcttctactacccattctgcatcttctttgtcttcagcaaacacctcagctggttgtggttctttacctggaggcatgacccaaaccctcattcctgaagggtctgggccattagtagtcttgcctggattggtttgttgtcttttccatttaccttaatcacagggcgtggaaatactaagatgcatcttaagggatcctctgtattccagacatattcttccttacctacattgtggagttatagttcaatttctccttggtattcagaatcaatcaactcagccagcacaataactcccttccttgcctcctgttgattcagaggcatgaggagcccaaagtggccaggcagcagccttaactttcaattcaatggaatcattgttgtgtcttctggcggaagcattcctccctttggaactaagacttcttggccagcagaccataaattcatgaaaagaggcagtagaaattttgctagtagatcactaggggtgatggtgagtggtaccactccctttgccaccccttaattgctggacccatgaatcctggctatgggagaaacagccccatctgaagatgctgattcagagcatatacagccttctggagaactttccccttgccctacaaggtattgccagctggctggtgctgtaacagagtttttaaaaagccagtttgcagtgaagtgagttcctttatcagaagcaatgctgggtggaatactatgatggtaaatagggcattctgtaagtctacagagggtagttttgaaagaataattgtgttcagggaaggcaaatccttatccatagtaagtgtctattccagtatggacaaaacttccacgatggaagtggcccaatgtaatcagcctgccactgtatcagggattcagtgttggtctctgctgctggcagattggacaccccgccatggccatagccaagttggccttgttgaatagaagttcatgttgctgattccatgcataacctccattcctgccaccatggtcactttgtttatgagcccattgagcaatgacagaggtggctgggaaagagactagtatccataaatgggtgattctatccacttgattattaaaatcctctgctgaagtcaccttttgatgagcattcacaaatatcttcatttttttacccattcatagagatctatcccatacctcttccccaaatttctttctcatcaatgttccaattacgttcccttcaagtctctgaccatccagctaaactattggccacagaccatgaattagtgtataataatgtctagccattttttcttccaaacaaagtgaatgacaagtgcactttttcaagttctgcctactgggaatatttcccttcatcaatgtcctttagggatgtttcagagaggggctgtagtcctgcagctgtccacttttggatagtgcctgtatatcatgcagaatcatctataaagcaggtctgggtcctctcttcctccatgacctgatcataggaaactcccccatgaggccatagctgcaagcttacagacagaagatagtgtagcaggaatgaggctcatgggcatttaggccacttcttcgtgtaacttatttgtgctctcaggtcctgttcagaccaatcaagaataatatcactttcatttaatgatgaagtattttggtgcatgcccaattttatggcttggtgggtcagataatggtcagttcaggtcacatggtaatgtggtggcctgtggttaagcattcagtctctactaaggcccagtagcagacaaacagctctttctccaaagagtagttatttgctgagggtggtaagattttactccaaaatcctaagagccttgtgtagcaattcacctatggggcctgacacggtttccaaactacattcctatctgccactgatccttcaggcaccattggatctgctggatcatgtagcccaattggcagagcaacttgcataccagcctggaccttgttctgggccctactcaaaactagcagctttttgggtcactcagtaaatgggctggagtaatacactcaaataaggaatacgttgaaatccaaagaggcccaccaggcgatgtgcctcctttttggaggagaaagatgcaacaatctgttttttaccttcgcagggattcctccacatgccctactccacttagcccctaaacatttcactgaggtagaagccccctgaatttttgatagatttatttccaaacctctgcaaggtgttgctccactgtcttgccatttgcataatttccaatctgctgtcacctatatatatgttcttctgaacataacatatctcttttatctggctactttaaagagtttttctttgtcactggttttggacaacttgactatgatgtgcccgattctactattcttcatatttcctgggcttggggttaattgagctgcttggatctgtgggtttatagttttcatcaaatttggaaaattctcagctattattccttaatatattttttctgcccctgctccccccacctcaggggatctgattacatgtgtattaagccacttgttgttttcctaagctcattgatgttctatttatttagtttttttctgtttcacttgagatagtttctattaatatatcttcatgttcacgaatctcttctgcaatgtgtactctgccattctatccagtgtatttttcatattagacattgtatttttcatctctagaagttcaatttggtcttttaaaaatttatttatttatttgtttagagacagagtcttactctgtcacccaggctagagtgcagtggcacgatcttggctcactgcaacttctgcctccggggttcaagctattcccttgcctcagcctcctgagtagctgggattacaggcgtgcaccaccacacctggcttatttttgtatttttagtagagacagcgtttcaccgtgttggccaggctggtctcaaactcctgatctcaagtgatctgcctgcctcggcctcctaaagtgctgggattacaggtgtgaaccactgcacctggcccattttattttttaaaattgtaaaaacacagaacccctggtttataatcaatttggtcttttttataccactcatatcttcactgaactttttgaatatatgaaatacaattacagaaactattgcaatgtccttttctctgctaattctaatatagttattctcctcattatggatcattctttccttcttctttgcatactgataatcttttatcggatgccagacattgtgacttttacctcattgtatgctagatgtttttgtatttctaataaatattatagaccttcgttctgggatgcagttaagttactcaaaaatattttgatcctttcaaggctaacttttataatctattaggcaggtctgaaagaatgttcagtctatggctaaatagtctttataactgaggcaaggccttcctgagtactctatccaatgccctagaattatgaggttttccaatctggctggttgggaacaggcactactcctagccttgtatgaatgctaagtgcagttacttctgatccttttgggtggttcttccctcaatatcaggtagttttctcacatgtgcagtttagtactcagctgaatgcttgtgaggaaccctctatagatttctcaagttccctctctatgcagccctctcctggtattctgttctgaactccagccttcttagtcaccccagattatcagctccatctcttcagctcaagaagtctgtcagactctacctgggtttccccttcctaggtttactgcattcgtttttcataccccggggattagttctcttcattgcctgatatacactcatgaaaagtgttgtatcatatattttttctaactttttggttatttcaagtgggagatgaaatctggtccctgatactcatcttaatcagaagcagaggtccatcttcaggaaagctcttctaacaacatctcagcttcttcattatgcttcctctggagcttgtcccatatagttcatttagctgcaaaccctctgcatccatgggctccaccaaggacacatacagaacagggatattctctgtctctatccaggatctgttttccctcttagtcttctccctaatggccactgtctttgtcccttcatattggcaaactcatgtctcacttgactggaggcccttgacaccttccccagagtatagtttggtgtctcctccccaaagaacttcatcatggtagttcagagtttgacattttcccctagatttccctaatttccttccttttaacaggacatacttagaaaattaccagggggtttcactggatctaagtaggtcataaggatcctaagatttcccatggctattccatcaccacccaacactagtggaagtatgatggaaggggaagttgaaatggaaaactgtagtcttaactaattcaagttaaactattttatttctgcaaattttacaaaaacatgactagtgctataataattcccagggccttggaaaggttgcttgaaaagggcccagaagctttaaggttaattagctatgtggtaaatctaccctggtgcatgtaccattttgatgttctaccttactccatatgctagaatcttcctttttgagtccatctctgtctctttcataactcccagctgagcaaccaatctctacttttgaactttgtcttaataattggttttggtcactcaacgacctgctttccaaaatacataactttcccattatctcaattatctcatcctggctcattcttcacatagtatgctagtgtaaacactagcaccagttcatgctcaaccttcatgcttccacacgggctaaactctgaccaacttctcaaatgtatctagacaagccatttagtaagagacaaaattgaatgggtatagattatagtgacacatgtcatcaaacttactaggagatataaagtcacctgccttttataaagttttgagaaacaatatgtacaaatgtgagatgacctagacaatttccagacagacaatgatatatgtctatgaaaatttttgtttctacccaccagtcctcacagtggatgtgatggacaactatagagcttggatctttagggactggtaggataaattctaactaaaagtcttggagtgaatacaaaattaaagaacaggatagactagttggaatagtaggagaagggtgataaacgaaggatacaatcaagattcatagaataggatgaaactgggtctcagtagaagcataccaggaacaagcaaattttcttggacatcggtggatgtccacagttcattttcgtggaccaatagatgtgtggcgccctcatcaagttaataagtacgttaattcaagaattagtccattcatgtaaacagacccccacatatgccaaatctgcctctctctataaaaggtaaacattattattatttgactcaagcttttaaccacatctatagaaaacctgaactcaaagcaaattgaagacagaaactgttgtttcatctccaactagcaatgactggcacagagtaagagttcagtgaacatatgttgaacaaatttgctactctgtattttaccaatctgtgtacccctatctctgccatgaaaaagtgacaattcttatttattttcctaccctcagtgtctagcactatgtctgggactttgtgcattattgataagtggtttccagatgaatggaaaaccttggaagtgtgacgcattgctttgtgaatcacgtcaatgtgacactggtggcaatgtttaacacttacccaagaatctaagaagattccttccacatcttgaaaaggacagagctagaactgatttaaattataggagggagaatggaatgaccagaatcagaattccaggtgtgccttcccaccatagctcaggtggccaaaaggtaatggagaccataccattcttagctgctgtcaccttgaagtacacgggtcttttcttttatagcatctagtctgatgttaagcctattcagtacattttcactttagacattgtactttgcaactctaaacactcaattatttttagtttaaaatgactttttttatctttcagaaggtgttgattatttattatgtgataggagttgttaacttattggttttcaaaccttaaatcagttacttattgagcatagtagatacaacatgctttttttaatcaatattttataccgtagatctgcagtattttaccatttactttaaaatcagcaaagcaagcaaaatactcctgtaatagtttatgtagtcagtattagacttccaaactgatcagaagttggatatgtcattctacttgagattaagtaaaatgtacataatccaaagatatttgtttagagtttcttttctcctttagatttatttttttaatttatttttattttattgtggcaataacacttaacatgagatctactttcttaaattttgaagtgtagaaacattttcgttgacttataggcacaacattaaaggtacagcagatctctagagcgtattcatcttgcttaactgaagctttatgccaattgattagtaactcccagtttttcactcccccatcccctcacaaccattattctgttctttgattctattaaactattttagatagcacatatatgtggaatcatgcaatatttgtctttctgtgactgacttatttcacttaccataatgccatcaagtttcatcaactctgtcccatatcataatttccttctttttaaaggccaaataatattcatgtgtgtgtgtgtgtgtgtgtgtgtgtgtgtgtgtgtgtatgcatgcatatatttaccacattttctctattcattcatttattaatggacatttagattgtttccacatcttggttattgtgaataatgctgcaatgaacataggagtgctgagatcccgatttcaatagataaatacccagaagtgggactgctgggtcatatggtagttttatttttaattttttaaggaacttccataccactttctatagtggatgcaccattttcattcccatcagtggtgtattttttgggtaatagccatcctaacaggtgtgaggtaatatggttttgatttacatttccctgatgattagtgatgatgaccattttttttcacatacctgttggtcatttgtatgcctcctttggataaatgtctattcaggtgctttgcccatttttaaatcaagttattagttttttgtttgtttgttttctcttttttgctattgagttgtaggagtttcttggatattttggagattaaccccttatcagatggatggtttgcaagtattttctcccattccataggttgctttttactctgatgattgtttcccttgctgtttggaaactttttggttagctatagtactatttgtctatttttgctttggttacctgtgcttttagtgtcatatccatgaaatcactgcaaagatctatgtcatgaagatcttctcctgtttttttttctaagagttttacagtttttggtcttacatttaagtatttaaccattttgaatttattattttgcatggtataagttaagggtctaatttcatcattttgcatgtggatatccagtttcccccaaattctcctgcttcagcctcctgagtagctgggattacaggcacttgccaccacacccagctaatttttgtatttgtagtagagacaaggtttcaccatgttgaccaggctggtctcgaactcctgacctcaagtgatctgcctgtctcggcctcccatactgctgggaatacaggcgtgagccacccagcctggccctgatcttttcctttgatctagtctgctgttgaacttcatgagtgaatttttcagttcagttattgtgttctttagctctatgattttggtttggtagttctaatattttctatctgtttgttgaaattctcactttgttcatatattgttcttttggcctcaagagcatctttatgacaatgttttgaattcttggtcaggtaaattatataactctacagtttctgaaaagttatcttgttcctttgtttggaacttctttgcctaattctttattttccttgactctctgtgttgtgtctgcacattatgcaaagcagccacctctcttagtcttcacagactagccttatacaaaagaagacctccaccaatcagtattgccagagattctgggggtctctcaaaccttcgtgctagtccaacctgctttttgtgctttgtagtccccaagcatatagggtatgttgaatcctatcagtgtagtgcaacaagtgtaaatgcaattggttccttagaaactcccagaaagctggattgttggatgctccattcaattctgttttccagtccattcaactctttttcttctcaggggaaagctgagacctgttttattaaaattcccttgctctgtgctgatagggggaaaggagctatggcatctaccagcccaagccaccatctctgttctcccacaggtgacagattatgctgggcctgtcagagctctaagactggcaagtagcaaaacagtcctctagtgagccccctcagaaaagttgtggtgcttgacatgcaaaccaactctttaacctccctttggagaagctgggagtttgaaggtctcttccctctcatgtgttgctgtgccagaggtagggatttcaatgagagggtgtcctgaatctctctactggcttccgtgagtctggtttcacatttgcccaggttgcaagatactgtcatttaatttctggatttttcctaaaggcaattttctgtgaattattgctgaatcaatgtgtctgtaaggggaagaagggtccagggattcctattctgacattttgctgttatcactctttgttttatatgtttttcctcatatcttccatttctcttctctttatgctcatgttttccttccaatatttcaatagttataatagctttctaaaagtacttgtctgctaattctatcattcctgtcatttatgagtgtgtttatatggattgaattttctcctggctctggatcacattttcctgccttcttcatgttagtaattgagtgctagacatcatgaatattacattgttcagagtctagattttgctatgtttctgcaaagaaggttgaagtttgttctgacaggaagctaagttacttgtggatcactttgattctttcaagtcttatttttaagtttcattcaggtgggtctagtataacctctagataagcgctgatttaacccactatgaatgcatgaccctttcattatttactgaatgttccagtgttcactgtggcttcttcactttggcacgtcagaattcaaatgcctcctggtaaatgtcagtttggaaattattccaattacagttccctagtagttgttccttgcctggccttgtggagtttcaccatatgcatatgcagcttaatattcagcaaaagactcaaggggactccaagaagttttcttgggctttgtctctgcatagcaccctttcctctggtactctgtctcacaaattccagctttgtcatcctcaatgaaccctaatttttgccttcttaactcatcaagagtaccatgttctgcttgtgtttaccctccctgtgcaaatggtgtgggaagtacattcagtcagaaggctgaggtaatcacaagacctaccttatttattttccatctctaagggatcaaatttctccactttttgttgcccaatgtttgacaagagttgttttctatattttgtgtacttttatagttatttatgcagaaggtcaaattggctgccatttactctatcatggtcagaaggactgctgtcaccttcagaattcattgactcataaatttttattcaatgtcttctatattcccagtgtgtactcaatctcagacgatatacggaagagaaataacacagaatctctgaccctaaggggcatacaaacagctaatgggaaaagataaataggtactaactcactgttccctttaattggaatattctctccagtttgcctttctgcttagccaaaaattgctcatctagctcagactactttgtgtatgaggccataatttggatggaactaactatgctctcctttgaacataacaatatcctgcacatatttctgtcagtgctcactaaacatcttcttgtgtttctctgtttatatattactcttcctcactaaacagtgagcttctgtaagacaaatgtcatgacttttttcccagtatccagcacaatcactagcacagagaagatatccaaggcaataaatactagtaaaatgaaggaatggatgagtaagtatacagataggagctaattaaagaataacaggtgttaaagggagtggtacccactcttatgcaataatttttttttcaaataaagagattatggagctttgggacaatcaggaaaggcagtgatattgatttggtgtgataggcagaataatgcccgcccccaaaatgtccatgtcctaatgcctagaatcagtaaacatgttaccttacaggcaaaagggactttgcaagtgtgattaagttaatgaccttaagatggggagataatttggattgtcagggggtccacaatataatcacaagagttctttaatggtatttcttttttttgtttattatactttaagttttatggtacaagtgcacagcgtgcaggttagttacatacgtatacatgtgccatgttggtgtgctgcacccagtaactcgtcatttaacattagatatatctcctaatgctatccctcccccctcccccaccccacaacaggccccggtgtgtgatgttccccttcctgtgtccacgtgttctcattgttcaattcccacctatgagtgagaacatgcggtgtttggtttttcgtccttgcgatcgtttgctgagaatgatggtttccagcttcatccatgtccctacaaaggacatgaattcatcgttttttatggttgcatagtattccatggtgtatatgtgccacattttcttaatccagtctatcattgttggacatttgggttggttccatatctttgctattgtgaatagtgccgcaataaacatacgtgtgcatgtgtctttataacagcatggtttacaatcctttgggtatatacccactaatgggagggctaggtcaaatggtatttctagttccagatccctgaggaatcgccacactgtcttccacaatggttgaactagtttacagtcccaccaacagtgtaaaagtgttcctatttctccacatcctctccagcacctgttgtgtcctgactttttaatgatcaccattctaactggtgtgagatggtatctcattgtggttttgatttgcatttctctgatggccagtgatgatgagtattttttcatgtgtctgttggctgcataaatatcttcttttgagaagtgtctcttcatatccttcacccactttttgatggggttgtttgtttttttcttgtaaatttgtttgagttcattgtagattctggatattagccctttgtcagatgagtagattgcaaaaattttctcccattctgtaggctgcctgttcactctgatggtagtttcttttgctgtgcagaagctctttactttaattagatcccatttgtcaattttggcttttgttgccattgcttttggtgttttagacatgaagtccttgcccatgcctgtgtcctgaatggtattgcctaggttttcttttagggtttttatggttttaggtctaacatttaagtctttaatccatcttgaattagtttttgtataagatgtaaggaagggatccagtttcagctttctacatatagctagccagttttcccagcaccgtttattaaatagggaatcctttccccatttcttgtttttgtcaggtttgtcaaagatcagatggttgcaggtaatgtggcattatttctgaggactctgttctgttccattggtctatatctctgttttggtaccagtaccatgctgtattggttactgtagccttgtagtatagtttgaaatcaggtagcgtgatgcctccagctttattcttttggcttaggattgacttggcaatgcaggctcttttttggttccatatgaactgtagttttttccaattctgtgaagaaagtcattggtagcttgatggggatggcattgaatctataaattaccttgagcagtatggccattttcacaatattgattcttcctacccatgagcatggaatgttcttccatttgtttgtatcctcttttatttcattgagcagtggtttgtagttctccttgaagaggtccttcacatcccttgtaagttggattcctaggtattttattctctttgaaacaattgtaaatgggagttcactcatgatttggctctttgttgtcagttattggtgtatacaaatgcttgtgatttttgcacattgattttgtatcctgagactttgctgaagttgcctatcagcttaaggagattttgggctgagacgatgaggttttctagatatacaatcatgtcatctgcaaatagggacaatttgacttcctctttttctaattgaataccctttatttccttctcctgcctgattgccctggccagaacttccaacactatattgaataagaatggtgagagagggcatccctgtcttgtgccagttttcaaagggaatgcttccagtttttgcccattcagtatgatattggctgtgggtttgtcatagatagctcttattattttgagttacgtcccatcaatacctaatttattgagattttttagcatgaagggttgttgaattttgtcaaaggccttttctgcgtctgttgagtcccagtttttcgggaggctgagccaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagtcatgcagaagtcagatatgggcttggatggacttaaaatgcaggccctgaaaaaccgccatttccatatccaaagatttcatggagggcaaaccttaactccattctatttttgagggaagtcttctcgacccatttgcacaaatgaatttccttataggcagccttaacaaagaagggggctcatggaatattcattcatttacttatttgttctctgcccaaatattgttgagctactaatgctctcactactgtatacatgatccttgccctctaggaacctatgtatgtaggtaatatagtttggatattttttcctatccaaatctcatgttgaaatgtaatctccaatgttggaggtgggaccttgtgggaggtgtttggattatgggggtggatccctcatgaatggcttgggccttctccttggtgataagtgagctcttgctctgagttcacatgagatgggttcatttaaaagtgtgtggcacctactcccccgactctactgctttctctttctctcttactcctgctttcaccatgtgaaatgcctgctcctgttataccttttgccatgattgaacactcccttaggcctcatcaaaagctgagcagataccaggaccatgcttcctataaagcctgcagaatcataagccaattaaaccttttttctttataaattgcccagtctcatatatttctttatagcaatgcatgaatggcctaatacagcaggaaagacaaataactttaatataagtatagcaggacaggattcttcattcctttaactcttttcatttcttctccttatttctggggcaggggggtgggggggatcaagaattttgtttgtttgttttttgtttgtttttttgaggcagggtcttctttgttttccaggctggagggcagtggcatgatgatggttcactgcagcctcgatctcctgggctcaagcgatcttcccaccccagcctcccatgtagctgggaccagcgtcatgtgccaccacatccagcaaatttttaaaatttttttgtagagatggggtctcactttgttgcccaggctgggagcaaatttttcacataatgatatcaaagttttactattaatgatgtgtaatataagcaagaagaaaggtcatatggtttctctatgctaaaagagactgtaagaagccattggatggaaagatccatcatcatcacctcccgtctgccagaatgaagaatctctggcctttatcacaatcaatattccagcccatttggaaaacctacaggaaggggctggaacatggtagaagggagaggagggagaccaggggctgtcatcagacatgagttttgattggactgaaaggaaagccaataggtaaagtgaataacccttttgtgctaccctctgaaatctgagtgtgtttatgatggactactagttagaaatgggctattcttgcatatcatttcaaggtgttttgcaaaataatcgtggtgttacctaaatcaaaatgtaccgtgttataagagtgacgaagtgacatgggggttccacattagtatgatcagagaagtatcaagcatgatttccaaccccctaaatatctctccataaagagcttagaacctgaaatgttatcattgatgcctaacacatttgtcttaaacattactttctttctacattgtttatttcagcgagcaagccaccttagtcttaaagagttggtgggatgaggggtgggactggctgtaagatggaagatgtacctcttcattctcatttgcaaaggctctgtttttaatcatttttagggatctcactaatactgctaatctggtcgttgtttctcagaactccctgaatatgaagcagaatgcacatgagaatggagtgcaactgaattgctctgtgctagattctagacaagggagagcttgctgctcaggctttggctctgttggaagtaaatcttattctttgggtgataggccctgcccttttaagtggtgcaagattttcattttgtgtacctaaagaaacagatctcaaaataaaaccagctactcagaaacaatgtggctgtgacatgcacaaaatggatacatggccaggagtagtgttcaatatcagccaagaatagtgggctagatgctatcagtgggggctgcttttggtgcttccagaataagctctattcagatatccccatcagtcttccctagaacgttaatgtttatctagtcccacatatgcggttctcttttcctccttctcttcctggcggcttccctgatatgttcaatgcctgaatgcctctctgtgctatctatgggcagaggaaatatagcaggaagtgtagggagcagctcaaaagttgtaataaaatggccatgtgctcattttgtgcatgttgtggccacactgttcctgggtagctagttttattctgagatctgttcctttaagaacacaaaatgaaaatcttgcaccacttgaaaaagtagggcctatcacccaaagaatcagagagcagcaagtgactctcgggtaccttcccctcaccccctacataccccaagcctcttcctccttccattctcaatctcctgatgtacgcttgtcaatataagggacacagagttgagttacatcattaaaacagaccatcattggccaggcacagtggctcatgcctgtaatcccagcactttgggaggctgaagcaggaggatatttgaggccaggagttcaagaccagcctggcctacagaataagaccctgtatctacaatattttttttaaaattagccaggcatggtggtgctggcctgtagacccaactagttatgaggctgaggtaggaggatcacttgggcccaggaggtcaaggctgcagtgagctatgatcatgccactgcactccaacctgggtgacagaacaaggctttgtctccaaaacaatttaacaaaatatagaggaaagaataagttcctggggtttaggaggcctagttgagccattatttagttgtgtgaccttggacaaatctcttttgattcctgggcctcagtaaatgaggggaaaggtaggctgcattgctaaggatcttgaaagttctgatattcaaaaagtaaaaagagagcatacaccttggctctgtgtttgtatccgaccttagacaaatcacttgccctatatgtatctaagtttctctatctagaatatgggaggctgaactacattgttactaatagccctgccaatcctgacatgctatgcagcatttcctgaaaccagaccaggtgctgactacctatgacaaagaaagtcatgaagcattttgggagaagaaagttgtctcttgcttcctggtgcatgtgctcgagggtctggcataactcatgggatgggtccaatttgccaatagttgcatttttgtttgcttgatttcttgtcaagacaagtgtgcaatccattctgtgaatataattaaagcagctgaggagagcacccttcagttctcaagagttagagattctagttctctccaaaggaggaaatacatttgcattgggagctaggtcccagaggatgcctaccaagagctggtgagtgcctaatgcgaggatcagcattgtgaggaggtgatgacctacatggtgtgcattgaggaataatagggagaccatcactgtaaagcatgcttcttccagtgctcaccattatgcctttaattttcccatttaaaagacattcattgcaatattgcagatttcagtcagaggttgcaaactagtggcccaggggccaaccagtgcctgtccacagagcttacttgggcagcacagttttaaagatttggatttgaatacttttagacagagcagtgtctcctgtgagccatagacatcactattcctttttgtattatagcttccttttttattgtgccccaggatacttgaatgccagtgatttatgtggagtcaggttttggctccctactttgtagctcctcctctgttggaagttagatactctggaagctgatcttcttccagcctcggaagtgggcactaggtggtagcttaatggtttaaagagatttgatgtgttccaatacctgcctgaattccaacgaggattttaaatcctgagataacctggttaccttacccatccagagggttctaatctgtaccctctggggtccaaatgtggagttccccagtgtgggtgactgctagctctggcacagaggctcaaacagtttctcccaaacctagtcattgctggggatgagaacaacagctaacaatggaccctggtcacagaagcacttcctacaactggactttagcttgagagagaagaagatgaaaaagaacactgcggccaggcatggtggccttgtaatcccagcactttgggatgccgaggcagacagatcacttgaggtcaggagttcgagaccagcctggccaacatggtgagaccccatctctaccaaaaatacaaaaactagtcgggcatggtagcacacacctgtaatcccagctactcaggaggctgaggcatgagaatcactttagcctgggaggcagaggctgcagtgagccaagattgcgccactgcactttagcctgggtgacagagcgagactccatccctccccccataaaacagaacactgaataatagttttacgttttatattatttaaaattctctttagttttccagggcttgaaaaaagcctctgggaatggctttcagacccaaaggtaaagctttccctggagtaaggtaaagttttccctggagtgaggagaactctttcaggttatgtgcaaaatgttttccttgagttcaccaagtatttaactgctgacttgtttttccagctctcagcctcaaacttccctctaagtcagcctgaagagacttaataggagataaacagtaagttattcaggcttgtcttgcttcccaagtaacattgtgggctcaccttctgctctgaaaatggaggtccagagggaacagacacatgaaagtgaggctggggcttgttgtagggaagttgttaatggcagaggagttctgagagcaaaacaaaatcctgtcaccatccaaacctcaaccttcacgaccatctgggcaacctccccccaccccattttactgacattttgttatctttttcttcaagaaggataagaaaagcaatactattccccagcagaggaggcctacagctatgcctgaaagtcaagaaatttagtgtccagtggtcagtagccacttctgccttctagccctgctaccttctctccaaattttcatttttagttccttcactcatccagaaaaagttcagtgatgtttagagaagacagacaactgcataattcatctaagaaatcctcattaggttcatttcaattaaaaaagaaaagtttggggtattaagaagcatgcctcaattccccaggtaaccttccaccttaatccttgaatatatgttcaccaagattgtacctctggccaccatttcttctcccgctttgtacttcaagtaccatctttccatgattttaagaaatcacgtattttaagacattgatttaataatagctttacaaaagttcactgcattttattttagaaattgcttaatatcaaggaagtatgctaccatctttctgctaatattcctgaacttttgtctgcacctctgacccttctcctgaagttatgtaactaactgcccactggaagtcttcatttaccagttatttactgaggacttactatgagtccagacactgttcaaatccctgtgggtgcagcaaaaataacacacataaagtcgctactcttgtggattttatattctagttgggaaagacagataataaataagtacatggtacaaccaataatagtaatcataataaattatatgaagagaatgagacctgctactataaaggagagtgactgaaaagggaggttgttatagctagggtgcttactgaagaccttcccaatgaggaaacatttgagcagaggtctgaatcataaaaaggatccagctatatgcaggtctggagaagaacattccagacagagtaaacaacaaatataaaggtcctgaggtgagaacgaaaagaaagtcagtgtgactgaagggcagtgagcaactgtgatcataggagaagaggtaggataattaagcagtaaccaggattgggcctgaagtccagggcataaagtttgtattttattttaagtactattcatatcagcattattaataatagccaaatggtgaaaatgactgaaatgtccatcaacaattgaatggataaaatgtggtatatgcacacaatggaatattatgcagctataaaaaggaacaaagtactgatagatgctacaacatgaataaatcttgaaaacatactaagtgaaagaagccaggcacatactatacaattcgcacatttaaaatatgtaattcagtggtttttagtatattcacagagtttggtaaccatcaccacaatcaattttagaacactttcatcacctcagaaataaactgtgtatatagtatattttatttaacaataaaattgttaaaataaagaactgggtttgggacgtgttaagtttgaggaacaagtaggtccttaaatattgggtaggtcattgtatacatgagtctaagaattcagtggggagatccaggctgaggaaataaatataggagggtgtttttcatctctttaaactctatttcttctccctcattcctagtgaagatggagcttttagtgtaatgatgtgccaatagcttgctattaagaactcagtattggcaagaagaaaggtcttaagagtaattcatgctgaaggctccaaaagacatcaaggaggcctctaaaaagccattgaatggaaggatctaccataactctacaagaatgatgatttctcagccctgacatttactaattgtttcctaggattctattcataagttccattatgagtctgttacacatacctctttgtttttattttagggattgctgtaagatttaccatctgcatctttaacttattagattttcttttcaaataatgccgtatcagttcacataaaagaatcttagagcaatatattttccacttctctgccctttgcaatatcgttgacataaattttacatctacatgtttctgaactacacgatacagattattattatttttgctttaaagttttttttttttttttttgagttggagtttcactctttcccccaggctggagtacagtggcatgatctcagctcactgcaccctctgccttccggtttcaagccattctcctgcctcagcctccagagtaggtgggattacaagtgcccgccaccacgcccggctgatttttgtatttttagtagacacagggtttcaccatgttggccaggctggtctcgaactcctgaccttgtgatctgcctgccttggcctcccaaagtgctgggattataggcatgagccactgaagttaattatcttttagagaaatttaatatgagaacatagtttaaaaatatctgcccacagaagctctttagtttaatccattatccttagcacactaacacaggaacagaaaatactacatgttcttgcttataagtgtgtgctaaatgatgagaacacatggccacatagacgggaacaacacacactagagtctttcggaggatagagggtgggaagagggagaggatcaggaaaaataactaataagtactaagcttcgtatctgggtgatgaaatcatctgtacaacagaaacccatggcacaagtttacctatgtaacaaacctacacttgtacccctgaacttagttaaaaaaaatctgcccacatattttccattctggagctctttattcctttgtttaggtcccaatttctatctggcataacttacctttaggctgaagaacttcctttaatatccctgtattacaggtctattggcatgaagtctgttagcttttgcttgtaaagaaatagtattcatcagggatattggtctaaaattctctttttttgttgtgtctctgccaggctttggtatcaggatgatggtggcctcataaaatgagttagagaggattccctctttttctattgattggaatagtttcagaaagaatggtaccagctcctcctcgtacctctggtagaattctgctgtgaatccatctggtcctggactttttttggttggtaagctattaattattgcctcaatttcagagcctgttattggtctattcagagattcaacttcttcctggtttagtcttgggagggtgtatgtgtcgaggaatttatccatttcttccagtattctagtttatttgcatagaggtgtttatagtattctctgatggtagtttgtatttctgtgggatcgatggtgatatccccttcatcattttttattgtgtctatttgattcttctctcttttcttctttattagtcttgctagcagtctatcaattttgctgatcttttcaaaaaaccagctcctggattcattgattttttgaagggttttttgtgtctctatttccttcagttctgctctgatcttagttatttcttgccttctgctagcttttgaatgtatttgctcttgcttctctagttcttttaattgtgatgttagggtgtcaattttcactttcctgctttctcttgtgggcatttagtgctataaatttccctctacacactgctttgaatgtgtcccagagattctggtatgttgtgtctttgttctggttggtttcaaagaacatctttatttctgccttcatttcactatgtacccagtagtcattgaggagcaggttgttcagtttccatgtagttgagcggttttgagtgagtttcttaatcctgagttctagtttgattgcactgtagtctgagagacagtttgttataatttctcttcttttacatttgctgaggagtgctttacttccaactatgtggtcaattttggaataggtgtggtgtggtgctgaaaagaatgtatattctgttgatttggggtggagaattctgtagatgtctgttaggtccacttggtgcagagcagagttcaattcctggatatccttgttcactttctgtctcattgatctgtctaatgttgacagtggggtgttaaagtctcccgttattattgtgtgggagtctaagtctctttgtaggtctctaaggacttgctttatgaatctaggtgctcctgattgggtgcatataaatttaggatagttagttcttcttgttgaattgatccctttaccattatgtaatggccttttttgtctctcttgatctttgttggttgaaagtctgttttatcagagactaggattgcaacccctgcctttttttgttttccatttgcttggtagatcttcctccatccctttcttttgagcatatgtgtgtctctgcacatgagatgggtttcctggatacagcacactgatgggtcttgactctttatccaatttgccagtctgtgtcttttaattggagcatttagcccatttacatttaaggttaatattattatgtgtgaatttgatcctgtcattatgatgttagctggttattttgctcgttagttgatgcagtttcttcctagccttgatggtctttacacttttgcatgtttttgcagtggctggtaccggttgttcctttccatgtttagtgcttccttcaggagctcttttagggcaggcctcgtagtcacaaaatctctcagcatttgcttgtctgtaaagtattttatttctccttcacttatgaagcttagatgaacgtcgatgcaaaaatcctcaataaaatactggcaaaccaaatccagcagcacatcaaaaagcttatccaccatgatcaagtgggcttcatccctgggatgcaaggctggttcaacatacacaaagcaataaatgtaatccagcatataaacagaaccaacgacaaaaaccacatgattatctcaatagatgcagaaaaggcatttgacaaaattcaacagcctttcatgctaaaaactctcaataaattaggcattgatggggcatatctcaaaataataagagctatttatgagaaacccacagccgatatcatactgaatgggcaaaaactggaagcattccctttgaaaactggcacaagacagggatgccctctctcaccactcctattcaacatagtgttagaagttctggccagggcaatcaggcaggagaaggaaataaagggtattcaattaggaaaagagaaagtcaaattgtccctgtttgcagatgacatgattgtatatctagaaaaccccatcgtctcagctcaaaatctccttaagctgatcagcaacttcagcaaagtctcaggatacaaaatcaatgtgcaaaaatcacaagcattcctatacaccaataacagacaaacagagagccaaatcatgggtgaactcccattcacaattgctacaaagggaataaaatacctaggaatccaacttacaaaggatgtgaaggacctcttcaaggagaactacaaaccactgctcaatgaaataaaagaggatataaacaaatggaagaacattccatgctcctgggtaggaagaatcaatattgtgaaaatggccatactgcccaaggtaatttatagattcaatgccatccccatcaagctaccaatgactttcttcacagaaatggaaaaaagtactttaaagttcatatggaactgaaaaagagcctgcattgccaagccaatcctaagccaaaagaacaaagctggaggcatcatgctacctgacttcaaactacactgcaaggctacagtaaccaaaacagcatggtactggtaccaaaacagagatatagaccaatggaacagaacagagccctcagaaataattccacatatctacaactatctgatctttgacaaacctgacaaaaacaagaagtggggaaagcattccctatttagtaaacggtgctgggaaaactggctagccatatgtagaaagctgaaactggatcccttccttacaccttatactaaaattaattcaagatggattaaaaatttaaatgttagacctaaaaccataaaaaccctaaaagaaaacctaggcaataccattcaggacacaggcatgggcaaggacttcatgtctaaaacaccaaaagcaatggcaacaaaagccaaaattgacaaatgggatctaattaaagtaaagagcttctgcacagcaaaagaaactaccatcagagtgaacaggcagcctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccgaattatacatgaaaaaatactcatcatcactggccatcagagaaatgcaaatcaaaaccacaatgagataccatctcacaccaattagaatggcgatcattaaaaagtcaggacacaacaggtgctggagaggatgtggagaaataggaacacttttatactgctggtgggactgtaaactagttcaaccattgtggaagacagtgtggcgattcctcagggatctggaactagaaataccatttgacccagtaatcccattactgggtatatacccaaaggattataaaccatgctgttataaagacacatgcacatgtatgtttattgtggcactattcacaatagcaaagacttgtaaccaacccaaatgtccaacaatgatagactggattaagaaaatgtggcacatatacaccatggaatactatgcagccataaaaatgatgagctcatgtcctttgtagggacatggatgaagtggaaactatcattctcagcaaactattgcaaggacaaaaaaccaaacaccgcatgttctcactcataggtgggaactgaacaatgagaacacatggacataggaaggggaacatcacacactggggcctgttgtggggttgggggaggggggaggggtagcattaggagatatacctaatgttaaatgatgagttaatgggtgcagcacaccaacatggcacgtgtatatatatgtaacaaacctgcgtgttgtgcacatgtaccctaaaacttaaagtataattaaaaaaagaaatagtattcgttttgcttttattcttgaagaacatattcttgaagtatatttgaaacttaaagattagttcctatctggcttgcattgtttgtgctgagaagtctgcagtcattcttatcatttttctctggtatcttatgtgtctttttttcctctggctactactgaaatattttccttaatcatgactttttggcaattttattatgatgtgtctttgtgttgtttgcttggtgtttatccttcatgagttcactgggattcttggatctgtgggtttatgcttttcatgaaatttcgaaaaaatgtgctgttatttcatcaaatacattttccaccttctcctgttgcttctctttgggacctcagttacacgtagattagattgcttaatattgtgccacaaatctctattctttgttgttactgtttggcactttttttctttctatctttcattgtagttagattctcttgctatgtcatcaaggcactggtattttcttctgaagtgtctaatttgcaattaaagtacaaacctttcaacagcacacttcaatttatgattacttttcatattacatattgtatttttcagatttagaagttgcatttgtttcttttttatatcttccctcattatgtttataagttttcctttattttttgagcattcttaaaatagccattttaatgttattgtctactaatttcatcagctctctcatttttttattttatttctattgactgacttctctcctagtcgtgggtaacattttcctttttcttgtatgtctaataatttttaatttagaatagtatgttgctgagtgtctgcacttggttgtcttccttaagaaaatgttgggctttgcctagtaggcagttctgttactctagccagttcattatgatatttttgagtctcatttggaagttttgttatagcagatctattgcatactttacccactgcttgcttatccctaataaaaaactatgttccttcataagcctctacctgattccctgggtattcaacaagttctcgctcctttatctggctggaacttaaatgtctcctatacttgcgtgaactctaaatttttcagctcacagcatcctggtagttgcctttgtcttgaaacatggcatttcaccatatgtatttatgtggatgattcataagcagaactcaggattatgcctatacagatttctgaaggtcttttcctgcatatcgtcttcctctcctgtgctcttgtcaagaaattccactcacctcagcttccgtaaactctagtctctgtttcctgaattcagtgtctgctgagctctgctcaagtttcctcttcatgcagtatggacaaggaagtagggctcacctcaactgttatattccatgatggatcacattctgtgcctgaaaatagttgtttcacgtattttgtccagttttctaaatgtgtataatagggcaacaagtttggtactaagtactccaccatgatagaatccaaagcctctcaaagtattactttaaaaaaatttttaaagcacatttctgacctggctctttctggtctctgtgcctttgctcatgtccaaatcatattcactcttcaagacccagagtatgctatctccttgatgcaacgtttaatatacctctgccagaaacaatctctctttcctttgctctccagggcacgtttatgaattccttcattcactcatttaggaattaaacaatcatataatgagcactttccatgttccaggcactgtgctaggccctgaggatacagaaatacaaactcccttttctttaaagctcatattttgttgagggtggagactatacattgtgatattaatactattgtggcagaaggatgccgactggaccatgtaagcacacacagtggaaggacaagaagtctgctggagaaatccagatacagaaggtttattagtagaagtgataattgctaggagagacgggagggaagagtgttccagatgaaaggactaacatgtactcttaatgtctgtgtaaatccaagtcacactattactctcagtccccccactgctttgtaagctcctggagtatagagattgtgttttgtttatcatcatccccacgccacccccgcccccgcccactgcagatttccaatataagcaccatttataacacactgcaacacatagtaagtatttagtaagtatttgggagtacaaaattataatagcttatttttctacaatagagttatgatcagaaaattacttggaaatgcctaatcctctcaaactgggtacactcgctagactgagaagtgttcccccgagtttcattgatctctgagacatagcgacatcccctttttgagcattatagaaggaagagtctcctatatatagctaggaaatgatatctatacgtggctactgcagatttttgcaatagcttcagggcttccatgtagacatcataaataatgtctgtagagaagttctcatgctggtatattatcttaggtcaaaatgaatcagtttgactgataatctggctaattcagctcaaatcttgtgtttctgtctttattacctagataactgcctgaatcctttgattgggttttgacatgacttaattgcatgtgtattattcatgtctgtcagcctcacactgaaaaccaacattctgatttctgtgttgcactagaaaggggtctgtatacctggattctgttttcagctctgcaagtctcatcatgtctctgagactctctcatagagatgataataatacttagaatatcattagtattttcatgcctcatatttgaagtgaaagtatttttaaatcatataaagtgcttaaagatgtctgaagaattattctacacatgcattcatgtatcacttaattaactttgtcagacagttttctcactgtgcaaaaaacatagactgtgcttatacaaacctagatggtatagcctactacaaacctaggctgtatggtagagtctcttgctcctaggctacaaacctgtacagcatgatactgcactgaatactgtaggtaactgcaacacaatggtaggtatttctgtatctaaacatataaaaggtacagcaaaagtaccttactagacaaggaagggcattacataatgataaagggatcaatgcagcaagaagagctaactatcctaaatacatatgcacccaatacaggagcacccagattaataaagcaagttcttaaagaactacaaagagacttagactcccacacaataatagtgggagactttaacaccccgctgtcaatattagatcaacgagacagaaaattaacaaggatattcaggacttgaactcaagtctggaccaagcagacctaatagacatctatagaactctccacaccaaatcaacagaatatacattcttctcagcacctcatcacacttattctaaaattgaccacataattggaagtaaaacactcctcagcaaatgaagatgaatggaaatcataacaaacagtctctcagaccacagtgccatcaaatgaaaactcaggattaagaaactcactcaaaacctcacaactacatggaaactgaacaacctgctcttgaatgactattgggtaaataacgaaattaaggcagacataaataagttatttgaaaccaatgagaatgaagacacaatgtaccagaattgctgggacacatttaaaccagtatgtagagggaaatttatagcactaaatacccacaagagaaagcaggaaagatctaaaattgacaccctaacatcaaaattaaaagaactagagaagcaacaacaaacacattcaaaatctagcagaagacaagaaataactaagatcagagcagaactgaaggagctagagacataaaaaacccttcaaaaaattaatgaatccaggagctcattttttgaaaagatcaacaaaatagatagacaactatccacactaataaagaagaaaagagagatgaatcaaatagatgcaataaaaaatgatataggggatatcaccactgatcccacagaaatacaaactaccatcagagaatactataaactcctctatgcaaataaactagaaaatctagaagaaatggataaattcctggacacatacaccctcccaagtctaaaccaggaagaaatcaaatccctaaataaaccaatgacaagttctgaaattgagtcattaattaatagcctaccaaccaagaaaagcccaggaccagacggattcatagccgaattctaccagaggtacaaagaggagctggtaccattccttctgaaactattccaaacaatacaaaaagagggaatcctccctaactcattttatgaggccagcattatcctgataccaaaacctggagagacacaacagaaaaagaaattttcaggccaatatccctgatgaacatcgttgcaaaaattctcaataaaatactggcaaaccgaatccagcagcacatcaaaaagcgtatccaccatgatcaagttggcttcattcctgggatgcaaggctggttcaacatacacaaatcaataaatgcaatccatcgtataaacagaaccaatgacaaaaaccacatgattatctcaatagacgtacaaaaggcctttgacaaaatttgacaccccttcatgctaaaaactcacaataaactaggtatcagtggaatgtatctcaaaataataagagttatttatgacaaacccacagccagtatcatactgaatgggcaaaaactggaagcattccctttgaaaaccagcacaagacaaggataccctctctcaccactcctattcaacatagtattggaagttctggccagggcaatctggcaagagaaaggaagaaaataggaagagaggaagtcaaattgtctctgtttgcagatgacatgattgtatatttagaaaaccccatcatctcagcccaaaatctccttaagctgataagcaacttcagcaaagtctcaggatacaaaatcaatttgcaaaaatcacacacattcctatacaccaataacagacaaacagagagccaaatcatgagtgaactcccattcacaattgctacaaagagaataaaatatctagggatccaacttacaagggatgtgaaggacctcctcaaggagaactacaaaccactgctcagcgaaataaaagaggatacagacaaatggaagaacattccatgctcatgggtaggaagaatcaatatcgtgaaaatggccatactgcccaaggtaatttatagattcaatgccatccccatcaagctaccaatgactttattcacagaattggaaaaaactactttaaagttcatatggaaccaaaaaagagcctgcattgccaagtcaatcctaagccaaaggaacaaaactggaggcatcacactacctgacttcaaactatactacaaggctacagtaagcaaaacagcatggtactggtaccagaacacatatatagaccaatagaacagaacagaggcctcaggaataacactacacatctacagccatctgatctttgacaaacctgacaaaaacaagcaatggggaaaggattccctatttaataaatggtgttgggtaagctggctagccatgtgcagaaaactgaaactggaccccttccttacaccttatacaaaaatcaactcatggtggatcagagacttaaacgtaagacctaggaccataaaaatcctagaagaaaacctgggcaataccattcaggacataggcatgggcaaggacttcatgtctgaaacaccaaaagcaatggcaacaggagccaaaattgacaaatgggatctaattaaagtaaagagcttctgcacagcaaaagaaactatcatcagactgaacaggcaacctacagaatgggggaaaatttttgcaatctatccatctgacaaagggctaatatctagaatctacaaagaacttaaacaaatgtacaagaaaaaaacaaacaatcccatcaaaaagtgggcaaaggatatgaacaaacacttctgaaaagaagacatttatgcagccaacagacatatgaaaaaatgctcatcgtcactggtcattagataaatgaaaatcaaaaccacaatgagataccatgtcacgccagttagaatggtgatcattaaaaagtcaggaaacaacagatgctggagaggatgtggagaactaggaatgcttttacactgttggtaggagtataaattagttcaaccattgtggaagacagtgtggcgattcctcaaggatctagaactagaaataccatttgacccagcaatcccattactggacatataagcaaaggattattaatcattctactatatagacccatgcacacatatgtttattgtgtcactattcacaatggcaaagacttggaaccaatccaaatatccatcagtaatagactgtataaagaaaatgtggcacatatacaccgtggaatactatgcagccataaaaaaggatgagttcatgtcctttgcagggacatgaatgaagctggaaaccatcattctcagcaaactatcaaaagagcagaaaaccaaacaccacatgttctcactcataagtgggagtcgaacaatgagaatacatggacatagggaggggatcatcacacaccaggccctatcagggggtggggtgctaggggagggataacattaggagaaatacctaatgtaggtgacgggttgatgggtgcagcaaaccaccatggcacgtgtatacctgtgtaacaaaactgcacattctgcacatgtacaccagaacttatagtataattttttttaaaaagtaccttactataatcttatgggaccaccatcatataagtgctccatcattgtcgaaaagttcatgacacaaaacatgactttattttgtatatgtattttggcattagtagagtcacagtggtatggtagtaaaattagtggccttcaggtatgtctctgtataaattagcttttgtccttgagcaagtcattttcctctttgtagccttagtttcttcatctctcctttttgagatatcattctgggtatcttaactgaaattcttttcatcctttgaaatacatagtgctattaggatgccatcttaatctgtttgtgctgctataacaaaatacctgagactgagtagtttataaacaatagaaatttatttctcacagttctgaaggctgggaagtccaagaccaactggcgctggccagttcaatatctggtaagggtttgctctctgctttcaaggtgaccccttcccactgcatccgcacatgaaggaagtgagaagggacaaacactatgtcctcatgtgctagaaggggcagaaaagcaaaagtgataaatacgttccattgagctcttattataagagcattattgccacccatgagtgtggagcccttatagcctaatcgccttctaaatgcacctacctctttatagaattgcactgggaattaagtttcaacatgaattatgtaggaacataaatattcaatccacagcattccactcctgcccttccccccaaaaaatttatgttaaaatatacaaatattccttcccaataggcctagaaattttaacttattacagcatcaactttaaagtctaagtccaaaatctcatccaaatattgtctaaatcagatatgggtgagagacccaaagtatgattcatcccgaagcaaattccccttctagctgtaagcctgtgaaatcaaacaagtcacatgcttccaaaatagaatggtgggacaggtgcaggttaaacattttcattccaaaaagaagaaagaagaaagggataataggtcctgagtaagtccaacccccaacagagcaaacaatattcaatcttaaggctggagagtaatcttcctttattccatgtcctgccctctggacaccctggggtagaagttgggttgccaaggctccaggcaaccttgctgccatggctttgcttggcacagccatactgaagctctcccaagtagagtcttgtgcctgtggctctcccagtgtacagttacatgctggtggccctagctctagagttctgggttcttggggtcacccctgctcccatggatccaatggacattaccctagtggggactctctgtagtggcccactaggcaccactgagcattgctttagtggaaactctctggtgcctctgcccctgtggcatttctctgccttggcccttaagctttccagggaatcctttgaaatctaggtgaacgtagccatgcccccacagctcttggactctgtgtgcctgcagagttagcaccacgtggatgctatgaaagtttaccccatgtgcctcctggagaggtagcccaagctgcagctgggctcacttgagccacatctgaagagactgaagagtgctgcattggaatacatggagcagaaacttgacactcccctgggcagtgagacttgagaacccaagttgatgccttctcattgtattctcacttgatggaaaggtagaagagataaactgtgtcttcacatggcagaagagatggaagagatgaatgctgtgtgctcatatggtggaagagacagagaagcaaaagggataaactcactctttcaagccttttcataagggcactaatcccatctatgaaaggtggagccctcatggcctaattacctcctaaaggccccacattttaatactgttgcattggagagtaagtttcaacaggaattttgaagggacacaaacaggcaagtcctaggagattttcaagtgccttagttgaagtccaatatttttaaaggtccaggtccaacatttagatgttgagatcaacattttagcctttagatgataacaaagactccaaaaagaaggaggggaaatgggaggctgatatgcatagaactaaatctattgacctacaacccaaagatccagctgagaatgttaagacaggaatgtctatggagaagaaaggagtgtgattctgaaaatttcgtttggaagctgaatttcatttctctgggaaagtagggcacaatatccaagatggagggcagggatacttatgtccagcattgccccatataaacataagctttacattagggcatcacaaaaataatgggcaaattattgctggaggctttcccacacatacattaataacctagtgccatcattttgaggaacatgaagagggtcagctagagtcagtccatatgacagcatccctggaaatacttctcagagggaatggccatttggaattttgatggtggtagcatcattggaaggctcagtggcagtttgcattagcagtagcaatggaaaatataacagtccataaacattgcacagcaatgggtagactccttaaaaaacagagtttctcaaccttggtactgttaatgtttggagctgaatcattccttgttgtggggagctgtcctgtgcattgtagaatgctgagtgcaaacctgacctctatccactagatgccaatagaattcccctagttgtgacaaccgaaaatgtgttcagacatgaccacatatccccttggaggcaaaattcctgattgagaagcagtgctctagggaatgacagaacactaagggtagattgaatctcaggccatcagggtgaaccatggattccttgcagcacctgttttagcacctctcacctagatatgttaagaacaatccgagattcaatagctgaatgcaaagtggaggagaaagtagtgagtaaggcagtctgggcttctactcaccctgtaagccaggaggaggagagatttccattgttgagtacaaagaaccaggctttagtttcagacagacttgtttctataatactctgtcactttctagttgttgagtcctggtgaagtggcactacctccctgaatctcagtttcctcaactgtatctacacaaatttgatttttattttgttatttataatcacaacctcttttggaggagggtgcatctctccaagtgacattttagaacacatattaaaatggggggaaaatacccgacaaagttgtatgagaatgagagataatagataataatgaaagtaaatagaacacctgaaactaggcctggcacatgtgctgattctataaaggatgactattgttaagttgaatatttctgaaatataattggtggaggcttagtcagatatactattttgccttttttttttttttttggtagttctatttgacatcacccacctattacattaagaatcctcctttctttaatctccatctccacctgccaactatatctagagagggttatcagtctgtgaccttttgctactttcagagtaaccatgggggctcagggcctctcttcttgtaatcccatttcccttgtttaccttggtgtttctttgatgtgaaccttcctgctgactgtacctgtaagagattatccattgtgcttttgcctcttctctaagcccccagacatttggaggtatcattgcttaatctttgtgtttcaccatcagttaaggtcagaagcctttgatccatcctgtttactagaccctacattttaacacataaaactgctgacagctatatttttattaaatttattttcctgggttttagtcatagcactaaacttcaataccaatatatcactacattaaaaaaaactatcatcagtgtgtgtttacagttaccatagcagtaaaatttgtactcaacagcattattacaattttctcctatttacaaggtatatttgattcatgttttaaaaccaacaaaggaaaaacgtaaatagaattattgctgtcaacactactgcaattttttctacccttaacgctcaccaccagtgatagatataacaacggattgcctgtaaacacataaaagcccttctcagaaaaaaatgggctttttgtatccatcatggtgaaatctgggtcctttgataggatgactgatgagagagaagataagaaaaggtgataaggcctacctttctgcactctacaccagcaccctgtggacacattaggatgaacactggcctgactcctcttagtttcccaagatcaagtgacccatactacaatttgctactgatagatggggcagccctgggctctagcaggagcaagtagatgatgaaatcttgcccactcctaattatttttccaccctacaaagtgatcctctgggcaggaagtttaatgggatactgtatagccccaacagttttcatgcctgctacatttacttgctagcctcagttcctgtggctcctgagcagctggctgtctgaaccccacccctttctccttactgtacacctacagaaaaggagagttggtggaggctctcctgtaggtgtacagtaaggaggctcagctctgtggaggtagatactgttgggagttggtttctgggggacccaagttagaatgggggtatcctatctgaagcaatatggggagcatcaaataataagataaagtcaatactgatggaaaaatctaaaaggccagtagcaacatgagggttgtgagtttgtatcagtgtgagatgggattagagtgacagccagtaaaaaataagtcagtgtgtcctgttgggtctttgctcatagccttgcaggtagtacatccatggtgtgtgtatagattgggatggctgcagtccctgagaacctaaatgctttattgcttcaattctgtatatgtactacgtagcaagtatctactcgccaaacttaacaataatattccttcaagaaggaaacaaagaaggtcattgtaaattgagttcctttcattgttttcttccaagagtgaagcctacaaaacaatatattggttctgaaatgtcctgatcctccccttctcctcaacctcgttttagcttcaacatcttaaagcagtaacgttttgtgggcttggcgcaagtggctaatgcctgtaatcccactgctttgggaggataaggtgggaggattgcttgaggccaggaattcaagaccaacctgggcagcatagcaagaccctatctctaccaaatttttttttaacttagccaggtgtggtggcgcatgcctgtagtcccagttacttgggaagctgaggtgagaggatcgtttgagctcaagaggtcgaggctacagtgagttgtgatcatgccaccacactccagcctgggcggcagagcaagacccatctcaaaagaaaaaaaaaacaacttatttgtggaatagccttttgttttgagaggatttattacattgaaactcttaatggcttaacaatttctatttcatattcttctcagagcaaaagtggatccaaaagagctaagtagtcataaagtaaggaagaatgaaaaccccattttccttctatcttgttggaggcccttgagaaatagattttggaagatttgccacagggcttccatagaattgactccagaaaaagttttcattaagcctggcacacaaatactgaaacccaaatgagaaaatggattaaagtgataaaaaatgttcaaatgttgtatgcatagatgtttttgtgtggatgatgtgtgatgtatccttttgtttataaaggtaaataatcgacaaatacagactgcctgtctagattcaggaatagtcaaagactttaagacaaactcagtgatgtttggctctgagcctcacacattttgcttactaaaactacaacctcttctctcaacctaggcatctcatttgcccttataccccaagaggctctttctgtcatgaatcgtcgttctctgtagcttttgctcttgccctcatgctttggtttcattttcagtgttctactttatcactttcaaagttggagaacaattaccatactgaagtgatttcagatttcctggccaaatacagattatctagcattcaagagaccacagttcttaaactcttgctctccacccccatccccaagagaatcttcgattttgagtaatgtaggacaatttcatcatgaattgtttgaagggacattttagtggcacatcttcatgctattctgggaatactatttccaacctttcttccctggaaccacagtacaggatgttttgactttttgactccacaatccgccattccttcctctttccagaggtcttcttgaatatttttttctgtgaattgctctttgatctctaaatccccttccatatttctgccagatggccccttacaaaaataggagtaactttggctgtccctgctatcctctagtttctaatgtaggtttttaattcaggcccctacaaagaccttgctgtagtctctccccataacatttttatcattcctgtaaagttctcacttttacccaagatctcccccttttaaatgatgactttgagagcattccttcaatagttattaacttcagtagctaccctgcatccagcttcatggtatagagtaactactcaaatatttgctgaatgaaccaattaatgaaaaacacgatagaaggaatgattgaatcagatttctaaagtgccagactgaatagggagtagaagtcaaccaagacaaagtttcacttggggctcatccatccctatatttctgtttttgtttgtttgtattttaaaccatggtagaggtagccctgataggactcctagtttagaggtatgctctaccctgctcaaatggcaggagctggatcaaaatggacagtgtttttcatacactaatttttttcctggtccaattcattagcaactccctcagtcttgaattttgactcacagtcgttccctgaattcatgatagccacagactgtggttcccatgatctactcctgctttatagtgctgagcctaagggaccaacatcctgggctaaaatatggcaaaagacaatatcggcaaagtccatttcactgtatgagttgatctcatactgattattttgccatctcttcataaaggccgtcaagtccaagctgaagagaaacaaagggatatttatggtctcagcctacttttttgaggcccagggagatgcggacctcatgcttttctgttgttttgacctcccccagatacatcatagcttccgaaactccaggggtaaattctggtttcagatgcatccagcctatagagaacaaacattatcgtaagaacaatataacagcgggcttgccccagaattacttgccctgtatacttggctcatgacttctctatatccatttccccctttgttcttaacagaattctttattcaggacagtctaccctgtggcttaggggtgaccatgtttcagggttctggctagttaaatgtaagtagaagtctaatagataagactatagggaaaactgtttctaagaaggtggagactcacatatcatatggattttgcctttgctcttcaccccttttccctgccttgaacatggatgcagttcccggagctatgattactctcaaacccataggaaaaaaagccaaatagtaagaaaggcagaaaaggaagactggagtgaggactgaccttgagtaattaaaccaactctgagctgcccacctccaaacttgttgtaagaggagaaggagaagcccctgccagggtatacctctttcatgcaagtttctgctcttctttcaccacaaaggccctttcgagactttctatggctgtctctgctactttggttgtccctcttttcatttctcttcttccttaagtagttttgcttttagttggaagagattgggaggcagacactttcattttgcaggtatatggagcttacgctgagtttgggtgaaacccagtctcaacctaatatgaggggtcttcagaaagttcataataatgcatgttatgaaaaaaactgtgcaaggatttcaatttctttttgtgccaaaataagctcatattaacagttacaacatgtctgaacaggatctagtttgaggtgctaagaagtataagtaatcagtttgaaaagagcccctctcagagcaacatgaatcctgctaaaagtaaagcaagaacaaacatcaaatttatggtgaagcttgggtggaagaatggagaaatcactaatgctttacaaaaatttatggggacaagccccacctcaaaaaaactggcaatttgcaaatggatcactcattttaagaagggagaagacaatgttgaagatgaagcccacagtggcaaaccattccatcaatttgtgtggaaaaaaatgtatttgttcttgccttaattgaaaaggaccaatgattaataccagaaacaatagccaacatcatagacatctcaaatggttcagcttacacaattctgactgaaaaattaaagttgagcaaactttctacttggcgggtgccaaaaccactgcacctatatcagctgcaaacaagagcagaactttcggtataaattttaaaaagtgggttcaggatcctaaagcatttctccaaaccaactgtaacaggagatgaaacatggctttaccatgtcttgtgatcttgaaaacaaagcacaatcaaagtaatggttaccaagaggtggaagtggtccagttgaaacaaaagcagatcgatcaagagcaaaggtcatggcaacaattttgtgggatgctcaaggcattttgcttttgcttgctgactttctggaggaccaaagaacaataatatctgcttattataaatgtgttttgagaaagttagccaaagctttagcaaaaaaatgaccaggaaaggttcactagagagtccttctccaccatgacaatgctcctgttcatacctctcatcaaacaaggacaattttgggaaaatttcagtgggaaatcattaggcatccaccttacagtcctgatttggctccttctgagttctttttgtttcctaatcttaaaaagtctttaaagggcacccatttttcttcatgtaataatgtaaacaagaccacattgacatgattaaattcccaggatcttcagttctttagggatggactaaatgactcagatcttcccttacaaaactgcttgaacttgataaagtttatgttaagaaatacaattaataattttttctatcatttacttctactgtccatgaactttgaagaatgccctcatatacagactcccattatctatggcaaaagtaaaaaaaaaatggtggttcaaagggggaagatatagccttctcagtgttttaaaagatttgaatccattgtcagcatttaaaaataataatatttttcataaactctagattttcagcatctctaacaacactgggccctcattagctcatgacaataattgactaaagtagcaaattcttcatttagaagggagcaggcacgctccagattgccacagttttcagccttcttgcaagtgatacacttcatttctttttaatacctgtcttgccctataggtgtttgagttttcaataacttatttatggattctttgaaggataattagtaatactttttctatttcaaacccctaggcagaaacctctgcctcctctaataactgtcaaggaaaatatgaccagcctgcaactgcatctctccatactcctaaacatcttagccagtgtccccaagaaattcatctgttacaaatgcactggaaatgtatttgtaacaggatgttacctcgagcatgggacccaaaggcaattagattcttcttttctacatctgacacctgccattcttgagacataattttggtgtcttcctcaaaagcatctttccctacaaatgagtaagcactacttaataataacctcagtttggaaggttggcaggtataattattataagaattattagttccagtagctcttctctaaatctacttctttagagcacttggaattggagaacgtttcatatctatgccataactgatttaatttctgtttcttctctaggataaatcacagtaatttgtagcttcaatgtttctattgctgtaaatggatacaaactctttgggaggcgatctgggaaaacttactaaaattttaaatgtggacatcctttgattcagcattgcctcagctaagaaactttccttaaaaaaatactttcataagtataatacacacacatgcacacacacacgtgtgtatgtatgtatgtatgaagaatttttttctagccatacattgggagcaatgaaaatgtccagtaatagggaactcagtaagtaaataacagtaatccagtaatatggcatctagaggctctcagcgaccctattgtttcagaacaactttttagttaatttctggtctaagaagagtagtggggaaaggatgatctttttaagagctgaggaaaaagttgaaactcaatctttacctctcactacatgcaaatacttacttgaaatggatgatggacaaacacataaaagctaaaagaaatttttagaggaaaactttggaatctttgtgaccttggggtaggcaaaaatgtcttagcttattcatttgagttgcttgtagatgctgaatattagccctccatcgaatgagtagtttgcaaatattttttcccattctgtaggtggtcagtttactctgttgattgtttccttgctgtgcacaagctttttaggttaactaagtcccatttctctatttttgtttttgttgagtttgcttttgaggacttgatcataaattatttgcctaggccaatgtccagagagtgttttctaggattttttttattatactttaagttctagggtacatgtgcacaacgtgcaggtttgttacatgtgtatacatgtgccatgttggtgtgctgcacccattaactcgtcatttacattaggtatatctcctaatgctttccctccccctcccccaccccacaacaggccccagtgtgtgatgttccccttcctgtgtccaagtgttctcattgttcaattcccacctgtgagtgagaacatgcggtatttgggtttttgtccttgcgatagtttactgagaatgatggtttccagcttcatccatgtccctgcaaacaacatgaactcatcctttttatggctgcataatattccatggtgtatatgtgccacattttcttaatccagtctatcattgatagacatttgggttggttccaagtcattgctattgtgaatagtgccgcaataaacatacatgtgcatgtgcctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaattggtgtgagatggtatctcattgtggttttgatttgcatttctctgatggccagtgatgatgagcattttttcatgtgtctgttggctgcataaatgtcttcttttgagaagtgtctgttcatatccttcgcccactatagtttcgggtctcacatttaggtctttaattcatcttgaattagttttgtatatggtaagaggtaggggtccagtttcattcttctgcatatgactagcctattttcctagcaccatttattgaatagggtatccttttcccagtgtatattttgttgactttgtcaaagattagttggttataggtattctgagttgtttattctgtcccattgaagtatgtgtctattttgatatcaatatcatgctatagccttgtagtataatttgaagtgaggatatgtgatgcctccagatttttttcttttttgcttaacattgctttggctatttgggctgtttttcgttccatatgaattttggaattgctttttctaattccatgagaaatgacatcagtaatttgataaggattgcactaaatctgcagattgctttgggcagaatggccattttaacaatattaattatttccatccataagcatgggctgtttttccatttgtatcatctacgatttctttcatcagttttatagctctgcttagagagatatttcaccttcttggttaaatatattcctaggtattttatgttttttatgtattttatgatttggtccttggctggatcattattggtgtacagaaatgttactgatctctgtagttaattttgtatcctgaaactttactgaattcatttaccaaaatgaagagttttttggtggagtctctagtgttttcaagatatcagatcctatcattggtgaacaaggataatttgacttcatcttttccaatttagatgtcttttttttttcctcttgttgattgctctggcaaggacttctagtactatgttgaataacagtggtgaaaatgagcattgttatcttgctccagttcttagagggaatgctttcaactgtttctggttaagtatgatgttggctttgggtttgtcaaatattacctatgttattttgaggtatgtttcttttataccagtttgttgaggatttttatcacaaagtggtgctgaattttattgaatgctttttctgcatctattaagatgattatatggtttttgtctttaagtctttttgtgtgattatcacatttattgatttgcatatgctgcactatccttgcatctctgggagaaatcccatctgaccaaaacaaatagccccattaaaaaggggacaaaggatatgaacagatatttttcaaaagaagacattcaagtggccaatgaacatatgaaaaaaatgctcaacatcactaatcatcagagaaatgcaaattaaaatcacaatgagaaatctgatggcagtcagaatgtctattattaaaaagtcaaaaaacgacagatgtttgtgaggatgtggataaggaggaatgcttatacactgttggtgggaatgtaaattagtgcaacctttatggaaaagagtatagaaatttctcaaagaactaaaaacagagtcatcattcaattcagcaatcccactactgggtacctatccaaagggaaagaaatcattatatcagaaagatacctgcactagtatgtttttcacagcactattcacaatagcaaagacattgaatcaacctaagtccatcaatggatgattagataaatattagataaatattatgtatacacacacacacacacacacacacacacactatggaatactactcagccataaaaagaatgaagtcatgtcttttgcagcaacatggatgaaactggtggccattatcctaactgaaataattcagaaagtcaaatactgcatgtcctcgcttataagtgggagctaaacaatgggtacacatggacatgcagagtggaataatagaacactggagcctacaagaggtgggaggatgggaccggggtgagagttgaaaaattacctattggacacagtgttcattattcaggtgatgggtacactgaaatccagacttcaccactacataatacatgcatgtaaaaaatctgtacttgtaccctctaaatatatataaaacttaaaaaacttagaattcaattaaaaaatgtaactggctctacatacacacacacacacacacagagcatgtgtgtatatatatgtacatagtttattataaattttactgatataaaagatacacaatttaccaaaaataaataatatacagtattctttatcataagttccatatagccaattgaattgtacagaatgctttgatttttgctgaactgttgtatccatatgcaacctctaattgcaattcagccattatttgacaaatgaagttgaattacaatttggtaactctttcttcaatatatgtattgtgattgaatctgaatcacaatacactcttgtaaaaaaaattattaggacacaaaaaatgtgaaccatgtaaaaacgtacaatgaattgcctcaaaactaaactttatgctctttaaaaatacactgttaaaaaatgtcaaggaaagttaaagatgaaaatattcacactgcatatatctaatgaaggaattatatccagaatatataaagacttaaaatttgattacaaaaagataaacaatctacttaaaatggataaaaatattcaaacattttgcaaaaaaagttgtataaatggtcaataagcaaatgaaagatattcaaaatcactgggcatcaagtaaatgcaaattaaaacagcagagtcatagcactacacactcattaagataggtaaaactgaaaaatactgacagtacttggtgttggtgaagatgtggagcaactagaatgcaaatacattgcttgtcacattggagaagggtacaacaaccactttgaaaatagtcactaagaccaggagcagtggctcatgcctgtaatcccagaactttgggaggccaaggagggcagatcacatgggtcaggagtttgagaccagcctggccaacatggcaaaaccccttctccactaaaaatacaaaaattagccaggcatggtggtgcacgcctgtaatcccagctacttgggaggctgaggcaggagaatcacatgaatctgggacgcagaggttgcagtgcaccactgcactccagcctgggtgacaaagcaagactctgtctcaaagaagagaaaagaaaagaatagaaaagaaaagaaaagaaaagaatcactattaagtgatttactcaagagaaaggaaagcatatgtccattaaaaatttgaacttaaacatttatagcagttttattgaactatcagcaaactaagtgtccatcaaagggtgagtaaataaaacaagttatagtatatacatacaatggaatattgtttagcactaaaaaagaaattaacttacaacacacatagtgacatgggtgaatctttggaagtttatggtgatcaagatagccagacacaaaattatacatattttatgaatccatttatatgtagctccaggaaatgcaaatttaatctatagtgatagcaattatctagagctggtatgggtagaagggaagggtactaactgggaaggggaatgaaagagttttctgttgtgttggaaattatctatttgttggttatggtactcattacataactgttacatgttaagtttttcagaagaagatgctgaattgggggcataagttgtttattagggatcaaaacctgtgaaggaagagagagaaagccatattagggagtggaagttgttgaactatgacacaggaacagtaaaacctctgtcaatctgaagtattgccaataagagtgtcccacatcaggcagaaatacctgagcctttatattctggctttgctaggtcactgggtatggcctgccttaggaagtttgtgacctggaacatgttgcttctctgtatttgagaaagaacctgaagaagctgacagtggatgtaatctgctgactgcattccccacagttggtggtggggattgatgtgttggtggggggatgtgcacatggctgtgttttcagcaatgtgtgtatatatttatcaaaaataattaaactctgtgcttaatatgtgtgcatttttttgtttcttatgttttgttttcttttgtttttttgagacggagtctcactctgtcacccaggctggaatgcagtggcactatcttggctcactgcaacctccgccacctgggctcaagcgattctcctgcctcagcctccagagtagctgggattagagacatccaccatcatgccctgctaaattttgtattcttagtagagatggggtttcaccatgttggccaggctggtctcaaactcctgacctcagctgatctattgtttctaaattatattttttaaagctgattttgcaaaagaatgttaaacagattagatagtaagcatgtataacagtctcggtacacattttatgtacaaaatcttaattatgtctaatctagcagcttaaaaaaattgacaaaaataaaatattggaccaaaatggcatgtaagttgtcattgttgttggcaaaaatggaaatatggttgataagaattaaaatgtattaagatccgtgtactgtttgggagggagattaaggtactgtttttaactttaggttgtgttatgaaacaacattttaatgataaccacctaaaaatattatttggtgtaaaattccaaactgttacaggaaaaaaggatggaatgtgaaaaaagcaataattgtactataatttaatcaggggagagagacaatgagagagaagtattaaaaatttcaaatagaaataaagcagtgagatgatagagacaattataaacatataacaaatctgataaagtaaacccttcccagaagaattgaaataataagctgtcaaaagatatactaggaaaaaaatatgtatcagacaaaatagtagacaaaacggaagctatgatcgcaatattactaggaaaattttacaatgaattattagagataaacagggtcaccacagaataaaaggctaaaattgctagaaatatgtagcaattctaaacttatttgcatatatacatagcctcaaaaaggcagtaatagaaaaagagaaacaaaatgtcataagtcgtatagaaaacaagtagcaaaatggcagacacaaatcctaccttattagtaattatgttaagtgcaaaaagactactccaaacaacatatagaaattcacagattggataaataaaacatgatctgacaatatgctatctacaagaaatactttaaattcaaagacacaaatatgtcaaaagtagaagcgtagattgatgacttaaatataagagctaaaattataaaactcattgatgaaaacacagaagtaaatcattgtgacctgggttaggcaatagtttcttagatgcagcaccaaaagcacaatgtcaaaagaaagaaatagttaaattggacttcatcaaaattaaaaacttattgcttcaaataataccatcaataaagtaaaggcaaacgcagaatgagagaaaatatttacaaatcatatatctgataagacgtgtgttcagaatatgtaaacatttcttataactaaacattaaaaggaaataaatcagcttaaaaatggaccaaggaactgaacagacatttcttcaaagaaaatattcaaacaaccaataagtacgtgaaaggattctcaacatctctaataattagagaaatacaagtcaaaaccacaatgagagccaacctaatacccaatagatggcaatgttaataataataacaaaagacaataacaagtgttagcaaggatgtggagaaattggaatcctcttaaattgctggggagaatgtaaaatgatgcagctgctttggaaaacactctggaaactcctcaaatggctaaatgtagagttagcgtatgatccagcaatctcacttctaattatatacacaagagaaatgaaatcatctgctcacacaaatatttttacacaaatgtttcatagcagcattattcataatagccataaaatggaaacaaccaaaatatccatgaattgatgagttgataaacataatgttgtatatccacccagtggaatattatataggcatcaaaaggaatggagaactgaactgatacatgctgcaacatggataaacttgaaaaaaaattataacaagttaaagaagccagtcatgaaagactacatattgtatcatgccatttatacgtgatgttgagaataaccaaattcatacagaatgaaactaaattagcatttgctagggactgggaaatggatccaatgggcaatgactgctaatgggcacagagttgctttttggaataacaagaatgttctaaaattaggtagtggcaatagttgcacaactcagtaaatattctataaaccattgaattaatagagggaattatatattttctgatttatatctcaaaaggagttatgttaaaaaggatttgaataagctttccataaatttttttttttaattaagcacccttttgtgacacagaatttcagcaatctaggaatagaagggaacttccaaaagttatttgagatccctagcaaaaatctacagcaaacatttctttttttatgggagagaaagttagaaaaattcagattaaaataagaaacaaggtaaggctgactattatcaccacccctggtcacctttgtattccagtttctagcccatgcagtaagataagaaattataattaaagacagatgaatgaagaaaatggaaacaaaagcactcttgttagcaattgatataattttctacacagaaaacctaaaggaatgcacaaattattacatatataaatagtgtttgcaatatggctaactatatgagcaatgtacataacctaatttcatttgtatctaccagcaataaacattttgaaaatataagttgaacaaaatataccacttaccatatcaagaatatcaagtacctaggtgtaaatatataaaaaatgtgcaaaacacctatggagaaaattgtaaatgtttttctgaagacattaaagaaataatggagaattaatggagagatattttctcttcatgtatatgaaggcttaacattttacatatgtcaattatctccaaaaatgtctatagattctatgcaattctgataaaaactcccaaaaccatattctaataagccaattcaaaatttatatgtaagagcaataggccaaaaacagacaagacacttgtgaaaaaaaaggtcaaaggaatctgccctacttgcttcgaaatttattttaaatctagaccaattaagccagtgtcttttattaaatgaagggacaaataaaataaccaatgtaaagtaatagagaacccagaaacagaaatgtgcatatagaatcttagtatgtaacagaagcattgaaatctctgtgtaaggaaagtttagttgttcaataaatggaactggaacaattggttatgtatatggaaagtgaaataaaaccatcgtttcacaccctacagctaaataaaaccaaatggattaaggactaaagtgtgaagctacccaaattgaatcaagaacacaatctcatttataatagccaccccccccaaaaaaaaaaaacctaggaatacatctaaccaagaggtgaaagatctctacaaggagaaccacaaaacactgatgaaaaaaatcatagaggacaaaaacaaatggaaaaacattccatgctcatggactggaagaatcaatatagttaaaatggccatactgcccaaagcgatatacagactgaacgctattcctatcagactacaaatttttcccagaaatagaaaaaactattctaacatttatagggaaccaaaaaagtgcccaaacagccaaagcaatcctaagcaaaaagaacaaagccaaaggcatcacactacctgacttcaaactatgttacaaggctacaataaccagaacaacatggtactggtacaaaaatagacacagtagaccaatggaacaagatggcgaacccagaaataatgctgaacacctacaaccatctgattttcaaaggtcaaaaaacacaaacaatcaggaaagactctctgttcaatacatggtgctgggataactggctagccatatgcagaagaacgtaactaggccgctaactttcaccatatacaaaaattaactcagatggattaaaggcttaaatggaagacctagaactagaaatattctagaagaaaacataagaaacaccattctgtccattggcattggcaaagaatttgtgactaagtcctcaaaaacaattgcaacaaaaccaaatattgataagtgggacctaattaaactgaagagtttccgcacagcaaaagaaactattaacagagtaaacagacaacctacagaatgggagaaaatattcacaaactatacacctgacaaaggtctaatatgcagaatctataaggaatttaaacaaatcagcaagcaaaaaacaactccattaaaaagaaggcaaaggacatgaaaactcaaagaaaggtatatgtgcaggtaacatacatatgaaaaaaaatgctcaacatcactaatcattagagaactgcaaatcaaaaccataatgggatactatctgtcactagtcagaatgactataattaataagtcaagaaacaaaagatattggtgaagttgtggagaaaacggaacacttatacactgttggtggaaatataaattagttcagccactgtggaaagccgtttggagatttctcaaagaacttaaaacagaactaccatccaacccaacaatcccattactggatacataacaaaggaaaacaaattcttctacccaaaagacttacgcatttgtatgttcatcacagcactattcacaatagcaaagacacagaatcaacctagatgcccatcagtggtggactggataaagaaaatgtggtatctatacaccatgggatactatacagccatataaaagaatgaaatcatgtcctttgcagtaacatggatgcagctggaggtgattttcctaacaaattaatgcaggagcagaaaaccaaatacagcattttctgacttataagtgggagcttaaacattgagtacacaaggatataaagatggcaacaacagacactgaagactactagagggagaaaggaaggatgggatgaccgttgaaaaactagttggtactgtgcttactatctggctgaagggattattcataccccaaacctgagcatcacacaatttattcatgtaacaagcttgcacgtgtaccaccgaccttaaagtaaaagttgaaatttttaaaaaggataaaattaaatggtctttatttgcaagtcatattatttcttacacagaaaacaaaaaagaatctatgtaaaattattacaaattataatatggtttatcaatatggctcacaatatgatccacagaaaaatgtaattgcatttatatattctagcaacacacaaaaagcatagctttttgttaaaagataacatttcttatagctagaaaactattaaggtacttgagaatgaatataataaaacatgtgcaagacatccgtggagaaatttatgaaccttcattaaagacattaaagaaggcctaaataaatgaaaagatattacatgtctatgaatttcatattcatcttctaacacttttagaaggagctataagagaatgtctttgtgaccttgggctagcttagactcaagacaaaaaaagcataaatcataaaaaacaaagtttgataaatttgactacatttaaaattaagaactgtggtttataaaaatgtagcaaaaagaaagtgacaatgcaaaccataaacagagaaaggatatttgaaatacatagagcagacaaagttttagtgtcctaaatatcatatgtatttctacaaatcaatgtgaaaatcaaaatgagctagtgggaaggagagagagaagaaagacaaaacaggcatttcatgcagaaacatgaatgccaatttaaaaatacaaaaattttctcaatctcattaataatccagaagatgaaaattgagaacacaatgaggtaccactttatactcatttgattgacagtgattaaattgtctgacaatactaagtattggagagaatgtggatcaataggaattcttgtacagtaatgttgatcatatcaatcagcacagcacaatttctttgaagatgaatttggctttatcgttagagtgaagattcgcataatctacccagaaattctattcctaggtttataccctagagcagcaaattccaataggaatgtgatatgattcctaaatgcaggcctaatatgtaattttgaacattcttgaagtaatataaagtacaaagaaaaaaggtgatattcatttttatatttaatttaaccaatatatccagtacattatgatttcaacatgtaatcaatatcaaaattatccatgagatattttacattaccttttcatggtaagtctttaaaatccagtgtgtattttacatttatagcacatctcagttcttacctgcccatttcaaatgctcaatagtgacatgtagctactgcctaccatattggacagtgagccccagaaaaattcttgttcatgtgcatcaagaaacatgtgcaaaattgtttatggtagcactgattgtagtaaccaaaataagaaataatctatatgtccatcaatagtggtataaataataaatgcaataggatactatgcagcagtaaaaacacatggactaaggttatacaataacatggataaatattagaaatcatgagtgaaaatacaattctaagaatatatgtagaatgatagcattttaataaagttcaatataagcaattccaggcaatataatctttagggaaacaaacatatgtgacaaaactattttttgaaaggaaggcaggtttaaaaaataaggatggctgccttattttgaatctctcccatacccacctttcaaaaactcttaaaatcaccaagaaatatatatataagcatacatgatgcatgcattcagcatttctaagaaacagcaaacactccaaccttaaagtgaccctcaaggataaaaagagaactaattccaacacacctcttgctgtccacttactgttgcaagcttgtggatgcagaaaatgggactggggaggtttaagaggcaccttcaaaaagtgttgatgtgatcagaggacttagatgaggcacaaataaaagtcacccctagaatgtgagcattcaacattgacaaaatattgaacacaggttgggatttggcagttcaaagcaccgattgcaagaaaagggcttgaatgtgtgtgggaccagaaggggcagcctcacatgctcctgtgggagaactagatatatagagaagtgtcagtaccctttagagatgaggctgtgtagcaaaagatggaaataagaagaaaataagggaaaaaagactcactcccttgcaccaacaccaccattgataaaagaaacttcatagtagagggaagaactgacagaagagcattctttaactaggaatcctgtccataaatttaatagaaatagaaaaaagactgaccatgtccataaaaaactactgtaagaaacaagaatataataatccaaggatttctgatggtaaaaattattcccccaaaaacatgaagtgaaataaaattgaaaatactttgaagtaaattatatgtctatgtttctttctcttcaaaaaagctttcagagatatgaaaaaacgacatcattgagaaatacaaaaccaaagaacataaatggaccaaaaaaacctagcaagaaatgaaatgagttcagctcaggaaaaatgatgaaaaaataataatcctacaataataaagactaaattacagagtccttaatgaaatatcagtccaaatgaaaatggaataaaagtcccataagaacatataacaaagaaatattaagtagaacaggaagtagtagaatgggacaggtaactggcacttactctgatgtgtgaaagttgggaaggagttagacaaaagagtagcaggtatcattaaggatcatcacaagccctattgtaggatggagcacaactttgtgaataaactctgataataagatgaggaatagtaagacatgagcctggagtgtatggtaaaagccaaaccataaaagtttggaaaccacattatagactttggtctttatgttaggagcaatgtaaagtcactgaagtatttttcttttttaaagaaatgggcaatacgatcagatttgtttttgaaaaaaagactctggctgcagttcagagcctgtattacaggggaatcagagaagattcagggcaacagatagggggatttgtctagtactttaagtaagatcagtctagggtgatagcagaagacatgaagacaatttgatagattttagtgatatttaaatagtgaaattaactgaaatttgtaatatattcaatataggggagttgaaagacaaggaagagtcaaggatgatacttaagatttttggcttgaggaattgagtagatggggtaccattcaataacattggacactgaaagaggtttagatgtgtggagatgagaagttaaagggtcttcaagatatcaaattggggcaggcacagtggctcatgcctgtaatcccagcactttgggaagctgaggtgggaggattgcttgaggctaggagttcaagccctggctgggcaatatagcgagacctcatctcttactactactactactactaataataataataataataataataaggaagatatcaaatttgatatatcaagcagatcttacaggtgacgtgtaggctagagatttcattgggaagtcattgacatttagatgtaatggaagctatgaatgtgaattagatcacctagggagtgagtatgggaagtataggaggagttatactagggcagaaccttgaagaactccaagattgaagcccagaaagaagagaatggatctgcaaaaactttgaagcatggaccagagagatagaaggaaaaacagtagaatgtggttttacaaaagtcaagggagaagttttctagatggaggaaagattaacagggtcaagtgctgctgagaggtcaaataggataaggatcataaagtgtccccttcagttggtaacaaggaggtccccttgagttggtaacaaggaggtcattgatgactttcataaagctattttgttggaggagtagaggacagattggagttggttgaggaataacaaaatggatagaaaaaagacaaatttttaaagaagtatatctataaatgggagaagagagacaagagggtaactggaaagggtggtggggtctagggaagggtttttaaataaagaagggacttaatgaggcacaagtattgttgagaaagttcacggtgaaagaaagaggttgatggtaccagagatggaatggatggttgatagtataaggttccctagaaggcaggaaggtggagaatgtaaaggtagaaatagtgattgcctcacatgggagcagtgacataatctctactgttgtaaaaagaggggagaattgcagattaaaaagtaggcttcaaaatagtatgtatggtactatcctgtaattacttaaggaacaaaaggagcatgcataagtacaaggcaaaaaatatggagaaatatatgtcagtatgataacagtttggtgggctgaagtcggatcagatgaaaatagtgatgacttggacattctatattgtgaatcattttatttaatgtttattacatgcttttatttttacatgcatatttggtatatgcctttattataagaagatggtgctcttagcactttcatgcattaccacaattcattcttataaatagcatatgaagtcagtattactgttttgccctatttacaaatgacaaaagtaaggatgagaaaagtgaagtatcttacccgcaattacaaaattaaaatgtctttcaagcccagatttatctgatttccgagacatgcttttcaccaaaatgctagactgcattcctgcaaattttgaattttttacagtgaacgtgtattattttgcaagcagaaaaacatataagggtcaaagtctatagtaaacatgatacctctttgattgcccaatagcaccttgttttaggaactatccctctgtcattaccttatataggtttttttttttttctctaacaaatgatacatttctctcatggacatagggatgggcatcttacccggactagactgatctttgttctgcatcccccgtagtcacagtgatttgtacagagaatagctcatgaaccaagcagagccaatcagagttctttcctgagattttctataaggattctgggggaaaaaatatccatctaccttttgaatttttagttacacaaatatagactgggaactaccagcaaccatctttcctgccaatgtggagaacctaagaaataaacagcacatagagatgaacagagctaagaaatgaaaagagaactcagatgacattgttgagcccctgggtccaactctgccagatctgcccttggactttccagttgtgtgggccaatgtatccctttgccgccaaagctatttcaacatgggttgttgttgcctgcatctgaaagagtcctggctaaagcaaaattagaaacaaaactggtgtctagaaagtggcagacctaggccgggtgcagtggctcacgcctgtaatcccaacactttggaaggccaaggtgggcggatcacctgaggccaggagtttgagaccagcctggccaacatggtgaaaccctctccctactagaaatacagaagttagctgggcgtggtggtgcacgtctgtagtcccagttacttgggaggctggggcaggagaattgcttgaacctgggaggtggaggttgcagtgagccaagattacgccactgcactagagcctgggcgacagagcgagactccatttcaaaaagaaaaaaaaggtggcagacctaaatacaaaatttgcttcactgaaatcggctacaaggcaagaggatcccctcatctccaaccaggaagctggcactccttattataaacttgcataccatctggttaaactgtttctactgaaacttgtacctattggttagattaatattatgtaccttttggtctggagctagaaaatgttcaagattatgatgtgattgctactttttgtagcctctagttagtatctgcatggatacaaactttggtcaaagctggcccatgtgtaagcagaaaggaaagggcacaaaactttcttaaacaaggctatatcttgctgcacttaagaatttaagatggctgagagttactgtaaatattcaatgtctatttctcctgttaaagttagagaaagtaggaaacactggtaaatcagactgggaccaggggaggtgcgaattgggggatgtgattccttagctccatcccaaacacttcttactgacctatattcctttccttaataaatttaataattattagcttattaaattctttattcgctattacaaagggctgtccattagaatacaggccaggaacaaggagtaaattacccctgtatcattacccaagctcatttgtcacagatggagactcttcaaaagagacagaaattcttaaatgagggtctaaattaaagaaccatgactgagcagtctctggccagttgatacaaattacacattctccagcagctgtctaaatagatacatacacatgtacatgcatacataaatgctatgttattaggtacatacatagaactatatcttcttgctgaattgagccttttagaattatgaaatatttcctgtatctttccttaaagtatggtttgtctaatattaatacagtcacacaagctttcttttggttagtgtatacatggtgtatctttttctatatttttactttcaacctatttctgttttaacatttaaagtgtgtttcttgctccttgtagacataattggggtcttttttaaaatcgagtctgtcaattcagttattttcattgtttcattatttttggtgtttagtctatttatatttaatgcaattatcagtatagtttgtcttaagtctacaattttgctatttattttctatttgtcccatctattcttcatttctttatttctctttttctactttctttgttttaataaggcatttattattccatttatctcctctattagtctttatgttatacttttttattgttcttttagaagtcatcctaaaaatttcaaaatacatgtgtagcttaatgaagttcaccttaaagtaatactttttctccattcggaaccatgcaagaaccttacaggaatttaaccctagtcacccttcacaccctttcagttatcacaagatatattttacatttaaccccacaaaactttattattgcttttgttttaaatagtcaataatttttgataatgaccaaattatttagcctttcctgtgctattcattctttcttgaagttccaaggagtaattttctttcagctttcaagaacttcctttagtatttttttctaatactagcaaaaatttatttctgcttttgtctgagtttttttcagtgatttttgaaatgttgggtgtagaattctaggttggacatgtttttgtttttcttttgctctttttggcactttaaagatgtcattttatggtcgtctgctttccatagtttctgtggataagtcagctatcttcttatattgttcttctcaggacaatgtgttttattcctttgggcacttttgggattttcactttaactttgatttgagcagcttgactatgatgtacataaattgtttttcttcatatttattctgcttgacgttcactgagctttttgaatctgtgagttgatgcttttcatcacatttagaaaatttccattcattatttcttccattccattctcctttttctcttcttctgggactctaattacatatatgctagacctttgtctgtatcccacatttctcttatgtgctgttttgatttttacattcatttttctcatgaggttcagtttaaattttctattgacctgtcaataggcctatcttccagttgactgatactatcttctgctattaaatctatccaatgggctgggtgcggtggctcatgcctgtaatcccagcactttggaaggccgaggcgggcagatcaactaatgtcaggagtttgagaccagcctggtgaaaccccaatctctacataaaacacaaaaattaaccaggcatggtggcatatgtctgtaatcccagctactagggaggctgaggcaggagaatcacttgaacccgggaggcagaggttacagtgagccaagatcatgccactgcactccagcctgggcaacagagcaagactccatctcaaaaaaaaaaaactatccaatgaattcttaatttcagatattgcatcttgcagttgtaaaataaccatttaatgtttaaataattatttgttgaaatacttcatcattttactcattcaattatattattggtgccccaaacttcattcccctctacttttggtctgggagtctcattttcatttaccagatccattgattcctttattcctctgtttgggaataaaggcctagcctttttttatgattctaatcttagttttccaggaacctgaccattagtttcaagctctccttcataagttttctaaggaaagctccttcagttactgaagcctgcctgttctaataattcagagctcccaaactgggattagtccctccccttttccacttgattccgtgcaagcttgtgtgtgtgtttgtgtgtgtgtgtctgtgtgtgtgtgtatgtgtgtgtgtgttcataaagcctaggcatatttcgtcagggttcaaatgggcataattttcatgtaatcaaggcagctaatgaacatatgggtatctggtgatatgtgaaaaattatgtctattaatttgtaaattttgatacacacaggtgataattataggcattcctgagcatttattttcccaatcattttctgcaattaaagcttagaatttctacaatacgtaatcttaagtactttaatttcaaatcaaatacattatataacatggtttctaagaaattttatccattaatgagtatttacctacctaagtatttaataaaaggtttaatgtttgtatttccgttttcatagcagcattattcataaaagccaaaaggtagaggcaacccacatgtccatcagtgggtgaatggataaacaaaatgtggatatacatgcagtagaatattattcagccttaaaaagaaggaaattctggcacatgctgcaatgtgaatgaaccctgaggacattaaagttaaataaggcaatcacaaaaagacaaatattgtatgattttatttatatgcattattaagagtagccaaattcgcagaaaaagaaaacagaatggtggttaccagggactggggggagttggtaaatcgggagttgtttaatggggatggttttagttttacaagatgaaaaactgctggagattggttgcacaaaatatgttaatatacttagtgaactctacatttaaaatggccatgatggtaaattttatgtttgtgtgttctattatgtttacaacttaaaaatgagttcagtgtttttagaacttcaacatgactgatttgtgtgatagaactgtgaccatataaaaaatactgatgtgaagccaggcacagtggctcacacctgtaatcccagcactttgggagaccgaggtgggtggattgcttgaggccaggagtttgagaccagcctggccaatatggcaaaaccccatctctactaaaaacacaaaaaattagccagctactcgggaggctgaggcaggagaatcgctggaacccagaaggcagaggttgtagttagccgaggtcatgccaccgcactccagcctgggcgacagagcatgattctgtctcgaaaacaacaacaacaacaacaacaacaacaacaacaaaaacctgatgtgaggggaaataaactacaaaatgaaaatgaagcaatgatgatgaaaatgaatgaagaaaaggtaaaagaaaaggaagacttagatatgagactaagaatttgaaaaataagacaataaaatagaggcattaagtatgaacaatcaataagcaataatcaactcataagggcataatgtggacaatatatgttcaactgtgagccataaaatacaaggtattggggacaaaagttaaatataatgcatacacacacatacacactaaatgatgtccctatggaaagatgtctaatatctactccaagaatacaggatacatgaaaaacaaaaagaaaaataaagaatatatacaggagtacagttcagcaacagcatttacatcagtaggtacaaagataaaaattaattgtatttactcacaaaaatatgttttcctctcaagatgtcattgtactcagtaaatgttgcatctaccaaaaaattaagactaataattgtgtttacaataaaatgagcatatagatccataaacatttcattataattatgaataattattaaggtctaccagattagtgtattctatactgggtaatgttaaaatttcagatgtctgttgcaaatcagatctgtacatagctcttaggctgattcaatcaatttgttgagttactagcaatgtgaggattaacaaagggtaaaacattatctctggcatcaaagtatttacagactgactgggaccacatcgatgcactggaaaagctatgaatgtgttggttatgcttcttcatgttttcaggcaaaactctcttcctaatgttgcacttctgtcacaagatgagaaaaggggactgaaggccaggactagtcagctactctcaaaaccatgtcccatgcattatatttttctaagtaattttgaggaaaattttggatcctgttgatcgctcccaggcatcagtaacagttgatcatctaggtggttggagtgtgtacaagcccaaaaaagacaagagaacctaccacacctctatacatttccctctaacccagggtggcagccttccatcacttttgaaagcttctccctcactaactcagagtggggagagtcagtgttagatgagcatcctaaggatggtggaaaacaaactgaagaaagtgcagaggagtggaatcacatacctccaaaagaggtccgagtatgcatttggtgtccacacatgcctctggatctgtagtataaacttctaacttcacttacctgtctctatctttagcaagcattgcttgtcaagtgttgggtactgaggatgagagaaaatgacacagacatagtcctgccctcatgaagcttagattgtagcagaggaataaaatatgaaagaagtaattgtggattcactgttatgataaaagcaatgtggaagtagatagcaagtgtacctaacctagtttaggaaatcaaagaaggcctcctaagagagtgaaacttacattgagacttgaaggctaagatctagctaagtctgagggggatgaggtagagaaaagtattacagaaagaaagaactgtatgggcaaagacccaaaggcatagtgctttcgatgaattgaaggaaatccagagtgcttagaatgatgttagaatacagaaaaagggaaggtgttgaaactggattgtataataactgcttggactagagtaaggattaacataaatttaagaggtaggattggatgtgggaagtgaagaaaaggggaacaccaagtatgactcccacttttctgccttaagcaaataagtggataatggtatcatttattaagatagagaagattgggatagaagcatggctaaaggtgaagacatagcactaagttctgttttagacatgtggggtttgacatgcttataagacattgaagtgtatcagaaggtctgaaggtcagaagtgtcttggctagagatgtgtatcgtggaaatggatgagattgtctttgagtatagtgtagactttctatcatatatatatgtatggtggccttgggctaaaccctgaagatcttcatatattctctgagtagaggaggataagtgataaaagtaaggaggaaaatgagaaatgtcacaaaagccgaaggaagaagtttttattgacttatttgggtttatgtataatacattttattctttgtggtgtattgttctatgtgttttggcaaatgcatagtcataaaaccacaaacaccagatttaagaaataaaacagatttatcatcctccaaaattccctcgtgttgccccattttagtcgacccctgcacctacccatgacaaccactgatctgacttccgctgcatggttttcgtttttccagaatgatgtataaatggaatcatacttccaaattggaggttttatttagttcatcctgttttccctctaatattggacattggatattttagatggagtcgaatatcatgtacccataaatgtgagaccatggggagctacatcaagacgtgtccaagatgactgtaaatcactaaaagatcttgcacttaaaattggataccctggccaggcgcagtggctcatgcctataatcccagcactttggggggctgagacgggcagatcacctgaggtcaggagtttgacactagcctggccaacatggtgaaaccctgtctctactaaaactacaaaaattagttgggcattgtggcatccgcctgtattcccagctacccaggaggctgaggcaggagaatcgctggaacctggaaggcagaggctgcggtgagccgagattgtgccactgcactctaccctgggtgacagagcaagactctgtcaaaaaaacaaaaaaacaaaaaaaaaaacaaaaaaggatacccttagggtatatgtacttgggttgtctctgtatagagggcacaagtacactttcatctgtatatgatataattatattagtcgaagagcttttgtaaatcggcaggctatcaaatagtggaatatagtgttcatgtgttgtttttgtctatccaacatacattccgattgttcggggaaaacactatggttttccttcaaggaaccagctcttgcattctccctcttctccttccccctctccctctcattttcaatccacaagatttgagcggtgatttcccactgcctggttcaaagagtaggcacataaactcaagcctggccaaggagaatgttctattttctggcttcaggaatgggcatgtgacccaaactgatattagcatctggctagaactgtatgaatcagccctaggacttacactggaacaactgggaacaagtatctattttctggattatttctacatggatgcaagggtggacctttcagtgataaacacagaaattacagctgataaaaagaggcagatttctatcctcacagcttgagtgccagcatacagctatgcctgaaatcaaaccactcaggatctgtcaactctttgacctaatatatgtcttcttttcttaaaccaacattattttgaagtgtttcacttacaaccagaagtaccctgacaagtagaccctcatagtcttacaatgtgccacctcccattctgctcatgctaagaatcatttagtgacagtagggtatattttttcctcagtgctgtaggtattttccccttccatatcatgtgggtaaccaagactttattttccattgtttatgtgcttttgaatcagatatgagaacccaactctcatcctgtttgttgttgctgtttgttggttggctggctggtttttaaagcattgccttatttagggaattattctggatagtcctggaagtgggggcagggatagagatgaaggcatggggatggaaacgacagaaaaggcaaaatgggaaagagatttggaaaacttcctgagcgatgtaaaagaccagataaaaggaagggagttcagttaggaacctatttctattttgttgtgtatcctgtaccttctcagtgctctgggggatatggcagaacctgagaaggaaatgtctgggtagcacaatgagtgagactgatccccaggactgtgtctccctgtcttggaagtggaattcttgtgtccaagcttagcatagaggcagtggagtcatctgcttttatttttgtaattgtggtgaaatatacataacataaaatttaccatcttaactatttttaagtgtacagttaagtggtattaagtacattctcattgtgcaaccatcattaccattcacctccagaactcttttcatcttgtaaggctaaaactctataataccctgtattactccgttctcacactactacaaaggactgcctgtgactgggtaatttatgaagaaaagaggtttaattgatgcacagttccacaggctgtacaggaagcatgattgggaggcctcaggaagcttaccatcatggcggaagctgaaggggaagcaagcacgtcttaccatggcagggcaggagagagagagtgaagggtgaagtgctatgcacttttaaacaaccatatctcatgagaattccatcacgagatagcactagaaggatagtgctaaaccattagaaaccacccccatgatgcaatcccctcctaccagccccctcccccaacacgtggggattacaattcaatatgagatttgtgttgggacacagagccaaaccatatcttaccccattaaacactacctattcctcctccctctagtccctgacaacctctattctcctttctgtttctatgaattctggatacctcatttaagtgtaattatacagtatttgtctttctggaaatggcttatttcacataatgtcctcaaagttcatccatattataacatatgtcagaatgtccttcctttttacggctgaataatattctatgcatatattatatttttcttattcatgtatctgtttttggacacttcggttgcttccacattttggcccttgtggattatgctgctgtgaacatgggtgtacaaatgtctgtttaagatcttgctttcagttcttttgggtatattcctaggactgaaattgttgattcatatggtaattctatgtttaactttttgaggaacaaccaaactgttttccacagtggcgtatcatcttacacacttaccagcaaagcactaagtgttccaatttttacattctcaccacctgttacattctgggttttcaaaaattatagtgatcctagtggttatcaagtggtatctcattgtgatttgatttgcctttacctaatgctgttgaatgtcttttcatgtgcttattggccatttgcatacctttgaagaaatatctgttcaagtctttgctcatcttcaagctgggttttgttgttgctattgagttgtatgatactactttctaatcgctacactagttgctggaaacagagcaacagataagacacataacttctactcaaaaaaattcacaagatagtgggagaagcagaaaaaatattttaatacagtgtggtaaatccagtgacacgtgctcaaggtataatgggagtttcaaaaaggagtacattaatggaggtgtggagcagaagtggaagttttcttgggggatatggtacttaaacagatcctcaaatgatggtagccaggcaaaaagggggagcgtggacattccacgcagaaagaaaatcactggcaaagacttgtaggcatgaaacagcagagtgtgtgctgttgaagtgtgtgcttgttgaagcaagtccaaggcaagtaatggcaagagatgaggctggagagttagacagggactggatcatgccagatgttataggctattgtaaggtgtatttaggctttatcccaagacccatggggtgtctttgaaagtttttaagcagaggaggtgcgtagtcaaagttgtgctttagatccaagcttcccaatctcttttcatatcacatcttagtatatgcagcatgataatttttgtgtggcactctgggtgaggtagacttgcagctgcatgctgctgaagacaacaggcgcaggctccagctgtcccgtgcccaacacaactgtcctgagagctaaggttgagaagctgctttagctagatcactctgaaagtcatgtgaagaacagatttagaaaaaaaatcactggaggtagggtgtaaagttaaactaaccaggcatagtagggatagagaaaataattaggaaatagaattgacaaaagtttatagattggagtaaaggaggaagagtcaaataagtttctgacttgcactactgactggagagcagcatatttgagagggaagattatgattttttttttttttttgagacagagtcttgctctatcacccaggctggagtgcagtggcacgatttcagctcaccacaagctctgcctcccaggttcacgccattctcctgcttcagcctcccgagtagctgggactacacgcgcctgccaccacgcccggctaattttttgtatttttagtagagacagggtttcaacgtgttagccaggatggtctcgatctcctgaccgcatgatccgcctgcctcggcctcccaaggcgctgagattacaggcgtgagccactgcgcccggcccaggaagattatgattttagggctgagcataaagttttgattcaattttagatgactggctggtgatgcccaatagatggttattattttcctatcagctctattggctatggagaattgagccacatgaaccaaggaactaattcagtgtagaaaatctaatgtctttaaaaacagccatggcagtgactgtactagagatctaccttcttgggaaagtttcccaacccacagcctcaaagagacaacatgtcatatgtaccatgtgactccaacctcttggccacaactaagtgcaacagagatagcatctgactcaaattgggccaatcagattctctctcatgagactcaggcattggaacccagtgactgagtcaattctctgtggggagtcaagcttgaagttcatatcaatcaatggttttcaaagtgtagtccacagagcattagaatcaaccatctgagaacatgttagaaatgcaaattctcatacctcatatcatagctgctgaatcagaaattgtggggtgggtccccagcaatctttgtttcataagccttgcaggtgcttctcaggttggctatcactcatgaagactcttggtacaaggctgccattctgggagtagtcctgatcaatcactgataagttattatcagtgcttataagtaagcagagaaagctggtttgcacacagaagcaggagaatggagcagagagacacagacagacagacacagagagatcaaggcagggagaaagacaggggagaaacaagccatctgataacttttcaatttcatgaggcccagttgttcttcctgcaactggaaactgaaatttttctatatcattacatgaatcccttttatttgaatggattttctttcttcattataataaaagtgccctgacttgttagttatttctcccccaagtttttttttttttttttttgagacagagtctcgctctgtcgcccccgctggagtgcagtggcgcagtcccggctcactgcaagctctgcctcccagggtcacactattctcctgcctcagcctcctgagtagctgggaccacaggtgcccgccaccacgcccggctaattttgtgtatttttagtagagatggggttttaccgtgttagccaggaaggtctcgatctcctgacctcgtgatccgcctgccttggcctcccaaagtgctgggaccacaggcatgagccactgcgcccggccttctcccccaagtttttattgcatttgtactgtatggctactgttccaagtatcataaaggatactaaaatcaaagagacatggttcttgctcttgagaagccagatttaatgaaggaggcacagagacaacgttagaagcgctatagaggatgtgggaattgagctttgagatcacctggtaagcactaaaaaaatattagctgcatctcagtgtagcaggtgaggccagagaagacctcaagggagtgctagttgatacatacatatgtactagtccatcctcatgctgctaataaagacatacctgagacagggtaatttataaaagaaagaggtttaaaggactcacagttccccatggctggggaggtctcacaatcatgacagatggtggagaaggagcaaagtacatcttacatggcagcaagcaagagacatgtgcaggggaagtgctctttataaaaccatcagatcgcgtgagatttattcactgtcacaagaacagcacaggaaaaacccacccccagtgattcaattacttcccactgggtccctcccaggacatgtggggattatgggagctacaattcaagatgagatttggatagggacgcagccaaaccatgtcaacataggatgggtttgcagagaagaggaagaagaagaagaaaagatgttccaagttgagacgaaaaggcagacatgggaacctatggtgtgtatctgggaaacagagagtggtgtaaggcagatacaagttaaaaataagaagcttaattttccctgttgaacataagggaagagtcttctttctacactacccccttccgttttcttttaaaatttctttctctgtcctttgcaagtcttttttatgcaaatatttttaatagctaaataagtaagcctttcttccagtcttacaactcctaggagctatctttttgaaatgcaaacatcaagggaggtagcaaccctgtcccctagttcccataggagggtaagagcctaactttcatgggccttgctccagtttgcaaaactacctcctgcttaaaatagatgagaaaatttgtttcttcttcagataaagccaacacaagtgacttctccaattatcaccataaagttaggacaaaattttgtgtgacaaaaggtgctctcaaatcctcttgctcaaggactagtcattacttatattgggaacatacatgtaatgggttgtatctgcttggctatattagggggtgagattcctttctgtctttgcattctcttagcaagttacctgtgatgtacatcacattctggtttaatgtttgttcaataataagagtgttttctttctttactatctttctggagaagatttctggattgggagaagatctcttgttttattacatttccccaacagtgctttaacttgcctggaatgtacagtgatgaagtttttccttgattaaactttagtcagattcctctgagtcctcttcccaacttggcctcaatgtttacacttccatgtttgtctttgcattgctcaattttagcaagaatcttgccaagttggtttagccagaagcccacccttgatatctgatcaggtttctcatcctctaccaactcccagttgatgtcttttcaccctgacctgtcttcagcaagaatcctgttaggtcaggttagccagaatccaccccccaccccaccctgccccttatctctgatgtttcctcttagtaatcttccatccactgtcccctaccctgctccttggctataaattcccagttttccttgttgtatttagaattgaaccctgttcaatactgaaatctcttttcccatatggcaatagtcctgaataaaatctgtttttactgtttgaaccactgttcacctttggcttgcttttataacacattacagaaggcagaggggaaaggtgaagggcacgcccaagggcagagcacgaaagagtgctatgtcagagtgtagactattccatagatattgaggagctgtaaagattttaatcaggaatcgaaataatccaccatctgactttaggaaaatgactctggcagtaatgtggaggatggagcagaaaggagaagggtcaaatggcgcagcactgaatacattcataatcataattttccaattattttttagtctgttattactaaaaaagttattcttggactgacttttccctaagccaccctaacaatatctagagctgtatttttttcccccataggaacatttctccagaatgtggagagtagaggacaacatgttgggatgcctgacactccttggatattgttcctgagtggtttgggtgttcctctggatccagaatttcatcccaatgacactgagattccaggcttctttagtatttctgatggtgtccatcagaagaaaggagttgcttattagagtgttctctaccgctggcttgtagttcagtttatggtaaacacttgcttatcactgaggttttgtatatgaattgtgaaaatggggtgtgattgttagaacaaataccgcttgactttcattggcagccctttctgtgagccccaaattatgaccactgtttgcagggattcttatgggtgcaagttttcctagtataactacccgtaagtggatttaacttgggacttttttcatagaaattgagaaggactgaaacactttgaataaactacacacacatttattaaatagtgaaatggttaacaaaggcacatcaataaccacttactatatatacagaaatatatataattaacatggatccaattatctcataactgccattttttccaacaaagagtcattcaattcttcatgtcatgaaggttaaaggcaaagtcttagtccccatcttatgctttcccaccctcttcttgaaaactacattgaacctctatgggttaatcatcgtcttctgtagccataaggtctctgcaagcatgctgactgcaggctcctcagattctttctccattccctcaagtccagtttttaatgaacaggctgtttgctttagcaggtgctgttgctggtattcatccagttacactatgattttttaaaaataaatctttccttgtacttgtacatgcctgcattgcattgcatcacttatgaagagatagctccctctctcatcaggaaaactggatttgtgtgtctatgtctgttgcactttgcaccggatgccctgcctgccttttcactgtgttctttccatgcacaacagaaaaatgctgggctgcactggccagaactgccattgtatactaatttctgcatccactttagaatgctgtgcttttgctttggacatgtttgtacaaatgggaatcagatagtctgtccctctcacaaagctatttcctggtggctgccctttgtatccaaaatcctctgtttggagctcttggcttttattccccagacacccactgtcctcctgcctaagggagtagtgtaagtcaggcactgaacagaaaagctgggaaggtttagttaaatgcgcatttctagtacaggaaagagccaagtagaaaatcagagaatgtgtgtccatctgttaaagtttaacaaatataggctttaaattactccagaattataatcatacctcaggcctgtcattgtatcatgccctctacagatgatgaccatgggaatggattctggtcagtggaattttaggatgttcactatctattcagtattttaggttcattatcatatcagaactttccagataataacaaaattacgagagtgttcattttttggccttcctgatgtggtgaatgactgcattgcttataggaattccatctctgcacctaaacactgagattcaatgcctagaagtttgcttaagtaaaacatatttcccttatctatgcatgtaggtgtctgatatttgcccattggaaagtcatgcctttttaaatgtgaacacttccaggacaggcagtatactaaatacggccattcttgaacaccatagggtaatttgtctcttagatctcaactatgagcagttctccatagtctgagaagcccaacaggaaagcacttaaggggaaaagtccagatctatcagaggaaacaggcctgataagttgctatcatgaggattttccagggccagaggccaccatgagggatgagaaaaggatgctgtgaaaagaatttgaaaagtacccaagacaaacttggtttacatctggttttgcctgtgggtcaactttcttccagccaatagaaactccaagtctccaatttgatgatggtcgggaatgcttgccctgaattcttacctaacattcagcagcctcaaagagaaagacattaactgaattctgaagaggcctaagacctcttgtaaatgtctatatactgaactgtttttagtgctggtattatcagactcacagaaacacctacaaaacattaaacggctcaaagtgggcttatcaagaaatgccatcatgggaaccaccttagaaatagtaaaacagggcacaaggggcaagagaactatgtatagggcagctgacacttgacaaggacccaacctcctccccgaccctcttcactgttaagagacacatcagtaatactttgctctgccatagcctctgatctaaactctcttcaccgcagttttctatcagcccaactccagaacagtggtcaatgcagagaagttccagattcgcatttttgaagcattttgaaataaggcagaataaagtattactaaattacatttactttcttaaagaacaaaaatgatcatccttttattactgtgccatttgttgaagataaccaattttaagtgagagaaaacattttaatggaaaaattcatgcatctcattgttatgaaatgattgatgcccatctggaaagtatgaaataaacaacactggtttcatatgttacactagggatgcaggatagacatgaataactgggaaagagaaacttctaataatgcatcttagaatatgcctcaggatttctgaggcacaagagaaactagtaagcattctctcaaaattttaagtattcttttattaaaatagaagtgtttttcttgtgtcagtaacttcaatcttataagagtaataggtctaacacaacggatatattatctacataattcaaaatactgatggtatatttggaaataaatttactctatgtatgaaatataacattgagccaaatcagaaatttaaatttcattttagaattactaaatattaggattaatatactagagcatgaatagccttcaagtgaactcctaatgtgtgaatatggattcataaaaaaagacataaccaagaagtttatgcattttattagaagaacaaaaaataaacatagaagtagcatactaaaatgagctgcataatgtgcacttttaaacataaacaagcactacagcactataacttgaaaaaaaatcaaagcgtctgcagttgagggaatgagctattgcattttggaggaaaattactatgggaagagttggtactcatgaaatattctggtcattatttaaatatgttacacatggctaataattttcttatatatatttttaatcgccattttccacccaaattatgtgcctccatttttcacattattccaaattgttgttatatgaatgcacaaagttagtcctttaaaaaagaatatatttaggaaaatccttcaaaagttttttaatttaaatcattgtaatttgggagcatggggacaaatggctcattttctgttaaagcagcaacaataatattaaaatattattaatattataatattaaaataatattaaaatattaataaataagtttattttgaaaagggcattcattcccataatccagtgatatgatggtcatatcattctctcaactgctagacacaaaagacatagcaacaaagtaatttgtttccatcactaacaaatagcatctctacacagaaataaagctctggaaccatgcagttttatgacagataaatctttaggttgtgtgttttcagagaaaaaagcactgcttaatagttaggttacttttaggtcttgttacagaggtattttttaaaaaactaatatgatgtagatgcctagcaaggattttgcaatatctgcaaagagctgcgacttatttcatagtcatacattttttttacatataccataattgtggatggattctatttaaagataaaatttctcttcaataatccagcttttgagtattagtgattctcttacaggcaagaacaagtagaagagctggaaactgcacaaattagtcaaactaaatattttcttgaggttagtaatagagggctttttttgggggggggcctcagttacatccatttgttttacttaattccccaatttgtcttatttattgaaacacagcctctatgttgaaactccagagtatgaccccgtggctgtcagcatgcacaccatgccatctattcatggggtatcttttgtgatgcttctacagttattcctactaatttataggtgatttttcctgacttaaaatgtcgtatctctattgaccttagaaaaatacattcttgaatctggcatattcacaaagaaatgtccatatcagtacataggttaaattgggaaattatgttggagataaggctgaagttggagttcctaactacagaatgaaggaatgcttacattttatatcaatggaaatgctggtcagattgtcaggctgtttgttgtatggctaactctaagtgattatgggctgagggaaaagaaaattctagccaactggccctgaggtattggacaactgtaaggcttggattgctttctggctttggcttatttttctttctctgtaaatgagaactatcaaaacgagtagcaataccaactccaccaaccccaggatgggttccttctctaggtactacaagtacctgtagtgatcaaatgcttaacctttctaaccttgacctcttctaggcctcattgcctgggggcaaaaagaaagttaactggctatctataggtggcgtgggagctaaaattggcagagatggtcagattgaaacattgtcttccagctcctgtgttacgtaagattttggctggttctcttctgtttagttaaaacaaaacagtgggaggctgaagtggcacagttaactactttgtaatctggtaaaggtaggtcaaaaaacagcttccactgaacaggtataatgtaaatgaagccagttataaagttgtgccaggagcattttttttccctttgttgaagggaatgaacggccctatgctggccatccttaactgttaaatatcatctttcaatggttaccgatttggttttggttactggatcttaaaggaggaacaatggtcaacattaacaatttgtcacttaaatacctattaattgataaacattttaactgacacatatatcagctgatcactttctgtgaaagatgaaatcttattctatcataacggtaatatctatcttgtaatacatgaggtatttcactgcttacaaccactgaaaaaggaaaacttgttctagaaactgcccggtgtgtgtgtgtgtgtgtgtgtgtgcacacgtgtgtgtgtgtttataggggggattaatttaaaaagcaaacaatctttgctaatgatcttgttaaaagatgaagttattctactcttgttcagtgctgttagctgaggctgacctgttacctgttactagccttctcttttggtgacctgtagcaaactagaaagcctccgtaacagcaaagcaacattatgctttagttaagtcttagagcaaaaacaccctccttttcaaagccttagaaataactctctcttactaacttttccactattatcacagacttcttacatttaaaaaaagctccaaggattgctttcatggactatgtacataagtgcaaaaaaggtgtgtctcacacatccgcaccctaactgagacagtcaattaactgcagcatatgtttcttaaacactgttaaggggtcattccacagtatctttatgtatagttttaaaaatatgaattaatttcaaaagaggctttagtcatacattaatcctcatatagctatatttgctcatgtaattccagaaaacagaatttttgcagctacagctatgccacttgaatggggtaattttgaattaagttataaaaaaagttaggtaatgtattaaaaatgcaatgattgcgttttgaagtctaaatactgtggaataaccctatccacacaacaaattctataaactataaagcctgattctagaatccatgtgttataaactttttcacaaaaagtcacacaaggacacaaattcagcttttatatatgggcctttgggattaaaaaagaactcaaccatgtctgttttcatagttttgagctgtattttctacaggctcatactgtcacaaatcacctatagtttacaagtaaaatgttcacatacacaaatgtctaaaggtagccatgttgtaattttgttgccaaagcaacaactaaatataattagataacaattattatttgtatataaagttaaatttgttcttaaattgtgaactgtaaaggatagttttggactataatctgtatcttgtcatacttcagtgtcagttcagaacctagctaggcgggcagaatccatgcagtaaaagcttaaactttctttaactttcctttgaaattaaattgattagttacttagagctacaaaaaagcaataaaatgaaaccttaaagatgaacaataagaaaaatgaaaatatggtaccaattagtgagttatatttacagtttgattaggctagtaactaaatttacaaaaaaagttgttatactcttggacatgctatttattctagtgccttctacaggcactggttaaacaaggctactgtcttagtatatctattcatcagaattgggaaatcagatttccctcataaattttgcctatttctgtttcaatgtatgtgaaatgtatttgagagaaaaataatgaggatttcagtttctaatcattctgtacctcatagcctaccctacagactaaaggaactcggaaaacttgtggctgcattttacctaagagcatccttatctatactctgcaatgagggggacaaagaaccaaataacatttcaagtagcacattaactttctctcttatttaataaaatgtaatgtaaatgtcattccttattcagataccactatgcttattggtaatgctacttaaaacagattcaagttgcaaagattaatttcattcagtttctgctgatggtagggaggaggtacttgctttttcccaaattggagagccggtgagctgaggccctcccattagtgaacaccacctagtggtataggacaacacttatggcaagatcaaagtgcttcagcatgttcaaaaacggatgaaaaaaattgatggagtagagagaagatgactttccacatcatgattaactacaaattaaagcctctgatctagaaaagtgaaataaaatgccacagctggttgtggaatcatgcttcaattacaaaagtaaatactgtatttaaatagcaattttatgaatccatttattttaatttaatcttaatccctctttaaaatatacgtatgttatggtcacatagtacttttttaaaaagttgacactactaaaaccctcttaaagataacttttagattattttctctgtatacatgacccgttttatccaagtttcagcactcttgcatattttttgcaaaaggctgagaaaaatggacaaaaacaataaatttggataaatagaggcccctgtaaaatacaaagcttataaaatgttaactaagaatcataagtgattagaattttatatatacaattcatccagtaaatttttgtttagagtcactgattagttttgtgacttgtctttttaaatggaaatttatagtctaatgacttatctttcttcttttctcttttcttgaataaagataatttgaataagtcattgcacatctagtttaaagagtgctatcttaaaattgtatttttttctgaaaactctattgaatttgatcaaaactttagggctttgagctttctttctttaagttcatttagaaaacaacttttaaaatgccaacaatgtagaaaattgtggcaccaaaaatacagtggccctaaatacccctcacggaaccttttactttaaggtaagtcattgttaatgtcttccagtgcttaacgcaacatgaaaacagctgtactgtaggtctattatctatggtttatgtatatctttgcccaaagttgaaaaagttaagtgagacagttcactgcatgcagatgtcaaactacacaaaagttcattttgcacaaaaaagttcttgtctcctttaaggaatatatccagactagctcaggtgcatccctcctggattcatgtaatcagatctgcccttctggagaggcactggcacggatcatacaaaactcagttccatacatgatgaatttcaaaaaggcatacactactttcttctatagcaatgttaagatttcagaaatagaaattaactggttcaaagagtccataggtaaaggtcaggacaactcttgatctctaattccacgcaacattgtcaacagctgacaatgactcaatacaagcaaggctgtttagaaagcactgttgatcaggatttggatggataattaagatcaacagagtatcaattcccagaaagctaattttgctctcttatattctgagccaaatgggtctgctttggaagagagcatcaaatgttctgaagcaaaaacaatgtgaaaaggaggaacaatgggaagcaggagatatttctgggtcccacaatggctaaggtagccttgggcaagtcatatgcccctggattcagttccatcaactataaaaaggattttgctaattccattgttctgtgattcaaacacttctagccagcttaaggtatcctcaatcagatttgctttttacttgtcattttcatgaaggagaaaaaccattatatatatatatatatatgtatatgatggttttatactttctggtggaagagcgcctatttactagaaaatattaaatctattacttgatgtaaaatgtcatgtgtttccaccactgtataataacattaataaatgagtagagtggatgagatatgtcacacaccacaggaattatttggttgtaaaattctttcataaatattagtaatgtgaactcagctgagctctgtggagtatagccactctgtctcattcaaagggtgataaaaccctttctattgtcattttcaaacatatataaaggcaaacgaatccaaacaagcataaaagaggcttggttatgatgtgagagggtctgatgttaaagtttgggcagggggacacttgccatatatcacaggtgctttctccttcactgaactgtttaacaaaacgaaactcagttgaaccgaagctaaagacaactacaaccatctttcccagttcttttgaataaatcaaggaataattgtaagtgcttccctgttccctgtcctagccatttctccaagcctgtactcaggctccctctgtgatcaacagagaagactgtccatttggggagggaagtcctcatttgcaaccaattctctttcaccctgactgacttttgctagattgcatcttacttgttattcaaagagtagtctaaagagcatgagccatttgcatttggaaaatggcatttgtgtaaaaggtgacattgccatggttttacacactttcctccagtacgtaaaaactatctccatgcccccatctctccgtttgatttataacttgtaattagcatatttttaagctcccaagtaccagtttctcagctgaagatgacaaatggctcagttttagacactcaatttaggagatgggattctcaagccacacacacaaaaaatctaatgagcactttacataatttttagtataaatgctgagaaattcatttaaaggtaaagtcttatttgccaagctatttaagaagagtgaattaggggttaatgttttatgaagttctctgctttgtgcaggtaattatttctctctttaaaaaatctagtaatttgattgtattatgcaacatcagatctgcaggtacaaattatacacatgcatgttaatgagcaggttttgtgcacattcaaaagtgaggcgttttaaatgtcagtcccaagaaacctacagaaatattctaaagaaagagagcatatttgcatgaacctgtcatgttcttaagcacatatacttctgttccccactaataacactttagttgaaatcaaacaccacacatatacagcaaaacactacagtatgtaaaaacctaacacagcacaacacaatacaacacaagaaatggtactgaatatatttgttacatcctgaatcaacccaatagactatcttgtaaacaaaatagtaaggtaacacttcaaaaacagatgaacaatttatccaccaagaatgtatatagtaagccaaaagctcactgtggaaatacacttagcatggttattagaaaatcacaaagagtaatgtaacaagttaccaaattttatggtcatgttctgcttgataattcaaataggatggatggtagttactagttttctatttgtgttgttttaacatctccattgatttttaatgctttattttttatttgaatttgctggctggcaggtttgctttgcttaatacattgactgcaacacgcttattgttgtgttggtagaataagacatacgagaatatatatagaaaggccatatggaggtttccatggaaagattctgatactccataactctgctgttcagaatttcagctgaaatggaaaaaaaaagaaagaaagaaagagtgagaaatattgaaaggttattgaaggaagagtcaggagagtgtggtgggtcttgttccagttctgtctgttaacagtgccaaaatatccccaatctgaatttcagattgaaatggggcttttgagaatgatcatgaaagaaccatatatctatgatagtctatgataccctttgagtgctaatgtggagaactgtcctaacagagatgcaatccaatgtttaaggcattatctatctactttttgttgaacatacacccatgtgtccacctttcaacaggcatgtactgagaaaacatgtttgataccgaacattttgaaatatgcaaatattaaatacactttcaactttttctctgaatgttttagagccatgcagaagtagcctacctgtgaaatctgggtattgtattgtacaaaattacatttttgaactttagaggaatttttagcacctattacatattgaagtgattatgttctgccaaatatctctacatttctaacaaaatcaagcaagaaggaatcactcttccctaacatgctctgttggaaagttaatttgacaacttgtggttaccttgacgtaaagcagcccatgaaagttgggcaagtgttggcaaaacctacattatcatgtttagtgctatttccaagttgccactatcccaaatgacacctctggaaacaatgacaatttatagctccttcagttatcccatgtgctcaaaggtgccttttaaaatccttccttatgattgaggagacctatttatttaatgtccagtcggctatctgctctgtccagaacacttagtgttctaagcccgtgtgtcctcagcaggaaagaagggctagctggggtctggggaactagttcacgagggaacagaactgctgcctccttcaaccaaatgacacactccaggtgtgagaacttcaaactttcgatgatgaaggtatgcaattcagagttggtacactattttagtaagtccctagaattaattaaaatacctaggagtcttaagtggcttcagaaatcacatgttcttaagtgaatgattgcttaaaaaagtgtgtgccatgatgggcaccaggcaaagaggagattgagggtgaaggagaaaaaaaaaatcccacaacaacaaaaattttaaaaaagagacatgattggaatgaaaataatgactcagttactaaattatgtcactcaaaattcaatacaatgtcacatgacaggcatagtgcttactgtgtttaacataatcatatcagtcaaatcctgaaaattcttgtttgatcttcaaaaaaaaaatgaagctataaaatggttaaagaattacaactcaaaagtaatctgtgcctctggctaacaaattatatattcctttaataataggaaaacatttaagaatgtgttagctcattgagaaaatacagtaccagctgtcattgccatataaaaaatattgcatatttgcactcacatttcaatttggaaaatttataatgtgtaaatcaagctctacatcacaagcaatgtctatgaatgaaaatatttacgaaagccttttagaagtgcaattgtgtaaataaaatatgtagcctataaatattatttatattaatactgaaagaaacttactgttctactgagaacttctacatctgtgaaacaaacatgctgctattcagttcatctattgataattggggtatctatagtagtaaaaaagattttagattaaaatagtttcttgggagaattctgtttatgttgttatatatgtggatcttttagtctataagcatggttcccactttaataaggcaaaatggccctaatactatacaataattattgtatgtatctccttataatttcaagactccccccaaacttataatctgccttgtgaactctgcctagaaatacctaaagcaaataaaaatcaaaacaacaagcacatctaatgtccatatgagaaggaacttctgatgtaatcactgcgaaatgataaggatatccatgtcttggaaagaaatgtgatattttgttttctctccagtggatctgaaggtaaaggtgatgactgtactaagccaaagtttaaacacaataatcaaaaatggcagtgaaataaattctcttgaccaatgaggaagcatttaagtaacattaagtatatacatttgaggattggtgtgttaccagtaattaaatatagaatatcaagagcaacatctggtaaccaattaaaaatgagcaaaactcctctgattcatcttgggatgaatagcaaagcacatatagcattctagaatatacacaaaaataaaaattctaaatgtgacaatggcttaagaaacacataagaatctcaccaatccaaaaagcatatactgtgcattaccaaaacattgtagttatcttgatctgaacagcttaaataaatggccaaacctgattgcctgtagttggtgcagcgaacggaacgctggtggcaggtgttgttgctgcagacacagtggtaggtgtagcaccgtgcatcatgggcactttcagttgaaaaccatagaagcaacacacgggagggtagaggatttatgcaaccataacatttacgatggaatgaggtgtggtaggtatcacagcaacaagccatgtgacatcataacgatgaatacatcagggtgttcatgcaatcacagtcagtgcaaagcaacacagcatggaaggggggaaaattaaaaagagaaaaggggaaagccaattatagttaccaatatggaaaatggaaccattctcaacatttagtaagtttttgagcagaatcccattgtagtttactcaaaaggctaaattttcagaaggggctataatgaatgcatatgaaaacaaaaatccaatgttacaagggctatctatctgaagctagttaagcagacaagtaactggactgcacattcaaaatggaattaaggaatcataaattggaatttaggttcactgacttatggacatgaatgccgtcactagatttgcaggtgcaaacaggcagttatatgtatacttacctgatctgcatgcaaagacatggtaggtagactggttggtatgtggtaggggggcagatatgaagaatacagtggactatgcatgcaggtttttaagtacacctctggcaaactcctgggaaactttggccatttatcaaacaaatacatggagtacttcacagtaaatcttgtcttcacagcaactattatagctacaatggttagcagctgtgaaatctcttgcaggatgttttatctttgccttttctagtttctatctcatttagaaagcgttttgggtgctttctgatgtctagctcatttcagaaagcaaaccagggaattaatgtgtgaatggcaatgtgtgaatggcaagcatgcatatgtaataatttatcatgtctacatcaattaaattcagattttctgaaagtctaaagagaaaatgaatggccagagaaaaattaacatgtgcaatgtcatagaaactgaaaatgtaccccaaatggtgattaacagaaactccatagttatcccttccatttatctctagttacccattacccagagccatccctgttgtctcatatgccaattctaaaaacactcttgttttccctttgggagtgcagcaattgtacaggaagcagatccactaaagaatgcagtttgcattcctaagcaaagctctgaaggtgaaaggacaagagagcatcttcaagaaaactgtcacaaaacatgaaggcaaagacacatttctcaaacttgcagaagtctgttctaattgtacacattatgattcaaaggtatacatattgtgctcctgttggtattaatggaaatgtttattaattcctacagaagacagtcaaaccctcagtaacaggggcctcacttccattcccagggttcagatctcgctatgttagtgagtgctgctactatgtggttgtcattttgaactttattctcaagaagcctgttagtagtgcttttggggctctgcatctattctggtccaccaaggtgacaaaggtcaatttgttgcaaactctcaaaagggaggggatggcctggattgatgtgagacggtagagtgggacgggttgggatcatttctccttgcatagaacagagctattttctcctggtctgttccttgtgcccatgaggactgtaggagctgtgaactccccattcctttctcatgctcttcagtattagtgctgtataaaatggtttagagatggctatcatattgtgttagtggctaacaaaaggatctgtgtgcaactgcttgttaaaaatcacgtaacactcaaagagtcattttgaaatgattctgttgtgcctagcttctgtgccaatggtgcttcaggctagaacactacaggattcattacagaacactgcagaatcctctggctttgctgaactcatcctctcgcaacataggaacattgaatgctttaagtcctatagataactttttcaggtgggaattgtttcattgtactttacaagttatacattttaagtattttacaatttttaaataatacatgttaagcaaagaacaaaactgcccagtctggctagtttcaaatattgtaaaagaaacgattttttaatatttcagttgctgttgttagggtagaaatagagaaatgacagggccagtatttggccacagtggcaaccaactaggacttgagaaagtaggactattttgatgctacaaagacataaaacagaaagcaccatgttaaaccttaacatactcagaaaatttccagccacatctttcagtcattcatctttcatagtcacaacagaaaaacacattttttcagattagaaaatgttgataatttttgtagaaaacctaccaatatttgaagcgggtgccatgcacagtattggccctgtacaccacgcagaaaagcgtggaaagtaaaagagatatttgattattaaggatttactgatagaaatacattttaacagaaagattatttctttgcaatatcaattactcagcacatgcaagtccaacaatctcccatgtttacaattacagattagttttaaggtcacaaacccaggtaatcaaaataattcttggattcttaggtacaaaatcagctataatttttctttaaaagaattaactcacttaaattacatatttattgtggacaaatacatcctaaataatttttataataagagaattttaatttattacacatatcattttctaaatatgctccagaatctcgtatctggtgtccgtgtttctatttagagtattaatctgttaacactgtctcctccactgtctcatagtcaataggacttgactatgaatatatggcaaagaggttccattaagagagacctcttagctggacaggcttttatgttgctactaattaagggaaagggaatttttctgacatttttgcttatgaaactagattttatgttggccaaatctggcaaaaaattcaaacttggaaacaaagtaactgtagtattaagaaaaactatgatgaacagcatacattttattatattcaaccaccttgactagacttccagggctactgaattcattccacagctataatacaaattggaagtagccaaggtagagtgatctaatgtgtaggtaaattaccacaatttttgaagaaaaaaaatgctaggaataaagtcatgtcaactcatactggttttctcttttactctgtagacattatgtgtgtttttcttaggttgggagaaaatatctaaattattagatatcagtagttacttattataagggatgtaagaaagtgctgaagaattccatatttcctctcagaaactatcatataaatgtatacaaattgtataatttaaatgatggcatgaaggactgctgtggctagtaactaaagactggtgttttatggtacctttcaaaattaattaactgattaatttactagttaaccaataagttttctcaagtctgggtattaacaaggatttctaaattattttttaaaacatatgttattttcatttaaaaatagtttccaatcttgggcatttaccattgtgtcaaaaaaaaaaaaaaatggaaaaaaaaaactgctgtactctcaatggttagaattttcaatttattcctaagagactatatgctcattcttaaactactaaaccactggaagaaaattagtttccccccaatatatgatatctaattgaacaaatttctggcttaacattttctgttcaatttcatgtaaaacaggctattaaatatagctgaatgtaggagataacaaaatatgctgcaaaatgtcagaaaatataaactgctatgtattttatattaactgattcaggagttacaggctaaaactatctgtttaatctatattatactatattatgcacttagggtagttttattttaactacctttggcatatcaaagacatattgacaacgcatttccataatatcgaagctgggagtttttgcctttttatttgacagcactctactgtctgtgacagtgatacctaagagtcaaggaattagtttgagactgaaccaagtgaattaatcataagcaaaaaccaacaaatgctaaaaagaaaaatgttgatactttttcctagtttgatttcaaaccatgaattttcatgaattatagaaaaacaagtagttctagatactagcagataagcataacttccttgttttatttttaatcaaaatacatgtcgacagtcctcctatacaagctctttgaaagctgttttgcattgtatacattcacaacatcaccaaactcgctgcagtgcctagagctgtgttctcacctgcagggataaatgccggctgtgggagctgcaggttagtcagagcctgttggcagtggaaaacagtgggattaaagaccggggtggcaccattgggcttttccagtgctgatctctttggtatcagttgcagtgtaccaggctgcagggcctgtggggggagagatggtactagtactagagaaagtaacaaatgtactcaaaccaagcaagcaccagtcatataaggtatttcctgggaatcctccgtaagggtatgcattgggcaagacactggataagcagtggccccacagcaaggtaaccaaatgtagagataagggggttcacagccgtgtacagtggctcacgcctgtaatcccagcactttgggaggctgagaccagcagattgtttgagcttaggagtttgagaccagcccgggcaatatggcaaaaccccatctctgaaaaaatagaaaaagtagccaggcatggtggtgcatgcctgtggtcccagctacttgggaggctgagacaggaggattgcttgagcccaggacgtcaagactgcagtgagctgagaccacaccactgcactccagcctgagtgacagagcaagagcctgtctcaagaaaaaaaaaaaaaaaaaaagaggtagtccaactacatgagcagtagtgcaaaacaaaaaaaaatgcaaaaaaaaaaaaaggttttcaacttcactaatttagacctcatttgggcaggatatgacagaaagctactacagtaaacaatcatttataattaatatctcagggatactcatctatgaatctataaaaatgagattagcagaagcaacagatatagcaggaaagagatttctgcctgttaaaactccaatacagatctaggacataaatggcatataggtgataaaacagatgttggtagatcagagtctgacactgtcaccccataaaataaaatccagtttatacaaagacttcaggttcaagtcctataattatatatttcctaactaacatgtaaggaaaaagcaaatgaatatttcctcccccacgacctacctcacgcaggtactatgtagatagttagcaaaatatatgcagttcttatttatagaggcttgctgtccatttcggtatgtaccatttgctttgttaagttcttgtaaggtttaattctaaaacctattagcatttttaaaccatcctttcatgtctacagttctttcaaaatcccactgtgcttataatactccgtgaaacttgcccctggatcagattctttggagaagtttaacattactttacattttttttttctcagcaaattgcacgttacttaaaaaacatgtcccagcaacaacaattaggtatgctccaaattcttaaggaaacaggaatgcttgtgttgagtaactatcctaccatgtgtccaaaagggtaatgccatgacctcgttcctgtggataacaaaggtctcaaggtatctctattttcttttgggaactctactgtcagtgcacacactgtgacagatctgcttttcatttcacctaaataaagaaaagcatgctagaagagtgagataaaataaactgagtagctttagagatataaaatttccaaatttatcccagcagaccagatggcaaaggtcagtactaaaatcataaaccataaaacaaaatctatcatttcgaatgccttttattaccattgggagaaaatggttttgctgaacattttaactaagacagaagacctacttatctggttgttaaaaagatttccctttggtataaacggggagtgtccccttctctctcttgaaagttggcagcatggtatgatcatcagaaccagttatgttccctagtaaactacaaattggggtgaaacctagatgaacattcaacaggtagacgctggtaaggtagtactgcttgtttatttatggctggggtttatcctgatgggtcagtgcccagttccaattgggtggtgattgtactattaaactcataaacctgccgaagaggtgtgagactgtggatgaactaagtatcaaccctttatgtctctctctttttttttttaaatacaagctgctttctgtgaactcaacctgagctatatacatgaacaaggtaaaaatgtctcttttataaagcatgtccactatgaatccttaaaaatataaaaagcttgaatttcttcatgaagccctcctttatttaatcttacctctatcaaattcttatgagccaacttgatctcactgctaagaccctgctgtgatcagttacttaaaagggaattttatattgatattcacaagtaacaattgaaggcctatgatataatatttagctctctacgtggaaatttgaggctgacttgtaacctatgcattctatcaaacacactcaaataatcagaaatggacagatgcatatgaagctattttcatagcttataattaccccttcaaaagcatttaagacaaaaagaatttggtaaagtcttttttaacattcattaacagattatgttgttcagatcaagggagaaagtaagtttgttctactttggtgctcagatccttcacgatgtaatgagttcagttctgacaaaaagtggagccagtccaaaaatggtactgtgtccttgaaaccataaactaccaggaaaagggagcaatttgcagtatttggcttagacaggagacatgagagtcactctcacttggaatagggactgacttcttttgtgaagttccagttgcagcaagataaatttcaactcggtatgaggaaaaccttcttaatagggatgtttgaaaataagtgtctctctgttgtgaataggcaaagtctctgtcatgggagtccaaactatgaatgtttgtgaggagatttagctcacagtgcatctcctgggcttcagggtcatgtcagtgctttttccacacccagggaacatgaggtttcctgtgggttttgtcctttactggggctgttatgccttattacacaaggaaaggtccagggagaaaaagaaagacatagcaagcagcacatcaaaacaacggacagctgtggcaaacttaagtcacgagaattcctggttctcagtgatcacactgcagtgttacacaaatatttttcctgcttcctacctttcagtattactaagcagcactaactgttcccccaaaactggctttctacagcaacttaaaagtcaggactctgggctgcgcacggtagctcatgcctgtaatcccagcactttgggaggttgaggcaggaggatcacctgagatcagaagttcaagaccagcctggccaacatggtgaaacccggcctctataaaaactacaaaaattagccagaagcagtggtgcacgcctctagtcccagctactcaggaggctaaggctagagaattgcttgaacctgggaggcggaggttacagtgagctgagatcacgccactgcaccctagcctgggcaacagagtgagactccatctcaaaacaaacaacaacaacaaaaaacacacaaccacccccacaaaacaaaacaaaacaaaacaacaacaacaacaaaaaaaaaaaaaaaaaaaaaaaaaaccaaagtcaggcctctgctcccaaccacgtagaaatttccccccagactaagcaggctgctgtccttgatactatgcctctagagaggaaaagtggccttaacctttaggaaattacaacctacttaataccctatcttttaagtgctgtgtttttgaaaggcattaaggatgttagtagcaaagggcccatgaaagtggctcacagagcagaggcaactttctgcctctctaggatattgagggtagtgaaactataaaagcactcaaaaataacttactgtttaaattatataatttacccttactctgaaaatgggagaaagagcacagtaggttaaaagcattagtaaggcttttaaataattatctttagaaaatcttagtaaataaagtagaataaataggttctttcttttccagcttataaccttgactgttcatattaaggtcctctcatgaccatccatgagtatggttacaggatattagacaaattgaggaatatacaaagcatttactctgaaacaggccacaagtgcaggccttttcttaccatggcagaggcagctgaatggttcatctgatgatgagctgccttgagtctggcttgcaagtgtgcaggaggatgaaagtacttgcatttctcccgcgagcatcgacctttgatgtaatccatgcagattgtcacagtattatcactcgcttcaatcatggaagcatcagtagggtgagcatagcggcaatcattctccccacgggtacaatttccacgctgaaattctcggcaaaccttagaacacacacatgcacatacacacgcatcacactgatgactggaagctgactggcttttatttattttgctagtgaatgtaacagtaattatatatacattgaatatattatgtgtgaacaaatctaaaaagataaagaataatgtaaagccatattcactatgagatataaacagacagaatttctattcccagaaaaaaattctattctccccaaaaggaggttgtccttacattgaaataaaaatgtttaaaaaagtattactgaaaaccagttttaattctccagttaatacacagccttaagcataattagtgtttttttaagtccaagatgagtctttatcacaccataatgcactggttttccaaagtcaacttgtgaaccataactgagttatatgtacaatcagattatattacaatacattactaggcatttaagcggctgcaaatggagctgactttgtaaggaaagactagttatttcaatgtacaaagaataacaatagaagaatgaaggacttcaataaatcaaaaagctgtttgaaatttctttcagattttcttttcttaggcatcggggttatttactgcctagcacatcactctcaaaatggagaaaaaagttgaggcactatgagactaatttaccttctgtgttcatatagctttacattctgcaatcgtagagagttatattgtctacttttttcccactttgattattctagcaagtagagactcattaacaaatatagtaatctgtttctgaaagctggagcctaggtaaaaggaacattcccacagaggcttcctgtgccatcgcacagtctatggctgggtacacttaacatattgtttgacctaccatacaggtgaatcaatgcactttataacaaggtatgattgcagtactaaaatgtttaacaaccctataagctaagaaatttgggttctcttatttaaaacaacacactgggctctgagaatactgctttatgtgtaaggttaatatctattctacaggtatttatatatatgttcacaaatacctccagtttatctgaacgcatcagttttgggccaacagctcctggcattgcaagaggtgggtttccaggaatcagaacaggtgtatttggtacaagttctgcaggaacgaggcccatcccaggatgtggtatgtaaggattgaaagccatgggaggattagctggaattgatggagtcataggaaaagaaccctgtatgtttaaaagagaaaaaaagatgttagaggtaaagattcttcctgtcattacacaaagaggtattctttcagaaacatcaaaattacttatgccacatcaaaatttactattgttttcttctgatttatttttagcctcatactaattcccatagaggagttgcttttaaaccaacaaatctctttacgtactaactttattggtaagctcataaaataagccacatgattttaacagtcatgaattatccaaattaaatctcactgctagtctgttccaaatgtgtttcctccaactctttctttattccctaaaaaccatgtcaccaatgacattacacatatggacaatcttctttgtttccttacacaggcatggcctttgcattcagtccctttccttcctctttcctcttcaccatcaatactgcttggctgtaaggctgcctgtcctaccacaggccccacctgtactaccaaatactggctgtgcttctgtcttcctggcccactgacaattatggaacacagcaaggagttgaggaagaaagtgataaattagaaaaagtgagtgctttaatatctacctaaaatgagtttagtatggtccattatattttgttatttttttaaatcagaggtcctgttttttaaatttttatgtgtacatagtaggtatctatatttatagggtacatgagatattttgatacaggcatactgtgtgtaataatcacatcagggtaaatggagtatctatcacctcaagcatttatcattccttggtgtcacaaacactctaattatactcttttagttatttttaagtgtacaagaaattattgtttactgtagtcatcctagaggtcctgtttcacaagctaatctgacttgcctagccttgtctttatccagggggccagatgatattcatagttcaaaagaaggcactagaaatgctacaagaatccctgttaggcaggaagagataagataacaggattatatggtacacaaactagagtaacttgtaaaaaaaaaaaaaacctcagaaatgcaaaaagctattactgctttttctattttcaaagatcctggattcaaaaagtttaatatgtgtatttcctttattatctgttgccatattatttatcactttgctgttttccagtttgttccacatgtgggtatcttttcttgtcaatgtggttttattcctttgatagttctcatctcccctatagtacccaacacttagtgaatgactggttgacagatatactcaatgatacattttaaaagcttaatgaatgaataataaatcatgactaaatgtagtatatttctaataatgactctacaagttagttattgtgaaactggtggtgtctcattgtgtattactaattgcatgtgttccttcttgctttataaaattttttcacttgaaaaaacccccgaatctgttgcatttgccaaactgtgcccatacctgctaagtcacattaatagaaacaagtctaaatacaaattgtggaatataaagtgaagggcaatgtatactcattgcctcacccccacacagacttgaaattgtcacccacacagcattccaagaagactctgttataaaccatattcagcttagaaggaagcactcccccattagcattctaccttagatgagtttatcaaattagctgattgggacattaggaagggcagaaagaatctggcaccaaaaaactggcaagactcacgagggtgagtaggaaagacatggttgccaagagccttaagtggaaagggaacgccaggtgccaggaaagatgatggtgtagtcaggagaaggactctaaagtctgggggcaaatagccaagggctgacccagtctaactagctcttatgatgtaatagactacaggaatacgggatacttgtcatggaatgagatgtgaagctcaggaactagctgatgtgacatgattttatataatgagaaggaaatcttctggaaacagccacccaggcatgcttccgcaataaggcagactttatcaatgtaatgattcatagttgtctcaagatcaccaagaatctctgatgagaaagagtccatttttgaagcacacgatagtgctcttcacttgacttttcgttgtctctgactttcctggtaaatttctcactgaagccaccagcccattctcctgcatactttttgctcttgccttttacaaaaatgagcaggaccattattgtatctattaatttttgaactgaaagaaagacctggaggtgggtgaattttccagattaaaaagttattaatcactaataaatgctgatcaatcaacaatattgaagcctaatgtatttgaaagcaatgctttctgtttatggtagctttttacttctgtaatttttttcttttcttttttgaggtgactcaccagggaaattctcctagctaagttctgctttctttggaatacttttaaactttcttaggtttgttatatgctccaagtgtatggaaaaaaaggctataaattaatgattggtctacatataaaatgtaaagggcttactgaaagtatttagatttttctaaggtttcaccacaaactatgctatctttagatcttaaaattagtatcctagctcttataactatttcctccttgagtatgaaatgcattctataacactgtttattgagaagaagcaagctatcccattctcaatactggggcagaggcaggaactcctgagtggcttatttattttcagttggacatttctgttttctcaccaccacctctgccccagggtaactactccatttcatgaatttgaacattcaagggcttagcgttgactaacagccatgggttaagtcaagcagcctgcaagctcagaagctcagctttaataagcaactttaatcctgtctctatatatatctcagcccttgatgtcagttgagctaacatgaacctatctgtgggttaatttttattgtaaaggaaaaggttttaactatactgactctgatttatctttacagcctgaaatggtctgaacacttaaatgtttcagatatttaaattccaacctaaattatttactaaatacttgaaaagagacggctgtccctcccataaccaggtgtaaattttcatctttctgagtgttgtcaaccagcaagaatggtggtggcaacagactttatgaataagatcacctgacaactatttatccccatgtctctagcagtattagctcctacagtagaaattcccatgagttcccagtgacttgcagattgcttaggaactatcagacactcaggaaatgtgtcctaaaaattaacgaaatatctagacaacactggctcctaatcttttttgagtccaggacttctccaagagtcagataaaggctgcagactctgtccacagaaaaattcatgtatgcaaaaaatgttgcttgtgatctcagcaagttcaaggaccccacgacactcacccctggtgtggggttatgaactacttactggttaagaatctctgttctagagtaaggctctgcaaactagggcccataagccaaattcagcctgcctgtgtttttgtatggccagcaatctaagaatgttttttacagttttaaatgattgaaaaaaataagagaataatatttagtgaaacatgaaaattataggaaactcttattccagtgtccatccacaaatttcattgtgctcattagtagagctgtattacaaaaaattgtagatatttgtttcctctcttgttatataagtacctatataataccctcaactttgcatcttgaacctcacagcctaaaatatttatatttagccattcacaagaaagttcaccgaccttggttctaaatgatttcaaaaaatgaaattctccaacgctttcaggagtaaagcaccaaatatatattcatatatattcatatatattcatatatatatattcctatatatattcatatatattcatatatatattcctatatatattcatatatattcctatatatatattcctatatatattcatatatattcctatatatatattcctatatatattcatatatattcctatatatattcctatatatattcatatatattcatatatatattcatatatatattcctatatattcctatatatattcctatatatattcctatatatattcctatatatattcctatatatattcatatatatattcatatatattcacatatatatattcacatatatattcacatatatatattcatatatatatattcatatatatattcatatatatattcatatatattcatatatatattcatatatatatatattcatatatatattcatatatacatatatatattcatatatatattcatatatattcatatatacatatatatattcatatatatattcatatatacatatatattcatatatatattcatatatacatatatattcatatatatattcatatatacatatatacatatatattcatatatacattcatatatatattcatatatattcatatatatatgaatatatatgaatatatatgtatatgaatttagtatttgtagcaagattccacaaattgaaaatgtttggctttgtaaaccaatactaaggtattcactaaaatgttcttttacatagttactaatattaggattaggatttttaactatttgtttatagaacaatcactactccgtgactaagaatggggaaatagtagttggaatcctgtaaaggtaaaaattttaaaagccaccacagattgctcttaaaggattctgaggcaatgcaattcaatgcaaaactatgcctcaaataaatgtctagtttacacacactttaggaacagtgacttaacaggttatttctcaagctagtataaataaatgaaaattaaatgttatgccaaatcaatctttgtgtctcctcaatagcctagatctatttgtagttacctcaaaaatatccaagatcaattacaattattgttggatgaatgtaaaatatttcaaaatcctggcctaaggtcaacagaataatcggggccttccatctctgagttcctgtctagagttgaatgactagatattttcttttacagaagggtaaacatttggtaacaatttgttgacccaattttaatacaagaaaaatagcactcataaattttactagcgtcataatatcttcattttattgctcatttgcaagcatttatataatataaaaggaaggctctttttacggtcatcatgcatatttctatctttagataatcccaaaatgcactgaaatccataattttagtttccatcagacttcactttcacacagagtacaattgaataatctctctttcacagtatttgcttggtcatttccacactccttgagtaatgttccgtggggactgaagtggccaaaatgcaggctgcaggagacccacataacctccagactagttaattagtttctcaataattgagagttaactttaaaaacagatgcaagctgatagtggtgtttaagtactaatcgtacttgttaatgaataagtccccatggctctagagagagctaagaaaaaaaaagttcatgggtcaaaagtgaaccattgtcctcacctagacctggattttctgatcttattaatcagagaattctccaagtaagaggaaccattgaaggcaggcaggttagttgaaagatcaataggtgattgtgagtataagaggtataaagaataacacaaatgagaacacaagtcatggttcagagctacccatatttgctgggaggagaaatacaacagcaggccaggaatcataaaggagtacctaaacacagatcagcacatcacctaggaagagagcaaatgattgacacttataagcagggtaactttgacattgttcctgaggaggtgaacaggaattgacctaaaaatttgttggtgaccaccgtgtaataataatggcaattcaattaactttagtattctagtaggaaacaaagattattttttaaaaaatcaagtttgtggcatggattgtagtaatagtatcatgagcatctgtttgtctccaaagtcatcaatttgtatacattgaacatgtgcagcttttgtgtgtcaatcatacctcattgaagtagttcaaagaattaagtggttatctagttttaacaaagggtataaacaaaatgtgggtttttgggagataaataggaagaactgagcaaagcaaggaacccacaggaaacctggagactatttatgaacatgtcagtgaaagttagataaataggtaggctaagagtttaaaattatcaagggtttgaccaaccacaaccaccaccaccaccaccatcaaaacaacacaaaccaaaacagaaccttgcatggctaatagaaagataattctatgttgaaaaaagaaaggcccaaagctacaaaaatatgaagaatcaggtacaaatcagaaattaaggggaccagaaaatattcatccaacatcttacttttgttacataacgaattcctagagggtagagtttgtttcttgatcatctttttatccaccctttactcatttaaatacctgtcacagagtatatgctcaatacttactgaattcaataaaaagggattcctaaaccattaattaatttttgatttactaaatagatcaacccaatttaaaaatcagagtgcaaaaagaagtaaaagtagtttcaaaaatggtggcaaagaaattgaataaatccttcagtcttgttctccactgaggaagactttaggcagatggctagtcctaagctgtcttttgataaagatatgaattgctagatcaaacagtatgaaaagcacagggtattttatacatacatatgtacatatgtacatacatgaatcccatatgtgtatgtatttttaaaattggagtggctaaatccatactagaaggtacctaattaagagttctaaaaaaaagtgatttagtgatactatagataaaaatatgtaactttattacaaagtgtataaaaagtaattttttatacactttgtaatacacaaagtaattcacacctttttatacacaaagtaattcacaatgtgtataatccaggtgattaatgaattgctaatgtgactggtatccagagtggttcaagagagaagaccacggaaagaagggtgtaaatgaatatttaacagatgattacaggatattaaggcaaattagaaatgcttgggggtaccactttaattatcaggtggtagggcagccacaggtttttatataaggtctcctctcattgacaaattactgagccataccaacctgcaggtaaaaaaaaaaaaaaaaattcacagagcccaccaaactcccagccttcacctcatttgtgatcaacagcaagcaatctcaaggtagctggctgtagcttacactgtgaccacgaacagtgaagctcacaggccaccatggtctcattagcaccaggctccaactaactgagctaaccagccccagaggagaaggacacaaaatagaggaggttacatgtaatttatctcacgggaatatataaaggatgataaagggagaatgttgagatttgtgactatcaaagaaactggacactatagaagatatacctaatgctaaatgatgagttaatgggtgcagcacaccagcatggcacatgtatacatatgtaactaacctgcacattgtgcacatgtaccctaaaacttaaagtataataataataaaataaaataaagaagatatcatgtacaagtgtcctctgtttggctgcaaaagtgtagcattttcattcaacttttgaaaaaagcagatttcacagtgtctattaacagagatggggcaaagcagcaaagggactgctaggggatttattttgttttaacgtaaaagaagctttaagctatgtgacatacacagtcttattagcaaaaggcccgaataactactctactttggaccagtaattgcaatgaggagcaaatctaggatatgtggggtctgaagcttagaccactgggtggggaagtggagccttaagaatgaaacacacgaatatattttgcaaattttacaaacacattttaaacacgttgctaggacccctctcagggttttggaaggaaaccatgcaaatgagcatccctaaacccctcatgttagtctcagggtaagtacaccttaaaaacaatgttagttgaacaaacagattacagtaggcttcagttgatatacctaaaagtaaaattttgtctaatctttcagaaaatgtagtaaaatccagatgatcatggcatggtagcactccaggcacttctgtgatatgatttggtcaacctcaatgcggaagttcacatgatcatgactgttgtaattatattaagagcatattaaccttataattacataatgcttgtctttcctaacttgaaaattttgcaaaaatcatttacaaaacatgtaatgtcaccacatcaagatgaaagaactaaatgccatcattcatcattacatgagtaggtgaactgaaaaacctgctgcagaaccttcattaaaatgttataatttctgtactgaccatgagactggtaatttagaatatggacataattttcttttctattaaacctacataatgtctgggtcaccttttaaaataataattgttaataaaagagccatgacaaaactactcttttttatagcataaatatttcagtcaataaactaaatttatgtgaactaaaaaactgtaagtctaatatgaatatttgtcctcttgttttcaagtactatatcatttaatgactgacttacaaaaattaaaaagtaggccaggcatgccagcactttgggaggtcaaggcaggaggattgcttgaggctgggaaatcagtaccagactgggcaacatagtgagatcacatttctatttctattcaaaaaatttttaaaaaacattactgtgcatggtgatgtgcacctgtagtcccagctactcaggaggatggggcaggatgatgacttgaccccacaagtctgcagctacattgagctatgatcatgccactgcactccagcctggtccacagagtgataccgtgtctcaaaaaaaaaaaaaaattaaaaagtaaataaatattttccaattttatctccagtcacttaaaattgttctagtcctaagtttataagtaatataaacccaagtaatataatacattgtagccctttagtaaaagagaaaaaaacaacattaaaaacatgagtctaaaaataatattcattaattagtatatctcccttcctcgtacctatttgaactttctattattttttttctcttggttctgaagcattacatcaccttcgttccttactatattaatgttagataaacatataagcctgtttatgagaaatatatttggtaaacagaattatgaaaatgatgtaaaaaggtggagagggatccaggcagctatcagatgattcaatttgagataaaggaaaacctagagaggaagacttgtttatggccttcatggtttggaactcggtaacttagccacaggaatgccagccatgaatagcatacaacagaacctgaggacttggcacatcccaatgcaacctcaaatgtgctgaatcaacaatctctatataaataatcaaatgaatacactctactgagtcaagttcacctgtgtgtcaggatctgtttccatgtgaatcaccacattcaaagagagaaactaggggaatttcccaggttttcctttagtttggatatggacaggtgtagatatgcaaaatgtccaaataaaacattttaacagcctgtaatatcatattcactttataaatacatacaccacattcagtagggagaatctttcctcataactaaaatttctaattgtaaaaccaaaattttaaaacattagctttgcttcagggtaatccactgtgcctactctttctaatattcttctacagtggttgtatttgcctcatgattatggcaaggggatacttcaacttatacttttttgctgggaacatcaggaacaatctctcttaaactgcattgaaaaatactagggagtcacaccttttgtttcacctgctgaacttccttaataaagccaaaaaaaagctttcagagatggacttttatactggcaaatgtcaattcagacctgtttaatagagtgaacaaacttgcctgctccagcaagcattccacccaaattgactaggtgtggcttttattcattgttcagtcacactcaacagaatctgttctctaggtaccatcgcatttaggttgacattccctttatctaggggcttataataagcaaaccatattcaattctgcaaaggcagatgtgctcttctggtatcctagaaacagatcaaagtattctttgtggaaagacatgaagttcaagccagtcatacaaatgggtcttaatatgcaaccttacaaatatcaggactggaaatttcttaaacaaaagtatgactatcttagagacaagaatcagattattgggtaggggtgattaaaagggatagagagttgtttgagggagagtaggtaccagagaaattaagtaaaatcatatattacttctgtaataatatcaggatccacaataaagaaattttttttccaaatcagactggtaaatgttacttaaaattgctcacactagctcaattacaccatgtctacaaagtggcttccttagaccatagaagaggaacatatcaaccatctcggagttagatttttgtacacataataactgcaggaattaatcatttatcggctcatcgcatcataacagctatcattaaataatctacaaggtagagaagcaatttccaattgttcccttgggtcttctaagtaatgccttgtatcttgtaacattctataaaataaattgtactcctgtgaatcatagcagtcatcttccgtcatctgaaatctgaaattaccctcattgaagaaaagatagggaaacatattctaacatagaaagcatagagaatcaaattagaaagcacaagtgaagaggctggaaagcacaatggatttcttactggattctcaaaaaagctactccctattctccagtgtgagccagcacgatcaataacacttgaagggttgagacttggaatggagagactctagcagaggctgaatagaacggcttccctctgtacccctactttaccccacttcttgctctctgattccctgaaacaaggcatttcactagtaccctgaagctatccctcgacctttgaaaagataaatgctccagctctgtaggaaccactgggctcaggtgtctgataatgaaatctgcttcctattctttgctcagtttgaaattgagacatcccatgagaagctgagagtaataattgtgagttaaaatctcccttgctatacctttgaccaacatcttcccccatcccctcccacccacatcccctggcaactacccttctactctctgtttctatgcattcagttttttcaaggttccacatatgagtgagatcatatagtatttgttttttctctgtctggcttatttcacttgacataatgcctgccaggttcatccatgtcatctcatttcacaatgtatacgtctaacaaatcatcacacgctgtacactttaaaatatacacaattttatttattaattatacctcaataaagctgggggaaaaaatagaagctgccttgctttattccccacccactcacattttctggacttaccaagcacgatcacttctctgtggttttgttcataacaattttcagtatccaaaagactttatcttccctctgcccttagaagtagggagggactgagatacgtcagtatgtgaaagcccagaaaaagcgtttgcgcaaggagttcaacgatgtaaagaattactgagggtcaaagaggagctttgaggagttcaccttctaggaactaatttaccaacataattaatctgagttccaaggcaaaactttttggtaaactaatagtacagaacatgacatctatttattttacttaaatctgtctagacattctggaaaaagagtatggtgcaaacctttagtgattcatcattgcctctcccatctgtttttgcatttatccataaagatgtactcattaaagggttccatatcaacacagatatccttgaattctgagaattaactttataatgagataggctttactgacagctgattgtcctcccccattttcattgcatctaaatactatatacatatttcaactttcaatatgttcattgtatcactgattaaatgggtaacaaataaaggtaaaacaggattttcaaatttatcctgttaatagtttaaaggaagtaggccagctggaattagaatgaggcaccactgagctaaatgtgaggcctgaagaactacagcagaaaagggacagttttcaattctccctaagaggtgtaaaagcaaaatgaaagtttatattttaaggcatagggcaagatgaattttcaatagaacaatatgaacagatatagcttaattactttataaaggatccatttaaacttgcaagtccagaaaatagtagatattagtctagaatgacataatcttactaatttctgcatagggaaaccctgtagctaagttaagggaaagccactatcaagatcatgggaaattgggaaaaactgagaaatggtcacagagcagagaagagaggggaggcaaaattcaaatgaatgcactgtggtaccctgaatcagacactggaatagaaagattacattaatagaaaacctggggaaatctgaataaagtctggagtttagttaataataatgatgtgtgattccagtttcttgcttttgacaaatctaccagggtaatataagatgttaacagtggggagaactgggtgaaaggtaatacaggaactctttgtactattaatacctttgtaacttttctgtaaatctaaaattatttcaaaataaaacgtttatttaaaagcaacaacaggccgggctcacgcctgtaattccagcactttgggaggccgagacaggtggatcacctgaagtcaggcgtttgagaccagcctggacatggtgaaactccatgtctactaaaaatacacaaaaaaattagctgggcgtgatggcgggcacctgtaataccagctacttgggaggctgaggcaggagaattgcttgaactcgggaggcagaagttgcaatgagcctagatcgcaccattgcactccagcctgggcaacaagagtgaaactctgtctcaccaaaaaaaaaaaaaaaaaaaaaaagcaacaaaacccccatcaaagaacaagaaaatttgtttgaattaatgtcctagaattcaaaggtttccatgtaataataatcaactctccttatcttaaaatgcccctgctcctttatccatattcttttataaagtgaactcatgcagccaggttttcagtgcaacacacctgactgctctcttcaagtgcacagctctgtagtgtcaatgaacatattagtttgtgtcctaaatcctgttgcaactaatttccccaagtccctgccaggttattccactgttgatctttatcggcaattttcaaaatatagctgcgacttacaagtgatgacatttgagcgttttggagcataagctgcatctgctgggcgaacatggctgcggcagtcttctgttgaatcagattgttccgcccattaatctccagctgcgtttttaagtgtggaggagggtgaaggtacttgcagttctctcgggtacaccgaccctgacaatgaagaatagggaaaatattaaattaaaactatacacaaatagataaattttggactccattatctggggacaatctaagctccaaaactcttcatcttgaatccatataaggcgagaaacaccctgaaattcactgacagtctgttaatgaaataataaatccctatgcccggcagccattttgttctttaggttccggagacaatggccctagatcacttgcatgatggaaaccaaagtgtattttggatcctcagctaattgaatgttttttattgatgttaagcactttcaagacaggacagtatgtcagttccgtggaatcaaacatgcttttggtgtcacctaaatgttggcatggctgctgattatggtttactatgtagcagcaaaggatgtcactggactagttgttggtcacattgtcacaatgtgacctattactgtgttgaactcatgagcagtatataaagaagctaacgattctctcttatttggattactaggtccaccataaaccttttaagaaagcacaactgcaaacaattctattttccacagatgctaagattctttacagtaggtgaggttattggggaaggggaaggtggggagcaaaagggcaactttgtttttggaccaaagagtgcaagctgctaggccacctgaattcccgagagaaaaatgagtttgttcaccaagtgttttcattcaacacatgctatctgcattttccttatttatgatgcctacacagtttatgcaatggcttctccattgtttagttatgttgttattaaaatattcctataatttcactgagaatcaagatgtgtccttcaaaacttttctagagctacatataatgcaaacccagatgcattgcaacggctctttttaaatattagatcactagggcaaggtggctctattgttttacctcctctggcaagaagctgagtataactttaaagtcagtgtgagaaattaaaagacacatcattgttttctgtcgagtttgtctttttgtttttcccattgctcaatttacatttaattaaattaaagtgatttacaaaatcaaatactatcttagttttatgtacttttatatttctatgcaaaccttggagaaagaataatttattggtagtatgagttaagaatcacgttaacctaatcctcctaaattcttaaaagtagcctaggaatagctacgcaatttcaacatatataatgagtgtaagcagacccctgtgtgtgctaaatcacaataattggggtcttttccccataaatgtacccctaagagagaccataagcttctttttacacccaccaatgtgaagcaaggcagaaagtcacaaggatcttcagttcctagattctccactctccatctacataactgaggtgatctggctcagaattaacagctgatggagggagtggcacttggtgacttccacagccaagcatgctagtttatacttctacttcagggtttctcttcctcctcccacaccctaacattaaagatttccccaaggccctgttctaaatcctcttgctctcctctctaatctcttttccctggagagactaagttgtttcaaagttccatctatttgtacaattgctcggatcttaaatctctatctctacccctgacctctcttctgaatttcagtctttttttttttttttttttttttttttttttttttttttttttttttttttttaccaattgcagctgcatttggagaccctgctgcctaaccaggtctaaataacttattactgaccttccttctcatttgactatttttcatcttactgcatactcccagttagggccaccactctaattcctatgctttggggtagttagacagcagtagtggggaaaataaattatgcagctcagcagcattgcttaaggattgcagagccacctagatagcttgtttagacaattagcatacacaagcgtggaacacaatttttaactccaaaacaactatataatgaagactgtctttcatattcaggaattccagacattagataagttaaaaaaagaaaaaagaataattggaatttcaccatttgttacaattgagttttaatatcatctacattgaatgtaatcagagagagaagaagaaagggagggagagaacacactgtatttggcacatttcctgccaatatacagataaagaagtgaacatgcctttgtgcttttatatcactatcctttacataaagtaacttatcttaagctttttcttgggaaataatgacagtttagcagagcaaaaacagtacacagaaatagaaaaaaagagaattacactttaaaaaattatatcaagttgggctataaaactaaagtatggaatatgaggcagcatgagacttaaagaaacttattcatcttagttatgagattttacttgatttataaagcttctattttgaatgaccgaatccataatttaattctataacaatgcaaatgcatagcaacaccatcttaccagagactgctgcttatgttccagaaagcttataaaataaaataaaaatctgtattctctatccaaacaatagatgaggagaccaagtaatttaacatctatattatccgtgcaatacaacatttcaaaagaaaactatgcccctgttttttcaaaacgactttagaactcaggataatatatttgtacacacaacacttggtgataataaatctcctctacatagcgttcattcttcaagaggcccaaacgtaattataggccaaaatactttaattggtgtttgggagagaacaaacttgttttttttacatctgttaacacttgttttttaatccttgtatagaattaaggctttggtaaagcatgtaaggttgggatagagtggggattagggagggactgtcccagtggagtaggtaatcatctattgtttttgtcctttggaaaatcaatgactctgtactaggaaggttccaatgatttctgtaggccacctaagcactctgagtgggccacaaggtaccctatcacattgggtctataacagtttggtgtgatagcccagcagccatcttggctctgaaaaatcacccttcatgtttccctagccaagtcaatggtgtcccaagccctccttcttccaatctagacccacaggttcagagttggctcacactagtgcaaagtatcagagcatgccttaaacgactctgtaaacgtacctacaacagtcgccatcctctggcagagcaggctacgtactaaaatcagcagctaaggggagtcaagacatgaaaatcaactctctctctctccccctcccatatacactcaaaattaaagaaacgttgaagcgattagagtgcaagctcatttatgcttgcctcaatttccctccttttccatttccttttggacttaaaaaacatgtcattctcatctggtctttcactgtgttactgagttaagaaaatagcaaagtgattcaataggaaagcgattctctgctgaaataagtgctactacacctatgaatcatatgaatcttccagctcccctttcccatcgactgtctttgaaaaatgcactcaaaaagcagcaagcagggggagaaaatagccgatgacatttctgaagtacatctgcatcaagaagttgatgacagacaaagggatacattgcagaacatttataaagcctcccaaattcaatctattgccttcttcctaccttcaggcttctcccaaatgaatacaaagcctttaactaagagagaaaagtctcattgtagagattcaaatcccacctatgtctagagagttatgagagtcagagtctgtcacaagacttcccatgcactgggtggtagaaaaaccctgtgaaatgtacttcatgttcatgagaaaaagccctaccatacatcagaataagaaaaggaacctgggaggctgcaaattaccctttgtcagccacagtatcttaagagaaacagctgtttgcagaatgacttgcttcttcaaatacatacagagttagagagaaaaaaaaaatcctaaatatgttctctcaaatacaattataactggattacttttcaaatacataatctcactgatctgctagactgccaacagttaaaagttaaatgttaaatcaaggcacccaagagatgatttgttctatgaagaaaaatgttgttattccattttaatcataatggattaaatgaaataattctgatgatagtgccccactgtaacatacttacatgcacagacatggcttctcagaggaagtaacagtgatttcagaattacaaatcatatgtaccagtttggctagttcctgcaagcatcacagatttattaaagctaggaaaaacctgagtcaagatcaacatacaacgagttattagccagatatcggcattctactggcaaatttcccactttcttcctcttagaattctgtctttacaaaaatggataatctgcatcattttctcctccaaatattgtatcatctataaatattgatatagatgcacaaagagcagccttaaaattctgcatacaacttttaagttaaatgtgagatgcaggcaagaaatttagagggaaaagtctttaataaaccatttcttaaatataatgaaggcaaaattaatgaggctgaacgttgacccccatggagagggccagccaagtaccccccaccattgcagccagcactgtacccaccttcttcatgctgtcccaactctgttttcttgacacatcccatacacacatacacagggcaatgactttggcgcaaaccagataacaagtttgaataggcgagaagctggggtgagagcagaagaattttcttgcctatctgtctccagagaacttttacattttgatctcccaatgacaaagggagtactgggctcaacaatcacacttttgttctgaaatagcccactaagataacttgattcccaggatggaaacagtttagggctgaatcggattgtagggaacatcttgtgcacctttatcttacagagaatgtgaaggccaaaggggtggggtgacttgtcctaattcataagcagctcagtaagcacacaagccaagtttccagactttcactacccaatatggattctcagttcaaatcacttttcctctgtaaagattttcctggaaccgtctccccattcctgtccccatttatctctccctcctttgtgcttccaactgcaccttgtactcagttttatcgtagctcttatcgctgtgtacatcgataaattgtttgcatgcttgtctcctctattagactttgagcctgtataacggcagaactacatcttcctccactttcaatctccagggatgtgtgtgtgcctgatgaatagccgccctgccatacacgtttgttgaagtttgtgagaataattttatagggcataacactaagtctaccttagaaacctaagtgcttctcttgctattttctttcataagttctttcttctccctccaagaagagaacaatagtcaacacatgactgaggctgcccctggttgtctgttccaaatgaaccgttattctattcaggtccagaaaatagctagttcctaacttttttttttcctatgaatatagaccctgaggaatatgtgaccattacggctgaaacatcctggtaatttagtataacttaaccagaagtgacatgaatccatgagacccagagacagaaactctggtctgattccaaggggtctctggccacaaaggccctcaggatatagggccccaccggacgaataaaggagccagcagcagatccatatctaatcagcacctgggcctgcccaggagggccctgcatttccagggtcagtttagaaaaaaactgcgttctccaactgccccaccccccatcctgaatttctctgaacaagccgcaagtcaaattccctgaagctactaagacaaaggtggctttaggaaaatcacagcaggtggggccttcttgtggctctctaatgcatatgccttcttacaagaaaaatgtttgcggctttccttcatgacccacgcttagctttgtttacgttaaacatttattttcaaatgatcatgagcttgatctttttcttagaaattttttgaacagcaaataacactaaaaatcccagaagttgttcacagtgaaagcaagcctgcctcactaataacccaaatctacttcctgccctattccaccccacttacacactttttacctcggttctcatcgaataccgtacatcactgtagaaaaatattaactgaatgactggtcaattataagctcttcaaaaatgcatcatctatttacaaaccagccaaccagaataaaattaaaacccaaacacaacgaagcacattggtaccaagttatcaaaagtcagaaggcattcctcatgcaaagtattactagacgctgtctttagagcagctgatagctgccaacataaaatgtcatcaagaatggaaaaaaagggagagaaaaagtaatggtactgaatttgttactctaagaaataaaacacacagaaaatcatataacttcaaaaagctccttctacatggacttcattaagaaagaacataaggaggtgtttctctctgacccattagtcaaatctcctgctcctaggcttctttacctcctttttctggacaccccatccactcacttgccacaacgatttagaagccaggacaaagagggtaccagctgcttgccccctttattccccagctagggcttctgcttaggatcctctctagagatgccaggtttatcaaataaatatgcaggactcccaggtaaatttgaatttcagataaacagtgaaaaaaaattttttagtataagtatgccccatacaatatgttatctggcagccctctcccgctctgttcttctgccttgataagttgagctcaataaaggcaaatccttgaaaacccattttacctctttaccttaagattcttagaagccctctccatggaatcagcccaggctctcccaggccttcatttgcccagagtaaagtagaagacactctcagccccagcttacctgatcagctgcaaggaaatttaaggaagttgactgttggagacagcaatttttgatccatagctcctcccaccaaaagcttcacacggctcgctaccctggcagccactccaccttcccacccaccggtggcgcaacagtatatttaaataccctcgatgtctgctggagctccccctttaggctaggatgaagagggggatggtgtgtgaccaatacctgcctaaacccgtaactccgaatttacagaacagatttttgagtatatgaggtgttacataaagatgaggcttttaagttttttaaggtttttatttatgtgtgcagaggtgaggggtggttaatcttttctttttttccttcagccctgtctttggaatactcaaattcgagtaaaagtcaatcattaaagtgcagggaaataactacttagcacatgtttctatatgcacacataagcgctataaaggtacagattcacagcatgcagatgaatagccattatttgcatagatatctttttcagtcaatccctgattactcacattaaaagagagcacaaagtagagaggtatggctaattctaatgaaccaaataatatattcgagaaaaatggcaatccacaatagcctcacattacaattgtgaacatttaagcaattgctagacacagtcctaaatttattttttcattaagaatgcagactctttcattggaatgatcaaagattaagaattagtaaggtcagaaatagtaaaattgtactgctctggggaagtttatatgtttatgggcatatcatagaaagatcaaatagtaaagctggaaaggctcttagagatcatttagtccagcatttgccagagtgtgtaccacagacaactaatcccaagagaggaacctcaaaagctgggttcactggtcaatcgggtataagaaatgtcactttatattcctctcttgtaggctgacaatacacaagagtatgataaaggctctcacatgtcctaaagtaaagaaacctggttacctttgttaacccagcatttcccaacattgtttaactcacaaaccatccccccttttttcatcatattcccgttaacatctctctttagtacacccttaggaaaatactgatctaatccaacttcctcattctataggtaaagaaactaaagcttcaaccaagttgtatggtgttttacaggtcaagttttccttagtattttcattttgatttctcttaaatagaaaaatagagtgaactccccaaaaatggctcttctgttgaaatgccatttttgcccatccctgatctcccaaaagctaacaagatggatattttcctatgattgcaaagtaacatcccacaatcaccttcccaacaccccttttcaaagctgtaagtttcgtcagatctttccaaatggttgccgtggctttcttctttcatttgaaggctttagtcaaggaacttctgaaataagaacgtcaagccttctctgcctaactggctttcctacattgtgacttctgccccttgaaaccatgctaattattttaggctttccatgacttaagggtctcaagtgagttttcgctgtactgaaacctgggaagtcagaaggtattgggcaatctcctcaattccaaatggttttagttttgcactaaccttaaaccttggggtttccacttggtaaaattaaatttcctgtctctaagtaaaatgaaaagtttcaaagaagaatttaatttgcaaaaatatcttacaaatgtatatgaagagtataaggtgagaaaggcactgattattgttcagatttaaacaatttatctttgcagggctcagtgtgctgctcagaataaattaaataattatgtctttataaccagccacatatctctccactcaaactttatataaagggtagatatggctattgatttacctctgcattttgaaattagcggtacaaagatgaaaatcagttcctcttttgttaaacatgaatcttctttcagataaagaaatgtaaaacattgtaccaaaatgattgtttacagggtgaattaatcagtgtgaaattatgtttcaatcccccaatgaggtcaaatgtctccacttcagaataagcattttcctcacactcctaccctactaccaacctaacaccaaaaatggaatttccatgcagaaagtttttacttggtgacatggactgccattaaaatacttttgaggcatggactaagtttatattttgttagggaaaatatacatttcatcaccaaaagttctattgaaacctttgtgctaacttgttattaaaattgtaggaaagtaggcaactgttggtaagaatgtaaattagcacagccactatatatataaaaaaaaaacagtatggaggttctccaaaaaactaaaaatagaactatgatatgatccagcaatcccactgctgggtatctatcctaaaggaaaacagtatttcaaagagatgcacccctgtgtttattacagcattattcacaatggccgagatatggaatcaatttaagtttccatcaatggaagaatggataaagaacatgtggtacatatacacaattgaatattattcaaccataaagaagaacaaaattctgtcatttgcaacagcatgattggaagtggagaacattatgttaagtgaaatacgccaggcacagaaagatcaatactgcacgtttctcactaatatgcgagagctaaaacaaaacaaaacaaaacaaaacaaaacaaaaaacccactcaactcatggagatagagagtggaatgatcattgccagaggctagaaagggtagtgagaaggggtttataaagaggggatggttaatgggtacaaaatacaattacgtagaaggaataaggtctagtattcagtagcacaatagggtgactatagttaataacaatttattgtatattttaaaataactaaaagagtaggattggaatgttcctaacacgaagaaatgataaaggtttgaggtgatagatatcccaattaccctgatttgatcattacacattgtatgcctgtatcaaaatatcacatgtatcccacaaatatgcacaactgttatgttcccataataattatcaattacaaataaaatataattgtatgtaatttagagtatcaggcatatgcccagggaaaattccaaactctaaatgtatcgtgtatttaagtggcatttttagccaagtgattcttttaaaaagcatctgaaaattaggccaacttactgtttgtttttgttctacagacatgaaaacaaggtattgatacaaatgctttctcttctaaaaataaagatctattctgcctggcctgaatatctaccaagtatgttaagtttcatccaaaatgtaactttcattttgggatgaaatgtttcagatatgcgaacacaattgacaaagctctaatgaaactgctgagattactgtaaaatatttatttttctttctctctctctctctttcatatatgtgtgtgtcttaaaatgttcctctcccagtctaatttagtaaatactgcaaccttaattaagctcagcttctgcttccagtgagcagttaatatttaatgatgatgaaactgttcccaatatttaaagaactaaacaaggccctccacaaacaatgtaactagaaatggggttaaagaaaatagtgataaagggaggctttttgctttaaaataaatcaatgcctcaaccataaatgtctcatggccttacagagaagaagttgaaatatgaccactgccaaaggatgcatatctccacacccaaaacaagaaaaaaataaagcaaagaacagagagttaattagttagcttcaaaatctatgaactgtactcccttagtcaatttaaacagctggaacaagacttattagaagagcagtacatgtctaaggatgtagtgttcattaaaaatgtgcatcctttctattaagcacgaaaagatttctggggtcattcaggccatggtgatattctagtcagtgccttttaattagcggaatccttattttggtgaagaaaaataaataaaataaatctactctagctccattgtgctttccctcaaaatcaagataaaattagaaaacttcagaaaacatctttctgaaaaaaaaataagtcagtttatgtctgttatataaggtaaatcaaattccattctcaaagattttgacaaagtggatagagcgaaagaaactaggtagtgtaaaacatcagtgtgctaatcttttacactcatttttctactaaagataactagactattaatttggttttacattgtttcatgtattgcattgacttggtatactagactcttgcatataaggtcaaatgatccttttcatgttaactaattcagatcacttatgaataagctgcagatattgtatatacagctttagctcatgttacttggcatgagacaattgttgatacacatttagacaccaggttgaggcccctgtaaaattatattttctattaatatcatgaaagtagtcataaaacataaactaattttaaaaacaaaactagtcatagaaacaaaactaatttgagagattttttagaatactgtaaactggtttccattttttcacaccatgtccaccttaatattaatggctaactttgttgtggatttaccacgtgccaggcattgttcaaagtgctttatatgcattaactcatttaatcttcacaattgaggaaacgggggcactgagaagtgaagacgcatgcccaagctgacataactaataagtagcagagctgggatttgaacctacgtgctctgtgtccagagctcatactcaatcaagatactgtgcttcataatactgtgatagttctaaatagaggaatgagctggttcaaatatttatactgtctgggccacactttccctctaagattataacaaagactgcatatcaactggctgttaggtatgtccagacactagttactagcacaattttatggcaaatttattttgttcaaaacccagggattttggatggcttgagaatgaataagacaaggcaattgaatgtgtcaaggcaattgaatgtgtttgtttttgtttgtttgtttggttttgttttgttttttaagatagagtctcactctgttgcccaggctggagtgcagtggcaccatcacagctcattgtaacctcaacttccccaggctgaggtaatcctcccacctcagcgtcccgagtagctgggactacaggtgcacaccaccatgcccagctaatttttgtattttttgtaacgatggggtttccccgtgttgcacaggatggtctagaactcctgggctcaagcgatccacctgcctcagcctcccaaagtgctagggattataggtgagggccactgtacctggccctaggtaaccaaatgttagaaatagccttccataattcctgaagcagaacaattagcataaacatgttatctgttaacacagctttttagtaaatgtttgcacagtagcatttcgctagttggtttgggagaagcaatgtccaattatcaggagttgggtcatgagggcttaagcataaacggccatgacttgacaaaagtaacagtccagcagtatcccatggagattgagaaccgatagaagtaggactcaacaaaagaggtggtctgtgaacttcatgactatcatcacctccctaagagaagaatcttttaaaaacaccatagtgccattcagaagcaagtttactcagatgacaagttgagtgctgtaggttcgacactatcacaaagcagagaaagtctccaaatgatgagaaaagatcaaccttaacacaaaatggtacaaagtgttcttctgaagcatttcattcccctaaggacaaaggcaaatgagaacgcacatgaactgcacacaccatttcacaaaagactaccccaccgaaagctcagtttcagaggaggttttagttaaatgaccgtaaagtagatatattttgagatactgcaaagtggaggtgaagatctgcggccctaggcactagggtttgactttttcagtgcttcaaatgtacaagtcatgtttctttcttttcttttctttattggcaatttatttttggttaagcaaacattattcacaaaataaaactaaagggtttcaaatacaaattaatatgtggctgcatcatgtaaacatgccaataaaataaacacaacaattctattctgtgatttatcattaggtttctccccagctttttaaaatgagaagatcacctgagcccgggaggctgaggctgcagtgagccattgttactgggggtccttgttcttagagctcctaagatggtggccggccacttccaagatggtggcaagcctcttgttctctgacctggggttcttggcctcatggattccaaggaatggaatcttgggccatgcagtgagtcttacagttctaacagaagccatgggtcacagaagagaaccgtggaacccagcaactagtgttcagctcgattaggacgaatccgggcactagccatgcaggaacaatggcaagcctttagcccgatcgggagcggcaatgggtgcctcgctggatcaggagcgcagcagacaccctgccggatctggaggggtggaagtcagcggcgggtctgcgacggcggcaaacagcagtggtggatggcgagtgaaagctcagctcaggccgtaacaaacatggaccagaagagtgtgcagtagcaagatttaatagagtgaaaacagagctcccataaaatgggaggggacccaaagggggttgccattgccagctggaatgcctgggtttatatccccatcattgtccctccctctgtgctctcaggcgatagatgattggctattttttttaacctcctgtttttgcctaattagcattttagtgagctctctttactacctgattgatcgggtgtgagctaagttgcaagccccgtgtttaaaggtggatgcggtcactttcccagctaggcttagggattactcgtcggcctaggaaatccagctagtcctgtctctcaccatgatcttgccagtgcactccagcctggacaacagagtgagaccctgtctcagaaaaaataaaaagtgactagacaactgaagatgcagaatccaaaagtatactaatagttctaaagacaatataatagggaaaataataacaacaacactgttatatgaatcaactgtttcggaagcaggtcacaggctgttcatactctgtcctctaatgtatttgttcccaagaagaaatgaatttaagtttcaataggaacacagtattttattagaaagagtgctaagctgagattcaagtgcccttaattctatttagttttagatcatcggtaaattattctccaatcgtgttaacttctctagaaataattcctgcccctacatactttctaggtgctttgaaagaaaaaaggaacaaagtaaaatttagtctgttttgcaagtaaaatcagtacaaaatgtaaaaaatatatttttctttattagttctttacaacagaactaaaatatttcccgagaattaagtataataactttgacagattataactactttaaatcattctacttccctaaaagaggtaatatattatcatagagtaattaccaattatatgagtaatataaattactatgtgcctagggagagaatttatatacgtataatgttaggaaactgaggacacttctcttattagaactggatattattgtcaaacagtcgctgttcccacaacttagtagtattctaggcgaaaaggcagaggataaaggaagcatatccaagctttaatctcatcctcgtaaataactaaaaggagaaaataattattgcttcttttcaagtggtaataagccagtgcccacttaggagactagtttacctagtcaagagacactcttttaccatcacaagcttctttaagatttagcataacgaacatccactttaaaatcataatgaatgaaacattcaaagtcatttgtattatataaaaaagcatggagcatcacactctagttggtactatttttattctaattttgccatgggtactgttatattttacttataacatatattaaaatgataacaagaaagcaggcaagtcattttttcctggtaagttagaaagacaaagccaaataagagactataaaagatgttaatggtgcttaaaatattaaaaaaaaattgtagcgaagtgattttaaatatcatttaaataaattggtaaaataataaaattgaatctcattagaaaactgtttataaatgtttgagctaatttttcatttttcttatttttcattttaataggctaaccttatggaagtgaagattgactcatataaatgtgaaatgtctgaatatactatgtgtgtgtgtgtgtgtgtgtgtgtgtgtacatatacacacccttttgttctcacagttgctacatatgaaaatttgaaggtccatgtgtggcagctagcaacacctacaatacgcctttcagggtacaaaaaagtcactaatcctttcaaagggttataatagtcaaataattaaaataacttcatttcttttgggttccacacatttagacaccagcatgattcttgcccagtcacctgttatgtagcattccataagtttctctatgctccacaaagatagggttctgtgatcaaaggatttacagaaattcttgggttcaacagaactaaactacactaacacgcagttaacagaactaaactgtctttcatgcaatacctctcagagccttttctcagctaaaaagcattgtgatgctccttggagggaaaatataataggtctcccaaagaaacattaagtcttccagaatagacatcatttcccttccaacagatctgaatatatatcaagaaagggccgtttgaacaagtggtgaggaaggaggaggcattagaggaacaacacagaatcctgagaattatgaagctttgaaacatcatccttaattgacaccctgctaaaccaattatggttttctctaaactaatggttcccaaacttcagtgtttgccagaattaccgggagagtttcttgaaacacaaagtgccaggcctccccacagagtttctgattcagtaggtgtgggtgaggtgataatttacatttctaaatgtgtccaggtgaagttgatgttgctagtctgccacatttttgagaacccctgctctaagggaatattgtcctatccgacaatggatttagttatttgctatgcattttattatggtactgataattcagtttccaaaaggtcatactaaagaaatttggacaccttaattctacatctctgacatcagtaatgatgttagcagccacgtaaaagaaggccggtctaggtcatgaagaaggattggccttctcaaaatctattctactactcctaggaaacacattcattttctgtttacaaagtagggctattagttatgatggtaagtatgtatatgagagctctgtattgtatgttgcttacatttgctgtataaacatttccagagtgttttctaaatgttttctgtgtacccaaatttgaacgaataaaggattctttaaaaactgcccctcagctctccaataaactcacacctttactcactacagaaatcccaatcatttgagaacattaccccttctcctcacccctaaaaaaaacatacctagaaaaagacaagctaaaaggaggaaaatactttccagatcgattaggcaaacaatttaatgctgaccacagcatttcagcacagatgatcaaaagccgaagtatcaatagattactaaacctcaaaataagcactgaatacaagttcatcagttgcaccctgcagcgaggaagtaaggaaaaaacacatctcatacaaccctttctccttttttcctaatgaaaaaaagtaaacgtctaaggagtttcaagtatttgttatttattcctttctgttttacgagtagccccagctgcatctggtttacttctgagtatcactggaagcccattttaaactgaggcccccagttaaccatactggaatgcctggaatacattaacatgtccaaatgaaaatcactcagatagccttataagctgcaaataataaatgcagaaatggaattagccccttctcttgttgacttgctctcttactacttagacaattacattcttcccaaaaggcttcaaaatgaccttcaagaaagatatttttgaagtaagattattacagtaactgtaaagactgatataatgggaaaggtggaacaatggagataattgtatcaaaaacttcaaaattctagactaaggttaattgctgcagctgggcccaaaaggtagctgtgagttttctggcaacactaaataggaaaatgtactgaattgcatttgctcctgtagcctgataaaagaaggcatactgtttaatacctctcctgcataaaagtaaaaactgtgctagatactatggaagaaatgaagattatgccatggaaactgcccacaaggagtttacaaatcttctctctcccataactagaggcatgagtagttgtgctggtgggggacctaggacttgacgcctgcttggaggttgtgaacagtggggagatcaaaggtaactagtggtgcatgtttagtggtgctgttgaaaatgaggaagagcaagttccatggggagaatgagacttctctgggccataattaatcacagctattcatttttgcttcaacgaaagcagaggagtttataatgaaaaatatgcgataaaaatggcacaaacaattctctcttgggggtggaggaatcccactcttctatattaccctcttttcatgagtatgttactctattcattacactttccttatgtttttgttacaaatacattattattggagctgaagtatttcagaatgaaaagcctttctcaatgggtgtctcttaacttctttctttcttcacccactccctctctccctcctttcctccttccttctttccttctgtttttttttttttaaatctctgacttggaagcaatgtcactttttaaaggtatttctttagtgggacaataggaaaatttggggagaaataagtgaaacatatttaaatgttttatcatttcaaagatgaagtaaatgtcacatgccactaaagtgaggcctcaagaattgggaaaaagggggagacagtcttggttctgttttatctgtcagttgcctattaaaatatgctagtcacaattatggaaatcattgccaaatgttgacaccagctgaatgctgctaaatatttaaaaatcattttaaggttttgttgttgttgttgttgaaacacttttctcaaatgttccagacaccttccctgtttttgaaagcagagtcaattgtccaaacctgaatcatatcttggttattgaggattgcaccaagacctcaggatcgcctgtacagaaaaccagcaatcattatccaggaatggagatgaacatggagaaagtctaagagactgggctgactgtacaaactccaagatatagtacataagcctagagatcctttcttaaacttcgatattgaaattactttcctattatttttcctatttcttttaaaagcatattgcttggactaaattacagttattgtgggttttttaaaaagtgtcaattcatggaccctctctattattatatttctttgtctttctatgttcaaactttttggactttcaaaatgtcattgtgtatttagaacaagagttctttattaaactttaaatatatatatttttgaactaggcagtcacctttttccacaaaatccctttttgaagattatgagcttgtacttgattagaatcaccttattagcactcattatgcttccaagaataccttgatttgcaagctacccatctgctgtaaaattcaacttcaaacattttaagacaaaaaatgctagaccattactacataatcacactaattatcttaaaaataacacttaacaatggccactaagtaattttttaaaaaaatccgtatataacgtaaaagcactgaaaatgtaacagttggagaatatccaacagcatttagccaaatatcatttctataatgctaagggatggaattaaatttgcaaatatcagcaatttgcaggccatcaaatctaggttaaaatgtggttgagtgaggaaagttggcacatgggtgtatacaattttcatctatatttgagtaaaaactgaactgggagtgaaagtacagctgcagatgaagagatctctgtgtacctctcagttgagcccatatttattctccctctttcaaagtgtttcaacaatctcatgtttcattcaacaaatatttttccaagccctaacgtgtactaggcacaaaagatatgttggtggacaagatagcatctaatgcaaaacaaaacaaaaagtatggcagactttcactgcaacttcaaagaaatctgatgttaagatgagcacaaggtcagtaggctggagggaaatatccactgctttctacttaaccatgttggcttcatctgcatctcaattccatcgctagttttcccttcccaccaccaccatctaaatcaaaaccttaatatttcataccttcaatacttcaacaactttctaagaggtacttcctcttgccagtctctttttttctgtcattttttttgcacaagctgatggtgtcatttctcatgcttcagccattctgacttaacattcaactccccaaacatatcacagttttccccctctatctttgctcaggttatcccctctgcctggaataccttcctattccttcttcaaagaacacctcaaacagtgtctctgccatgactccatcttcaaccaccactgctgaatataatcccagtccctacctgtgcccttggactgttgtagctgttagtttgtatctggcttatggcatataacacaagtaacctcttactaaaaggtcaggcaagaaccacatctttcctaactttgtattctccacattactgagcccagtgcctaacaagtaagaggttgcaataaatgtttgttgaatgaatcatttctttggggaattgaatgtacatacaattcttaatggatttaacaggactttcagcattaaataacccctgacatttatacaaatccttctaggaaaccacaaccaaatagtcttacaaattcagtgctgctgcttgctctcatatgaagagaaacagaggtagtaggattcccatgacataaggagcccttgttagaactgttatgtgtgacaaggcagcattttcgatgtttatgccacttgctgatagaatgtttcatttcagatattttcagtggttacatctagagttcacccaagaaaaaggtattttccaaaactacttctcaggctcctttgaaaaatgagacaatattccaaagtcaaattcttcctacagtggggtactgggagattaaagatggctatggttttaaaatttgttagtaatactgaagttaagactgaatttggttctatatagaacactttttttggttagtaaaaaaagtaaaataaccaggaaattgcagaaacactagagattacatttttataaaagctggaaaaaattaagtttgttaagtggaacaactcctaggataggtatttgtgaaatatttaaaacaagaacacagagtacatgaagctattaaaaatcctcaaattgttacttcggttttactatctttcacaaatgggaagatgaacaaagatattaagacaatgtgacaatgtggtcttaaaacaatgtggtttttaaaaatgagatctctaaaaagtatttggagctaagagattattgatactacaatgtaatctactcactgtatttagatgcatataaaagatggttaaagagtttaaagtcacagaaaaaggttttctgtttgcatttttgcacgctaagacagaaattagaacattactaccgttccgttagctaacaaatcatggctgatacataggacatgtcttgttttttgtcatatttaatggaattaaagggaatttgtcatatgtaatacatttatattactgtggactttacattttcaaatttttgtacagttttcaacgtggaaactgccttcattgtccactatctactcataagaatataggtagaagcaaagcctaatttattttctaccaatttccagtgggttaaaaaaaatttgagcttcaacagaaaaaaagcttatttatgatatacaaaaatccaatttaaggcatacatttaaatgcctatgaccgagttatagctgcaaaactgtttctaacagatagattctatagccatatctacttaactaaataacatattagacatgacattaagcaattttacataatctcatcataaacaagataccgaaaaatgatttactctatctctagatacaacatggttcaatccaaatactggagatcatttagaaaataaaaggatgaaaaacaaatggaattgtttactgactttaaagaaaacaatatcaagaaagatggcaaaaaatgtgagataaacttgtaatgacatctagcaataaaacttgaccctggggtgagaattgaaggcacagaaacaaaaacattgaaaacccaagcaggactgcaaatctggattagacatcaaaaattaaaaaaaaaaaaccataaatttaagaaactgaagaccgattatgtagcagaataaacactgaagaaaaaaaagagtatttacagaaaatagcagacagctaagattcctctggaatatataaccccataagtcagggaccaagtgacacactgagaggaaaacaagggtcacctcaaggatggtacatgcagaaaggtcatctgcaagggcaaacagaacagtaagtaaacaatgttctatgaataatgtcatgttcctagaagaactaattgctatttccggatgcacagaagtaccttgtatccacatttcgaaaaaatctgatatagagaaaaagacttcatttcagctatgctacatgaagagattatttactaaccaagtaggatcagatgtatattaccctaacatctaagagtttcttctagacaaaagagttgaaatataatagttttcaaatttccaatttccaaatctctcctacttaatggagttcctgtagcaaagggtcagtattaatggtaacatcaaacagtagttggggaatacatgcctggccctagcccaagtcttttctcaccagatgcccaattacaacttggccaggaagagatgattttgagctatgatcccataaaacaacactttaaataagttggattagattccaaattattgtataaaatacttgacccataataaggctgaattgctactgcaatatttcagctgatctatgacaggtttcttcctagctggccagggcattgtactaatgagtatataacagaatcagacatcaatgagtttcatgcagtgaagatgtgatacacagccacagttacaatccccagttctggtcagcaaactcaacaatgcggtgtttggggagaaggatggacaagggagcagagacagctcagtgttctgacactcagcaattaagcaaagtttagtatcacaaagttaggtaactttgtctaaaaattcttctcttctgccttattttcaaaacaagttatccaaataattgtccatgaactaaatatgaaggttaataaagtcttaatctaaattatcatgaatcagaaacaataaaagagggagggattagcaaaggaaaagttggcttatccacgccttactttatagtgcaaaaagtaaaggagaaccagaaaacttcacagacagtcccaatgtcatgtggagcagcatgactgtgataagagctggatgcttttggtttactaaagcaatagcctaattgatgttctctccatttccttcttctccacaggaaagaagactgaataatgattggaagaacgccggagtcatcaagctcttttgataactgcatatgtgaactaggtcaagtcactctccctcaacggatcaccagtttacccaactgtaaatggcaacaattttgaactgaacgttcttccttctacagccaaaattcttcgtttgctaggtttgtgaagtgcttttatatgtatgagcgctttcttaactatgaagatatctgagtcatcgaacttttggtgggggcaatctcatgatcagtcatgactagattttagagttttctcatccccatactcaaagttttttttttaagaataaaaatgaaaagaaacaata

SEQ ID NO: 3721 - DNA, 107650 bp, human
ggggcggcccttggccgcattcccgcccgtcccgcagcggcgcgcggagccaggtgaggttggcggcggcgccgcgctacctggccgggcggggcggggccgggcggccgcgtgcgccgcttccgagtccggcgctccggatgcccgcccgcgctccgctggcccgcggagtttcgcgggagtttccgttttggcgcctaaagcccctcgctggcgccgtttccctccgcgtgccgcgtctgtccggcgcgggacgcacggaggcgcggccccagcccgggctgcctggggtcggcggggctgcgcgaggggacgtctggcgtccggcggagggcactggcccgggaggagggcacgcctttggcaaaggccgggcggggttgggaccggggttgctatggtagctgcgagcccgggcgggagccccacgcccggcctccgcgagggagctggggcgctccgaggtgtgctccgagtggactgaaccaagagcctgggaggagcgggtagggccggcccgtggccttgtcccctcctcccacagcccgccggccggccccgggaaggggcctcgaggagcccagaaaagaaagtattctggcccctggaaccgaaaggagtcttgcaaaaagcacgaaggggtcaagggggccgaagggagagggggaaccgtcgcctccgtccgagagtcagcgtgcgcgtgtctgtagacttgacattttataccccagagcggccgacttggagccgggttgcaagtcccagccctgaagttctggaggtggggcgggctttaatttgcttatatctaatgatttcaggaacctcgctttaaaatggcggcattcagtatgcacccctgctaaaggctctcccggcaccggggccacctcgcgcagcgctgcttttgcttctgccgctaacagatggcatgtgccgctgtcgctgccgctgcccctgctgctgccgctgagagcagggccccttagcctctgggtttgcgctagcagcgtaaggtaaggctggagatgaattgggatttgtaagagaggctgccttcctcggacgccgaggaaataatgccttttaaacttcattttacaaaatagcaaataggaggaaaagtcatcctgcaactttgttgcgattttagagctttgatcattttcctcctcctttcctcctcctcctttttcttcttccttctcttcctcctcttctcttcctcctccccttccttccttctttctttttttctactttcttctttttaatttaaaggaacttcttgcatggcatataatcagcaaatgctttttaacaacgaatttccccattttcacgcgatatcgtgagcagtgccacagcttccttgcagaaccttgtctcttcctgccctgagtcaacacgtttgggcagctcgcttttactactggggtttgaagggcatgagagtagattttaggagactattaaaaagggaactttagtttttaacactcacacaataagcttttatggtaagaaaacgaaattaaacccagacgagtaatgaaagttgacatttaagtgattctttgttgtggtttcataattagggtaatagacctactgtgtgtttttctgagcactcttagatagctagctagctagctagctagctagatgatagataaaacagataaattaattgtggctctaattaaagtaatatgttttaaaggagttattttctcctagatgttcttacatcgtttgtaaattgagctgggatccccacagcctctccgtatttgtgggtagacttcatgggaaagaatcaattaaaacaaaacttgcaagatttaattttgaagtgattggtactttttttattaagcggactccctgctttagtgaataaacgtttgggtgattactgatataatgtttggaaaacagattgttggtatgtgggaatgactaaacatccatgcttgatacaatttatctgaattttgttttgttttgtttccccctccagtgaaaggtaaatagacaatgaggcttatcagacaccttggatttttcctgattatatttccatcttctccttggcccatgaaaatctaatcctgaatgtttaactactttttaaaataatttttaacttttttctaatgtgcgatacttttgggggatgctttcatatttaccaacacttcttcaaatatagactaaaatgggcttctgcccacagctcagctgataatattctatcgctgttcactccttctcccaaagcagtagaaactacttggttggcagacgctctgctactaaatttagcaagtgtgtggaaagggagaaaaatattgttttgcccttattaaagcatggtgcagttttctgcccaggtgctgtagtctacctagaaacaaacaaccaaactgtttacaatggaattactatacaacaaattttcagcagtttttcatattattcttgaaagaagtatgtggggcaattcattgcttcatgtctaaaatgagagttcctgcaggtagagcaataaacacttgcattttggtaaagggaggatgagaaaaagcaacttctcccatttttagtgattatggacttagatcccagttcagtactgtttgcttccggatgtgctaccttgctgctaaaagacttcggaccaaatgcatccttaaaaaaaaagaaaaaaagaaagaaagaaaagtgaaaatactaaaccttgaggccagaatagacaagctaaactggtgtcagagaaattaggaaattttgccagttaacattctgctgcctcatacagtgatgagattggagaccttatatgaaaacataagtgaaggagtttgtaaaaaaaaaatgttttgagagataattgatatagtgctgggctagaggtggtgactgcatgttttgctctacttctaagagctacttcatttctctaatttcctttgctactttaagcaatcgtaatgactcccaggactattataaagtaccttttttttcctcaactgtccacttcaggcatttcacaacagctgctttttatgattatgagctggtagcaaaggacctttggtattctcttgcaccaccctctacctagataatgctttgcacaaactaggtgcttaataaatgttacattaaaaagaagaatagcttataaactcacagtggaatagattttgggtacagcttttaatttaaacggaaggcatttttatgcactcacaagaacctaaacattcaaagaagagtagaatgtacattcccctagttgtctgcattgtatttgcttctaaagggttctcttgcctctcattgtacttccaggcacttgtatacttcatgcttttgaccagtaggtgtattattatctctccagcttcactgtgatacttcccagtatcacagcagcttgggaataaaaaaggttttgtcttttgagtgattgtatagtaccacacatgctggaacagtgacagtctcttgactgttgtgcagatgttgacagtatagtttagtacagttttgttctccacccagctgcctttatgtgtgagggacgaggggagggaatggagtgagaagctctaaaatgatgaagatttctattgataacattttacttttattctgcttatagtacaataaattcaggaaggtggcagaatttttctgttttcaaataaataatgttgcctgataggcttacaaacagggattggggcatagctgacagtacataagttatagtacatttttgacaagtaatttcatcctgtaattaaagttagataatggtcactgccatgttaacattatcaagtgtctgtaagagcatgaaggctacactcacctttacttcatcaaggttcttccatgctggtgagttttcttatgacattgtctactaggcaaaacagatggatttttcctcattcaaatgtatgtgatatcaagaaaatagaaatcagaagttgtgtttgtgggatttttctgcctttctctaggtgtgatatagctctcacttcaaatatagaaagaaacccgagcctcagctaaaatgagatggacacttttcctgaaagagaagaaactgtgtctgggagcaagttgtttaattgtcaattaaccaaccagcaaacaaacataaattataactgaaagaaagcaattagatctttcataatgtgggcttttaggtcttaaggataccagatggttccatgacattctgttcttcctaaatggttatctattgcctcaagatagccaaatgacagtgttggaaaggcaactttgagaattaggataaataaggtatcagttgtcttaatggatgttaataacatccacatgacctgaaagggataagaaaatattttttcagatcattgtagtaaaaatgcattattaactcatcatttagatctgcttggtattagattgagtgacattgtttttaaaagattgatggagaaaacaatacaatctgggaagtaggaccttatcatttttatttgagaaataatgggacttccaaattgcctgggcacacaaacacacacgtacatgagtgtacaaattagtggtcaattcaaaacaatgtatacagatgtgcattgctttctcactggaagattataggaaaatatttttacagtattcctccaattctaagaatgaaataaaaaagttcactgtaaactattataaatatttgatatagtgatgtcactctgaggctcaggaaaagaaccagggctttgaatgttcaactccaggcagttaactttcagaaaaaaataaaaaataaaaagatgctttgctcagaactcaagaggaagcaagaataaaaggaggcttgatttaaatgtgtgtgtgtgtgtgtgtgtgtgtgcgcgtgtgtattctccctttgtatgtgtatggtgattttcaggaagcccaagcataggactcagtttgacatgcttcctaaaatattatgtcaactctcaagttttacttgcatcagtattaagttggctcatgaggaaaaggaattatttgttttctgatttgaggcaggagtttgttttttgcccagacagtgagtgaacttgaagggcttagaaataaagggcctcccatagagaaaaggcaacctggacagaaatgcagggggttggcagtagagactagaggtcatttgatctctttaagccatgggagcatcctggagtctgatagttggctggattttgttttccatttaggatcacaaattagcttaaaattgtccacattggattcttgaatcctgagcttcttggcattgccttcaactggtgtggaaaattgagaaaggtttcctcaggcttactcaggtttccttgaatgtaccagtaactattcattaagcagaggttattgggtctctttacctcatatccctaatgcctggtagatagtaggttctcagtaaaagtttgttaaataaatgaaagactagattaatctttctaacttgtttttgcatgttacgaacattcttccttgtagcattatttctgttttttattgacaaaagaaaaatcaacaccaataagcagactgaacgctagattgaatgactgttctgctagaggccacagtagcaactcaagtccagggagatgcaagcagtgccagctttggggctgagaccttgaggactggcctgaaagccagctgctacttttctttcacctgtagttgcatttagaatacctcccccacatcccagggatatcagtcttcattacaaagaaatgtttacatagaaacagttctttaactgtttcaccagattaaaaatttaaaaaaaaaatcagaaatactgtgactctgatgcctcctgtcatgtatagtttaggaagtgatgaagttacagacaaaatccaaaaaggacactgggagctgtctcattttcagtcagatgttgattgcccatttagaggctggatttgcataggtttttacttaccaagatacaggtatgaatagtgcctctttttattgtgtacagaaagcaaagtccacacagtagaagagacaagagctgtcatttcagatccaccacaatcatcttttgtgcccagaggataatcagtctttaggtttagcgcttgcaatttctccttatgtggcagtacaaagtaaccaaacaagaggttatgttggagagtggcatgggaggggtagtctattagcaaaatgaaagagtgaaagaaccagagagcttacatttcaccttttgttttgtagtactcagcttctacgcaggaaagcaaaacaacacaaaacaaaagcaccctgtagaatattaactggacatgtatctcgtgaaataattccttacttaatttaccaatggggaaaatgggattgtcacaatatataatattaaggtggttgctttaaggttggattcatatactatacactggtttttctgagttccatttaaaatatgtaatgacaaattcaacaagacccatggcacagaggtggggatcacatttaacctcagtacccaagtgaagagtttgtattcgtcctctgaaaagtaggcacttgataatggcccagttgggggtgctgttttgttaaagggtacattgatattttaaaaattgtttgctgtctgtgatccatgaggatcctgaagaaaggatgggggcatttctttcagaagtgattttgagaaaaaattaaactcccaactcctttatgtcagcattttcccctaagtaattggacaacatgaagagaaaccttattagctcacccagatatatgaagtgaaacatagtacatgttatagagttacattttatatttaaggacttcccaataaaatcattagggagggactggggtaccatgcctgtgtaatctgatatgtttcatgaatgcctatagcagcggcctcagctgcagacagaggctgaggctgtgtcaatatgcactctgctcgctttctgaagccagggtcaaggccagactcagattgacaggctcgtcaagggagggccttttttgagaaagaccttggattttggcgggacttttttgtggtgtactttatatgtttacatttattaaattaacattgtaatgcaaatgaaaatgtagggtcaaaatacataacctgatctggagatagtgttaaacatctgcatgtgaggcagtttgtgaatttgaggccttaggtaaatggtcatcacgacatttagacatgacatcagaaccagggaggagaccagtatgagcagtgaagggctccatgtctgcctctaaacttaagttcagggtaggtcccgctcgccatagaagatgagttgaaaatcagtgttacccatctaaatgaggaggaagggctaaagcctgtggattgactagagggagggtctgggagttctttttataaacttatatgtatatttttaattgacaataattgtaatatttacggggtagaatgtgatatttcaatacatgcatacaatgtgtaatgatcaaatcagggtatttagcatatccatcacctcaaacatttgtcatttctttgtgttgggaactttcaaaatcctctcttctagctatttgaaaacataaactaaattgttattatcatcacccaacggtgctgtaaagcactacagtttattcccactatgtggctatagttttgtgtccattaaccagcctttggctattccccaacccccacccttcccaggctctagttaccactgttttactcactgcttctatgagatcaactctttcagcttccacatatgagtgagaacatgcagtatttgtatttctgtgcctggtttatttcatgtaacacaatgtcctccaggtttatccatgttttggtgggacttttgactgactcgcaagttgcccctctaccccatgtttaataacctggttttgctggggaattcatatagatgcgctgagattcagtgcagcaacaataccagggcagaatgcttttgctttctaactgaaactccccctccaaagctcttttgtgattgaaaagtggataggctagaaagatgtgtcctagggcttggcatttcacagtgctgaaaaaaagacaagactacctccatattttgtgaagagtgtgatcatcatcatcatcacatcataaaaggatctaaaatgtgatttgatttagagaactctcatgcacatactttgaacttgcacaagtcattttgtgggatgacaatgatgatgatgatgagagaaactctaagaagctagatttctgggatattgtagtctccagctctgtcatttactaatcaggcacatgaaaattgtggttctgaatatatattctaaattaacaggaaacagctaggcaacctaagatctgattttaaattcttttacaaatgtgggcttttattccaatattcattaaaatgcagtggttcaagtgactgaatctgtaacctgtgttaagtgaatgttttttggataaaagttacatttttcactttcaagcctagatcatataataggcctccttgttgccttgtgtctatccccaaagaaatctctgtaatatttttagccatctaagaaaacagttcagacagaggcactcagaaacggtgacaagcaatgacaggaaatgctggttgcactgggctccctcataacttagtgaggccacagctggctgatttgcttttaacttcctgtttggcggctatttgagtcaaaagtagctgtgttttccatatagagttttttttttctttattctgtaaggccacaataaatctgtcactgggctgcatgttttgtatattttatgaactgtatcatgtggtttgagtttaatttggaaggcagtgcttttacaatcaaggtccctcccccaccacacgtgcagctttgtggtctgggattgcatgggccttcgaaagtttatggctttatttacacaatagtgattgctgaggagggcatttcctgccagctaatgactggttggaaggaccaacagtccaaatccacggagagaggaccattcattaaatgccaggaagcgaccaggctgcttttctcatgaagcagtggggagaaagtgaaaccacattctgccctttgaagagcccagagcaccatgggcagagctgggtatggatgtggtgcctcctcatccatatggacaatggagctacttttcctaacagggacaaactacttctttctcataggttgccaaatcgggcctttgatgggagggcatttcctataggtcgatggtccaatagagactggccaaataaagttgagggccctgaatttgccattaacgtctgccagataattcttaactcagaggtgttacagctacttgaaaacctttaatatcacatgattgagtttcctaattggttgaataactcatcattagtaaagtggacaaaaacttggaaaggaatggaaagaatggtttgttttcagggtcagtttagcaggttacagatattttactttgatctcgtaatataatgaaggtaaataatatacatgaagagtgctttgcctttagtggaagtaccattgagagctgtaatagtaatcatttaacccatgacatttccaggaaacagttttgtcctcagtataattcttgcctgctataaagcagctgaggtgtgaacagtttggcattgatttagagcaaaaacagaataagatcgaggctgggttcacatccaggaatccctgacttcctggcctgcccttcactcccttagcttcctaagccttcaatttgctaaaaagttaaatgtttataaaagacaaacatctgttctgagttctttggtaggtacctccatataaaggaggctatgtgacagcgccccccacccccaactcccctgactccatgacttggcttggtcctttatcttgaaatttaaatttctttcatatcttccaaatttggtggggggatggcaggggtgggctgaatctctgaaatagaggcaatcactgatggccagacacctgcatttcttcatgggattgagtaatctgttacatgcagaacaaaccaaatattaagtttcatttttgagtctggcaaatgtcattacatgctttttaaatattcagtaatccagggattgctggtcattaccagttcacaaaagtgaaagggttttctgaagtttaaaatgttccacaaataaaccgtatactcattactgttgttattattagatgatgcccagagcagatttataaacaaaaaagcggctgatgaacaaaaaaatatatatttcaaaatatgattttaatttttgaacatttttgagtttgaatgttaagatacactaaaattttgaaagctcagatgaaagaccgtattcgatttagaaactggtttggactaagaacaaacaacgttttttgtaagtagattggcctgaatatttacaaacatttataattagcaacacagctgtatgtatgtatgtatgggtttatttatttatttttatttttggagttgaagtctcactctttcgcccaggctagagtgcagtggtacaatctcagctcactgcaacctctgcctcctaggttcaagcgattctcctgcctcagcctcccaagtagctgggattatgggcacccaccaccataccatgctaatttttgtatttttagtagagatggggtttcaccatgttggccaggctggtcttgaactcctgcctcaggtgatctgcctgccttggcctcccaaagtgctgggattacaggcgtgagccaccgtgccgggcccggacattattattttgtttagcaaaacctttctttataggtaatctaaaatacatatttcaagctgattcaggttcagttatcacaatctaaactagtggtgtcaaaattaatataggtttactctactgtatttggagccaacagcattaccttgtggtattagaaaagcctatttattctatcattgtaattttcaagtggtaggcaacaactcattagtgcataatgaaatccatttagtaggttgtgactagcatttctattaaacagaattgcattaaatagacagtaagaaaatatcaacatgtgtcatgtagtaagattagatatattgggtgagactgttatttcaaatccatgcacctgttactgagttaggatgtaaagtgtgtttcttactatttgttgccgtcagaaaggtttaaaagtcagtgttttagtggatgttatttctgtgtcagaaatatttttcctctcttttttgaagggaagatggtcaagggatgctgaaggctttcatgataacatacctagtgctgttggttcagtaccctgatagttatgtgtctgcttttcaaactgaacagtaagatattgctatagatgtgctataagatttaatgtccaaggtattttgcaatcctgaaggcagaaactttatatattatgtatttactaagtgctattgctagaacattgggacactgaaaataaaactatctgggaacaaaagccaaaaacggatgtttaacaacgacaacaacaacaaaatgacaactaaaaaccttgggacaattgggtgtgaggtgcttcgaatggcaaaagaattatccaaaaattttaaatgttggaagaaaatcaagctcattttaataagttaaatataagttaaagggctcaaaaattgtttttgattttcataaatcaaaaatggtcatagcaagagaatgtgtttgcaagaagaaaacaagctgattcataaatataaatgtttatgctgggaaaaaaacctgtgggtgtctattttttctgcggtgaacaaaggcacactttaaaatgaattttaaaattgtagatgaggcataagctgaaagtctgttaaatatacctaaaatattaatgggaaagattacagaaataaagaagaaaatagccacatagtctttccaatcactttttttgtgctaatgagtattgagcctagtagtaggaaaacataagattcactcacatgaacagataagagattaactactgaatgcaacccattaggagaagtctggccttagaagtctggccaatttgtgcatattccttagaattaaataattgtcagggggaggaaaatattgccttccgggggtactattgcatctccagtaggatcatgaggagtttgtcttcaccctcacctctcctgcagttccctcccattgtcattaaatctctttctgcctgggacatattgaattctttcccaaaagtctcttcctgtggacatccttcagagccttaaagcactgttgcttcctcaactttgagacttgacatacaataaggctttatagatatttaaatgttaaactgaagttactgctctgaaaatgtaatgtcagcttcttatgagttagtgactaaactctgtcattgtgagtttgtatctccctcctcagatataatacatttaaagattaagaatagaaaaagacttacagatctactgattgtgtaattagcaatcaatttatgaaatgagatgtaaaacaaattaaggaccataataaagggttacatcatcaccaacaaaacccgttattctgtttatgacgataaaaactaaaaaatgttgaagggtgaaattgcatacatgctctgatcctgagagctaaaggttttaattctttcttattctgatgttaaagctttttagaaagcagtaatacatattttggggggttataggatacctttgcccataagcatctgtttcactgtaaacatgtacagagtagtatagagtcagttgaataaggtgtggggggtttgagtgtgagttattcaggattttcagctgtaacaagcatgtagttgactgttctaggcaaacaaaattagtcattgttttgggtgtcagctacctttttcacgttagccttctgggatttttttgttatgggatgcttgacaaattaatagtgataagcaaaagctctgtgagagggagtgctcaagccaactaaacaccaacttatcattcatttcatgcagcactctaactttcatcaggctgtctgggaaatattgtgacgttttatataatattacatttgaaactttaaggtatacatggaactcaagacctttgacaggtgagtttgttttgtttattgtaagtggaaatttccttcagtaggcaatgagactgtcaaggcaaactttcttgtagaatggaggaggagaaaggaaggagagaaagagctgcatggtttcctaacattttgtttggagaactccttataccgcattcctcattttcatgaaatccaaaagaaggttgaaatgctgtattgctgttagcagagttttccctaaactagtaagtgagggaaaccccttcttcccaagaattgcaaccattagcactctcaggaagcctgcaatgatttggacataaggaaaacaaaatatatacaccttctatgtactcacaacattttttaaaaaataaaaataaatataatcatgttgaaaaaaaaacacttgatcatctcagatccaggagaggagctctggctcatattattcctcatgttggataatcattaaaacagaagaaaataaaaccctcttgaaatggcaggttttttaagtgaaaataagtaaggtttccttggacccctataaggagactcttgtgaagcatgcatccagacttctgagactttatactttttgctttctagagcaggaaagacttaagaaataggaagtcagaaagtacagtaaaaatctatgggttctgtgctgttaagggtccctttctgattggcttggtgtgaataatggtatagaatttaaccatgtaagatgttagaggcctgagacttcccttgacatttccttatgctggcaggcccaggcagtttgactttggctcttgtggcacttgggtggcaggagaaacagtgtttacaaccaccttcacctccaggaatgtattatacttttaaatcaatcttagtatctgtaggcaggagtttatatataggaataaaatttgaacccccattttcacacccaataaaaacgtcctgtaataggtgtttattcagagtcaactgacatttattgaacaattactgtgtgccagatgctctgctaggtactttcattttgttatgacagtttttttaagttatgaaatacagttggttctagctgggcaaatactctctttggcatctaatagatatcaggctaaaaattgcatcctcaagtccctgctcactttttgtataaaacacaccccccaacacacaatcatttcttctctgtcttgcttcatcatttgggaaccatctaatggcccatggcctgcctcttccatccatgaagatatttatttcattataaatcaagccaacactaatctgttacccatcttgatgtaacaaaaggctgctttcactgtttgatggatggtgctacagtaggataggagaaacaggaagaggcttgagaggtggatgaagagtgaggggtcaggagtgtgaaatgatgtggagttaagtgctagtgaaagccatgtagaaaaatctagaacaaaattggattaaacttgtccagaatgcagagaaaataacaaggcaagatgttggaagttaatccctcacccctaggagtggccaggacagcccaagttgagcaacacaggaggatttttttttgttatagaagcaaagggcaaagaaagtctctaaaaggagggagcaatcaacaaataccacaggaattatgtaagttgaggccactggttttggcactgaaaaggttgttggtgatttttgagagccaagaagctggtttccagtgggttgaggagtaagtgaaaagttggaaagtgaaagtggtaatgatgactttttttcagatatatgatgatgaaggatgagatatgttggaacttaaaaaggaaattgcatcaagggaaggaagggttttcttattaggatagagatgacttagatgtgcttactggctgatgagaaggaagcagaagagaatattgaaaatgtctgtcaagcatggaatatgttctgagtggctgccctacttgcgcaacatctctgttaatatgcacagtattaattgtgcagtctgatcaagtaattcatacagaactctggtgagcctgaattttgggtcctctttattctttttgcctttaaggtggaggattaggattgtcataaaagaactgggataggtacaaccaaaaacaaaaaaggaggagggggaaagacagtggaattcagctaaaataacagataggattatttttaaatggcttcagaggcaagacagtgctactgaaatagcgaaaatgtgactgacatctttttacagcacatactcaatgaaaatgaaagagagggttggggaaagctataaaaatgagaattcaaatgtaactatagaggatataggtttactctgatttgcctttacactaggattcagtgtctttcataaatttggaaatttaccatagacattacttcccttatgttgcgtctgacaacttcagtttttcatggattttatatttcaacttgtaaaaataaaaaaaataacaaacctcaggtctggttcaattcccctcattttaatcaccatcccctttctcccatctagaagaatatatttcctcttttcttagaagcttatgattattgatagaaaatatctctaccttctctaccttaagctttgaatttaatgtctaggttgattctagtcaaacaaaaggtgatgctgctctgaggttctgcaaatttctttttactctgaagcggaaaacgatgcgaattttcaatgcaaatacattgaaaaacttaaatctttgaagttatattgtagagatactaatgatctaaaccagcgttttcaaaactgtgtttattttgccacatggtctaggataaaaaagatatactaggtggaatgcctgagaattgaggttgaaacaaataccacattctgagaattaaattgcattaaggctacattcctaaaaatatatataaacatatgtatacatatgggttttttttgtgtgcgtgtgtgtgtgtgcgtgtgtttattcttctaaatttcagcttttagctttttatgctgcatttcaagttactgtgcaaatattacttgttgataagaatttaagaatactctatcaataggaatcaaagtagattaacggcatcttcatgccaagagaacagattgcacaaaatcaacaggactttagattaaaatatttccccaatgctagagaaaaatgtttcttaaatgcatttctaaaatgaatacaggaattttgcttttaattttttgtttatggtttctagtataaattctttatcattttatactggggaaaatagatttttatagtatcctatatagagaagcaaatcaaatggctttacatttagattatggaggatatagttttactttgttgaagtaaaaatattcagcaggtttaaattctgaaataatagcatgaatgagcttattaagcccatgatcaacgatttgcaactgtttgcttgataattggaaggattgcaaaggaaggcaagtttatatggttggtttaaattaaggctattgttttgagggaatcagccagccctgtaatcaagttgtgaactcagtgcatctctgaactaattaatttagtgtgatatcccctcaaagtccgtgttctgtgttaccaattagctacacctcataggaatcttagtccctctttcaggatctgcactctggtttaatattatgatgattatttactggattcagttaagaaattcaatttgcaaacagatcctttttgggtttggatagtatcaataatcaacattctcagaatccttttcctctgtaaaatagtatttttaacaagttttacacaatgaaattaagagaattaaaatgggaaacctatagaaaagatgtattttccccaaaagtctttactgcattatcttttggggggtatgtgtctgtatgattaatattacaataaataccaaagaaatgacgagttgtttgttgagcttaaagtggaaaaattccagcaaggaagacacaagtgagtgatgagagagtatttccaaacatatccctcttaaaatgtcttaagatggcttttcagtaaaaagcttttgcctccatctctgcccagctgcattttagttgagagagagaaacatttactttaggatgctaagtaccttgccttattcaaagatagagaagcctagtgtgaaggacttgtgatcttcgagaggtattcacttcttccaattcaaattccaatcaatttctcttgtgtctgtacatcatcagacctcccttttgtctgaaagtgcaagctcacatttagccctttagccccagttcctggtgcagcatcaatgttcctaaatatccacgttgacatccaaacttttgtatcctcttttcttggcaggaatttgattcttccaatactcaaattgaaaattgtgcccttaacatgtgtagagcagttggcacaaaggggaagggcgctaatttatctgactctagtcaataagcctacacaatttcacatgaaaaaaagcaaatctacaaaatacatggagaaaagttcagtataccagttgtgtgtgatgtctgcagttaaccttctatagcatatcaatgctggcatcctcccaaggcaatcttagcccaggaaatcactatacttataatcttggaaaattgcttcagcaacaaaatatattagatagcaagtcttctttttgtttgcaaagtgtatttacagactacgtatgtattatgactttgtaacagggcatcctaagtgctaaatatcttcccttcccccctgcagcatgtacacacacaaataaacatcggaacatctttaacttatatttaaaccacagttatgtagtatcttgcagttacattgtatttttatttatttttattttatgaaaagggggtctcactctgtggcccaggctgcagtgccagtggcacgatcatagctcactgtagcctcaaactcctgggctgaagcaatcctcccacctcagcctcctgagtagctagctggcaccagaggcatgtgccaccacgcttggctagttaaaaagaattttttttatagacagggtctgctatgttgcgcaggctggtcttgaactcctgggctcaagcgatccttctgcctcagcctcccaaagtgttgggattacaggcgtgagccactgcacctggcccagttatattatagatgtgtagcagttgtgaaaatttttcatttgtgttttcccttgtaataactgacctaaaataaatcatttaatcatatctttttattttaatgtaatattaattgatagccagtttttagtttcagagcgggtctaactgtagaactatccactagggagaaaaaagggaaaataattgatatcatattaagaagtggcgggaagaagtgatgtaattttgtacttttttctaatagtaacagctacttactctgtgctagtctctgtggtaagcactttgcacatgttatctcatctaatcctcacagcaaccctgtgaatttagcgttcttatttatctcctttttacagatggggaacatggggctcagagagaggaagcagcatgccaaaagacattctgctagtaaacagtagcatcaaaacttgaacttgatgctctaacattggtctatgcctataatccccatggttatattatggaaatataaaaaaaggtttgattgggaacttgagtttgctgcttgtcacttccacagtgtattagccatctaggattgggcactggataaagatagtgctgcttgaatgaagtaaacatctggaaccaccagacgcgacagacattacaattcacttccaaattatagaattataaactgttagaagtggaggggggaaagcatcatttgattaataatacatttgtacagaataagactgtttggcacaatattgtcagtaatagcaaccctaaatgtttcagacttttaaaagttgtattatggtgggatttactattatttagcagagctagttcctgatatttttctaggaatgtctcatttaggagactttaatgtaaactgttaaatgtctagaggaactatagcatttttgaaattacagcttgatttttccctgatatttggctccctaggactttcctatttcactctccttttcatccccctttcagtttttttgttttgtgtttttttttgtttttgcatttgttattcattcaacgtactttattgagcacatactatgagtcagccatgtttctaggtgctgaggatataactctgatcatgtaagtaattaattttagtgttaatgtaagtgaattagacatttttctataaattgagcctcacaaaacaccattacctttattgccttagatgtccttctttagcctaatcatgttgttttaaaattgtactgatttagtcacaatagccaaaaagtggaaatagcccaaatgtctgtcaactaatgaacaggtaagcaaaatgtggcatacccatacaatggaataatattcaggaatagaaaggaatggaatacatgctacaacatggacgaaccttaaaaacattgtattaaatgaaaaaaggcagacacaaaaggctacctacgatatgattcaatttatatgaaatgtccagaaaaggcaaattcagggacaagaaagcagattagtgttagtggctgcttagggaagaaggggtgggagcacagcctaagaggaatggggtttctttggtgggggagtaaaagtgttataaaattgactgtagtgatggttgcagatattattaaataatactaaaaatcactgaattaatactttttcaaagggtgaattttatggtatgtgaattatattgcaataaagctgttattaagaattgtactgacttagatatgatatatgttatattattcccattttagaattacaaacttaatcaatagctaaattgaggggattgttgatctatttttaaacagaggcaatggattggaataactttggattccacttattctttgttctttatgggaacagttgatttcttacctgaagacccacatcaactatctctgttcttacagatgccttcctttttggtcccactatttactgggcacttggccgtgctgccttacatgtggaccaaatcattgccttcccaacatctagcacaatgtcttccatatgacagatgtgcacaacttccattggtttagcatgtacttgttgacaacttatttgtatgtagtattgagccagacactagagatgaagatgtgtcctcaaggagctcacagtcagccagacagctaagcaggagttacactacactgtgacaaatgttgaggtggagatgggcagacatgtttgatggggatgctgaaaccctgcgtatagttctgtgtctggatctagttcattcacttatctgatatggataccccatccacggtattcttctctatatttgaacacatccagtaacaagatgctcactttttactaacacagtgaaattaaactgcatttttctaatctaccaaatgcccatgtattttgacatcaaatccatatagtacaattacatagtttgtaaataaaacttaaatagagctgttaacattccttggcacctccagaaatgatactatattgtaatagaactttgagtaatctttattattttatagaaagtacttggatttttaatgtgccaaaatctctggtaacaaacatgtataaattttagattatgtttgtatacttttgtgcccattagaggcagtacagagtggtgattgacagtaagcattttggaacatgcctgaatttgatcctagctcttccactcatctgctgcataatctcgaaccaagttacttagcctctctgtgtctcagtttcctcatctgtgaaatgggtacagtaatggaacctgccttacagggtagttatgagcagtaaatgaattaatatatacgagtgtgctaaaaacagtgccttgcacatggaaaacacatgcatattttctgttgttatattttcaattcaactgaaatgccatgttttattagtctgttcttcataaatcatacacactcaccgttaaatgacattcaagtcattggaaattgaatgttccttttacagggacctatagtttttgagtgttctcacaccaaaagccagctagattttctggtatctgtacttgaaaataagaggtcacggttgacattcctttctgctccttttgcgtggtcacagagttttataatgtcacatgcctatctcctatcagttagcttgataaaatctctatagctcacacatgatttcatgccaaaggatcagtgcttttaaaatgtttgatgcatagttacaaatccacaggaaataaagcataaacagtgttggatttacactttttgactgcattgatgccattctgtttgcgagtcttgtgatttacaagggcattttattttagtcagccagtagcatcattggccagtatgctgtctagggaccacaattcagtggtgacttgcagtctgtcttgctgataaatgtttttggcagtgtttgggagttctgcttggtcaaaaattgacacatacaaagtaatttagaataataacaaattaacattgagattattgcttttgccttagtgcagatgcaggttactaataacctttcatctttcaatattgcttcatatttattatttccagtacagtgatgatatatagtcattttcaagattaagcagaagtataaacattgaaaatggcctaaaagagcgatggagctagtttggcacagaaaaacagaagcctgttgggacaagatgctatactatgtgcgacttagtctggggtttacaggagattcacttttcacttttaaccttttgggaccaagttgttaacaatgtctcattgtacttagatcacaattttatctttgccattaaatgtaaatatattgctgttaaatgtaaacatatgactgttgtatccacaagaaagtttcctcagcaccaataagaaaatgagttaatgatagttcttatgtgtattatcattattaatttttaatcagaacttcccttaaataaaatgcacaagcagttaagttgggtttacaaacttaccaacaaatagtctttataacctgctgtaattatctctagaaattttaatgtgttcagtgactaattctccagagcttttactaagataaataaacagaaacagcaataaccagtttccttgtatttcttaattattggcgtgccttttagtcgtgttttagacttaaggagggctgtgtctctctctaggcatgcaaactatgctttctcctagttggcttcctggaaaatctaatcctccctcttgctcattgactcaagtccaactaagctcttgtatatcgcttcattttgtgcatataatgtcaagggatttgaatgtgtggtagtagtctgatagtatgcatgtgtatggccatatagtattgaatagtattgaatatttattgaaatacttccttactggttagtaaatagatactgcctatagtaccctttccaatgctcactccctgacaaccccccatgattcagcaacaaatatggcaacacttggcagaacaccatcagtattgatttgcctgtgaccatgctataagaattgtttaacattttgagtgtcattcctggctcatggtttactatgaggtcagccccctgcctcaccgaccaggccattggtgctctgtgacattcacagccttttgctgaacagtttttcccagattgcttcctaaacatcagctagacttctgagagaagagctgtatcccataaagaaatggcatactacttccagacctcagcttctaacagacactgtagatctcatgaaggccaggcccttaagcatttaaaacatactcatagggaacctcccaaggccctctctaagatcactcaagagcccatgtcatttatattttaagacccaaatcttaaagactcttgattcaataccttacacaaagcaattgtttgctacactttatttgattgaatgtgactttgcaaaccacagaaatttaatcagtgtgtttgtgggggaattaatagaggcagaggcatagtgaagtcatggccaataaatagctgccagtgaggaagaagatagacaaactgtaaaaagtggaaatgaagacaccaaaaacacaggcatttggggccgtttaacaaagtgcccaatatatccttcaaggcattactgaagtttctttctaatgataacctagaattatcagaaaaagcattacttttttcactgtcttatgtctaagggggaacaacgttttacaaatcacttcagaaatatttccaaagattgattaaaagagacaaatatcaatttataagggttttgttttttgaaattttattcttatggatctccttgcctgacatttttccaataaatgaaatgctgtaataagaactgtatgtgaacttagggacttttgtagtatatgatgggcttgcaatattaatcaaaattatttgtcatagaaattatcacagtgagaaaattattttgggaccagagtcagcatcataaataagtatctgctctcagtgaaaatacttccaaactcatagagtttgtttgtgaggtaaaagaacacataatattaatcttcttagtctcttttttcaaagaaatatgattgaagaattattagatatctcactgataacagtctaagggagcctgttcaggaaatgtctaaaatgaactggtgtcaccattgaatgtttacatgtacaccttttacttttttataaatatgcatttgtatttggagggaaaattatttttctgtcatcaatatcatatatgcttcaaaatacttgtgcattatttaaaaatagaaatgtggactaaaagaagaacgaagatgaagaacactaactttttaaggttcgatttaccagtgtaacttttaaaaaatatcaataatactttgcttatcatatgaggattttcaagtgctgtgtgaatgtgaatgctcacaataccctgtgctataatacagagaagataatattatacagatataaatgttacttgtgtgtgccaacaaccacatgtattgtttccagaatcatagcttttaaagttaagtttagctttgtaccattcatagtgtaatgagcaacaaatattccaatttatttaaaagtattaccactaccataacaaaataaatacatagtagcttacagcttacaagatgtgccctagagttttctatgttcaaatatgcacacacacagtaatttaccagaggtaagctttttgatagcctgtatattagaatcctatatatgctaatatatttttgaaaacctactatgtgcttagcaccaaaaagtctgttttacttccctttttaaaaagtttttattatttatttatttactttgagatggagtcctgctctgtcacccaagctgtagtgcaatggagcaatctcagctcactgcaacctctgcctcccgggttcaagcgattctcctgcctcagcctcccaagtagctgggataacacatgcatgccaccacgcccagctaattttttatttgtatttttagtagagatgagggtttaaccatgttggccaggctggtctcgaactcctgatctcaagtgatccgtgtgccttggcctcccaaagtgcaggattacaggtgtgagccaccgcaccggccagatggtttttaaaacaagctcttcttacctctccttagcatataaaatgtatttggatagtcaatacaataagacttttgtgtggttacatctttagttgatacagcaccattccacttaccactaatggtcttgctgatttttctattggcccgaataagctcgtaaagaaatggcatatggaattaatgtttttttggtgttttaagtttcacttctgagttcccacctagatgtgaaaaccaagagccccttcattctttactgttattttatcaacctttgcaattgtgaggagaagatattcttgattttaacttagcatcatatttatttacattgtatgatcatattatttcttttcactgagggctactgatacattttctcaggtgcattgaaatattaattaagtagaacccaactgtctgaaacccacagtcgacagaagttttatttgtatttgattattaggaaaaatttgaatttaccaaggattcagtgttaagaaaagtataaccacgttctttagtaatgagagaaagttttaattccgtttacgatatgctgtttaccaagacaaaaacaaggacttgtattttgaaatggtttctatcaaaagtggtttttagtaaccatgattaaaaaattaattccgtattttcattaaatgaatctatttcacatttctactgatttccaacaatattgtgctttatcttttcataaaacagaggaagaaaatctatttttctcatacatccattttttatgttcataatctcatgccacattattctcccctaaccccttaaaaattgcagacaaattttttagggacagtgatggcttaaccttttttaactttggcacatatacagatcatgtttgtttgatagattataaatgagaaatttatttatttctaaatcttacacagtgataggaattgctatgcaattgattgagttctaataatctgtatatcttaaataccacagaatgagaaaaagcagtcattgaaaaggcgtggttttagtaatttcttaacattttatgggatacttttttttaaaattgtgtgcgaaactccttatttttaactagccactatgcttgcaattctgttatctgccactaggtggtgcgtggttataagttgtaaccatctgggcttgccgtgtgtggataacaatgagaataggtttatagtacacaactgaattcgattttttaatgaaaattaatgattaaaatggtcaatgtaaatattccttttgtttgtttgttttttgagacggagtttcgctctgtcacccaggctggagtgcagtggtgtgatctcggctcactgcaagctctgccccgcccgggttcaagcgattctcctgcctcagcctccggagtagctgggactacaggcgtgagccaccatgcccaactaatttttgtatttttagtagagacggggtttcaccatgttggtcaggctggtcttgaactcctgacctcaggtgatccacccacctcagcctcccaaagtgctgagattacaggcatgagccacggcgccccgcctcaatataaatattcaatcagcttccaagtatagtcagattggtatgcatttttaaataaatgagagtgcgtaattatgagtacttttctttcaccaaactttaaatgttttaaatcacctcatgtgctttctttagtttttctttaaaggagaacttgattctttacgttattcaaaatttttttgtttattaaaaagctctgggccctatgcttatggacaacttcccgtggctctttgcttatagctttctcttctattgccctagttaattgttttgctactagttctaagtgccctaaataactaaagtctggtttagttgggtttcaggtgaagtgttaagctctagcaattttatataggaaagaactgtgtcacgtattgaatacagtgtgtgagtagttttagctcctttttgaccattagacataagattccacacctatgtccaaaaataacaacacacacacacacacacatgcatgcacacacacacacatagtgcaggtgtactcacccctccacacacactggtttctaacagtatagtatacatatgtggacatgtggctgtgtctttctttggtctctgaaaatgtcctgcagtggtctctcttccaccaactagcttccagcttgtcactcattctaacttatgctttcttgtggactttgatgcttggattggtataaaaactaatttgcatcaaatagtgaaattacctgtgaacttctctagcagattcccagcagttttacagtctgctttgcaaaaggaggccaatagtctatttctactgaatttttgaaaacatttatttcaacttcccattcaaaaaaatagaatggtttttaagtagagacatagttgctttagttctttgaccacatgtattatcatgccatgaaaattgggagtttaactgtaaagagaaacaggagagagagggaggtagagggagagagagattgagattgggaaagagattgagatttaaactttctccaaaatgtagaacaaaatattcaactccagttatcagaactgagctcttgtgttggctctgtcaccctttgtgactgtgtcatttatcctctatcgtcctattgtcttctctgaaaaatgagggagttggcctgtagatcatcactgcccacattgtgagtctgtaactcaggctttcatattaaagcaaaaatgtgggggaatgcatagtttcaggtctgcttgcattcatgattgaactactcaacttcctataaaaagcacagattcttatgtataatagaaatatgtaggttcattatttttatttttatttcttgcattttctgaatcatctgctatcaatgtagtgctttgcacttgggatatcttgttagatataccatattcccattcatgctaaaggaaaataggaaccttgcaatgattatttttttgtttacatagatacagtcattgtgatctacaagaaatactgccattggataagagagtgcattctaagagggcaaagcttgtcattttatattctttttaaataaaaaagcaagtgaaattcagaacttaatcatatgctgcctctgatacttttggggtgtgagattatctccccaactagattataagctcattgagagaagaaactatcttgtatgcattttgtgtcacccaaaagccaaatgcagtgctatgtacctagaatacaggttagaaatgcacttcctctctgatactataataataagttattgactcatggtatcttagccttgtgtggtcgtttgggggtttctagcccaacttcccagccagtgtgacagaaatccagtgaagaggagtgtaccacccagaaaagcatttcaaaacactttcggaaagctcaagctgtgagaaggctcttcactgtgttgagctaaagtgtatctctctgtaccttttacctgtagatctttctggaaaaacagaaagcaaatgaaccacttgtctttatttttttcttgttcatccgtgttcatctccagaatttatcattttgtaagtatttatataaggaccttgatggcttcagagcaaatacataacaaatcattttttaaaaattgagtcattgcagccataaaaaggaacaaaataatgtcttttgaagcaacttggatggagctggaggccatgattctaagtgaagtaactcaagaatgcaaaaccaaataccgtatgttcttacttgtaagtgggagctaagctatgaggacgcaaagacatacagagtgatataatggattttggggactcatggtgggagattgagaggcgagagtgagggataaaagactacatattgggcacatggtacacttctcgggtaatgggtgcaccaaaatctcagaattcaccactatagaattcatccatgtaaccaaaaaccacttgtacctcaaaggttgttgaaataaaaagtaataataatttaaaaaattgagccactataaagtaatggaataaggtttgtcagatttctatttctacactgaatgagataagttcaggtgatttatttcagaagcacttaattagtatttactctgtgccagacagtattctaagtcctttacaaatattaactaatttcaatctacaaaacaaccctaggagatagatactattactgccaccattttatagatgaggaaactgaagtacagattatttaggtaacttgcccagggttttcaattagtcagtaagaagtagaatgatgatcaaggccttctggctccagaatcctattcttaaccactctgctatgctgggataactgttacacgtttcaaaaaattctaggacatttaattttgtttctcttgttctcttaagtaagaacctagttgtttaaagtttccaatttttcatgagaacttatttaaaaattaatcttaaaagatctggaaaagatattgctttcatttgttctgtttgtgccatcttgaagcactctacctttatttattttgattatataaaacttttgcctgtttaattaattgacattgctactgtctgggtaagttttactatagtctctaaggatgctgttacatcagctctgttttctatcccttgggcaactgttaacttttttccgtctaggtcccttgcactctcccacactttatttaaagcttcaccttggctgaagtcaaacctaaaacaccaaataaatactataattggctcatttttaacattttctttgaattcctaacagcccatttaccatatctgtcattaactgggatcttggctttattgagtgcctacctcacaccaagcatttgcacatctgtcatatgacttattcctgctaggaaactgagatactgagtttaaatatctggacagaggttcaaattcaggtctttgtgattctaaaccttattctgtagtgtatacaacaacacactttcttcacttctctgggtctggtcttagtttcctcacctgcaaaagggaaaaaaatatataaaaagtagactgagagcctattaagtgttaggcaccaggctaggttctgctctgaaggggttcacagaaatagacaactttaatttaatgggttcatggtggtgatgtctgtttgaacagtgttttgagtacccattgatcccttttacttggtgtaaatcaaaagctggctctcgcagaataagtaggatttctcccattctaaggaagcacattccataatcctataagacctttaaatatatttttaaaaatcaaatttatgttgtactcttctttctatacacaggtttattaagtatgtggcatggaaattatagtttgttagactattaaagttcatgagaacaggaaccatgtccactgccttgtactaatacttaatacatatttggaaaacaaatgaaagaaaaaatagttttaaatatggagactcttacacaactgacaatttgaagttttaatgagtaactactatatagtgcacactacctttattatttatacaaatttcaactcaactagtatttattgagaatctagtatgccaagtactgtactaggagaggtaatattcaattcaaattaatgttctacttgaatgcagtcattgactctaggggagttttaatagaatgattgatagaagccatattgtagtacatgctggagtgattaagggtgaagaagaggaggtatcaggtagaagaagatatttcaaccatgaaggctttggaagccttcctctagagggaggctgagttgaagtttaggaaagtcacatggatgtttgttggggagacaaaattacagctcaagtgatagtgggaagaggcctgagaaacatggtcaagggatagatgggttctgctgtggtttggatgtggtttgtccctgccaagactcatcttcaaatttaattgccaatgtaatggtattgagaggcagtggggcctttaagaagtgtttatgtcatgggaattccaccctcacaaatagattaatgcagttctagtaagactgggtttgttctcatgagagagtgttgttataaagtgggccaaccactttgtccccctttctttcgcatgtgtctacttgttcttccacttcccactatgagttgaagcagcacaaagcccacgccagaaggactgcctaatcttggactttcctaccttcagaaccatgagccaaaataaatttattttctttataaattacccagtctcagatattcctttatagcaacagaagatggaccagttcctagtgatgatatggtttggcctattcttcagtaaccttgtgggcctacacataagttttttttttttttaatgaagggtatataacatcaggattcctaaaatcatatcacttatccactaagacattttttgaaatttgtttgaaattttgaaaataaaatgtaaacatgagggactgtggcttatccatgtttgtaccttcaacatttagttatgtggccctgagttagttcttactgtgtgtttagtgaataaatttatagaaggttaattatggataactgctattgatatacactgaataaatggatataagccatctaccctaaaaaaagatttagaggcctacatttacctgcctgaaggtaatgagctagacttgatctttcagagttatttccagttctagaattctcaaaattcttaccctttactgaatgaatcttatttgacttttgacaaacctgaaaacatgagttgtgttgtttccgtaattactaatatgaaagctgctttgttgtttgaggcttgagtatcttcagtggaacaattgtttagtagtacatgtaatagataataccatccatattagaccctgggaatttcagcctagttttatgtcagtgtgagttgaagaagtttgtatttgctgagaacctttatgatcttttgtaggattatactgttattttaaatagaatgaaggcattttggttccctttctgtatatggaattatatggctgtcagatttaatagtttaagccattcagtacctagtgacatagatgatacctacatcacatgattcctacctacagtataggaatccatcaactttgatggactttctcttcacttcagtataaatgtaaatgccctctttaaattactatttaagccatgactcctcctcctccatctcctcctttttcacctccttcttttttgcctagccatttaagctgagttgatttttgagatgattcttaatctatagatatcttcttactttccatatatgttggtacttaacaacatatatgtacagacttgcttgcttgtttgacttcagtatttcccttgagttttattttcaaatccctgttttatttgtaggctcttactcagatcttgtcctgaaaacctcttgtggtgaaatctttttttaaaaaattttgccttctttttatgacttgcacactccagattttgatatagtaaatttacaagttagcaacagagttgaatttgtgaaggtactgacaatcttgttgtagtattatagcttcctagttttttcataatttccaaatcttggttcagagatttcactttgatttggatagccatttttttggtagaaaaattttatttttagagcaaggacctaccgtgcccaagggcttttatgcttcccttctgccagctggttgccagatttctggaccacatgttcttttgaatgatgattttaaacccactatgtcaagcagtttctaacttatttgccagatatgtatgaaaacatataccttccaaattataagcaattcaggatgctctggcttccatgggtagggagtagtaagctttcttattgtcatttcaggaatctggggtgggggaaatgagaacttggagattttttattggtgtttatgactcttatgatttctgagaaatttaaatattgaaaaactcaatacaatgatttggtaacaagtctagaattaaaatttgtgaaagactgatttggtttttaaatgaaattttaatgttgccctttaaaagtatgtacctcataggatattggggatgattaaatgagaaaatgaatataaaatgcctagcacagtgtctggcacagaataagagctccatacatgttaactattattaatatctattacttaataatcaatagattgaccttggaagatacaaatacctattagttaataacaaagattggctttagaatgcgtcatatgatatgctcagcaaggcaaatttatcttcctcattgtgttctagtggttatttgtgaatcctaaactcactcttagaattcttacttaatacaattcccagtatcccagttgattagaaattaatatagaaaatattttgtgtagacacagtttatccagaccagaggataacaggagaaatgggctcacagaggtaaacacaggaaaaagagaggacaaaccaaattatttgtttaacagaagaaatgtgccagatctcacgagttttggcttgcaacagactgtggccaggagggtcagatggttacaaacaggtaaactaaatctgattctaacaggttttagaaagtagagaggatcaggtagagtatgatagaaaagctgaatccaaagtttggacaacttgtagtagagaggcaattgaaacaaaaccatgtgtgcaaagaagatgttgttctctgaaactgaacaagggtgtcacggcagttgtgttgaaattaatggaagacacaggcccacagaggtcaatgaatctttataactcagaagcaagcgattgcctttctccagggatttaaagctacagaagatgtccttctggttttcagtagtgtgaaaatgcctccatagccaggaattaagttccaacatgaatatgagctgtcaataaaacaaactaaatgaaccgggacaattgggttaaacttttgggactctgcctacccattctgatcacagattgccaagatatcagataagatgaaattacagcgtgagctcttcatgtgtacactaaaaattttaggtattttgtccaagtaaatgaatccttctgggcctctgttcaaggttgaagtaatcagtaggttactttgtccctcactggctttgataactctattatgagcccattttatttggaatattttcatatttgatgtatacttgattgtccgtatcgctttttgatatccaaaacgtggatttaaatcgcatgccttgcaaaagtcgacacagaagttgcttccccatttattgacgcaaatcagagttgaaaatgatagatttcatagcattgtttttattgaagatgagtattagattatgtgggtaaggtgttgctttccaacctcatggtataattaaaccaatctcctttccagctcccctctactttgggggttctataatctttcttttgagatttgttgagattgatcttggaagatggaagagaactattctatctgggccaagaagatgactttataatgactgtattatatttacacaactttctttagtgttaacaaggacattgactacttggccaacattcaattaaaagatgtttaaaagcaagcctatgttgcagttcctctaaatttttccataaagaaaggcccacaatttccagtgaagcataaatcactttggaatatcaagagaaaaatgaaaatttttattttagaaacttttaaagaaggataccctcaggcctgtgtaaagattgggaaatgtagagcttaagactgtatcctgtctgtgctcccagcatttcactcataactttttactaaagcagccaactttccaatgaactctaggcagttggtttgtagatatgtatttcagtcgtgtgtgatatgaatgtgaaataatgcttctagaaacagtaagttgagacacaaagggttagagctcttgtgtatactttcctagaaaattcactttcccagaaaactcccttcaaggctactggagggtttggcattggtctttgaaatcagggtacatttgggactctcccaacattttcagccacagagattttttctcttataagtgctcctgataaggagaaggtacttagtatggagattgagaatctgaatttattggctataatgccagtgatgaactcaggtaaggaagccctcacaggatgcctattaggtatagtagtgaatccctttacgacattatatcacatggatgctaccttagtttacctctctgccaaataattatccttacgtgaccctcatgtttgactagagaattacttgagctgtttataattaaaggatgaataaacatttagtgatagcttttgatatgtgtgtgtgtgtgtatgtgtgtgtgtgtgtgtgtgttggtatggggaggtgaacagtgaatgttcaaccaaatcttatcaatgaatatcttggccaccaaaatttaatttgattcaattcaatatgtactttgggagaaccatgaacactttcttttttctttttctttttgagacagaatttccctctgttgcccaggctagagtgtaatggcatgatctccattcactgcaacctctgcctcccaggctcaagcgattctcgtgcttcagcctcctgagtagctgggattacaggcatgtgccatcatgcccagataatttttatatttttagtgaagacggggtttcatcatgttggccaggctggtctcgaactcctggcctcaagtgatccgcccgcctcagtctcccaaagtgctaggatgacaggtgtgagccaccatgcccgtccacatgaacactttcagaccactggtttgaaaggggtgctgcttaaagccctatagcaggaatttacaggatgccattatacccaaaaatttattgttcaaatttagttcctggtatgagcttattatttagcaaaatgtaacaaaaaaaccatcctagttgaaagttcaactacatttttaaaggaatttctattatagagataaagattgaaaagtatttgagtcagttcagaaaataggaatgctgctatgtgtccttaatgactggggtcattgataaatgatgggtaggtagcaaaatgcaaagaagaagctataattttctgtttcccaacctttttatgttggccggtcttgaaatactctctatcttgtcctcacggagcctgtgaagtagagaaaaacactctgacctttatctactttcgcttcaccttttgttcttccacagtacgttgagtgcatgaactttactctgactctgtgctgtgggctccttaagtaaaccaattttccaggagcagatcattgttaacattctacatttatggcctgtaagattctgctctgcttcaagtctatgagagaggctccttcttctataacaaatatatactccttaggtcactttccaggttcttcagaaaccacccacacattatttctcttccccagtataaacctaccatcctaaccagcccatgtatgctcaccatcctacacacgccaggtgcccagtctgatcttccagcccttattcatgctgcttcccttttcagaaatactatctgcctctcttgccttcatctagatccttctcattctttaaggcccagctcccctttcttcttgaaaactcctttaactactccagactttagtgatgttctgttctctgaactgtcatcagatttgttgttaatgttaccaaattttgttcttaattgtctgcattgtttgcagacatatcatatatgttgttcttacctccccaactaaattaggggcttcttgagtgcagaggcagttccttaaggttatactaattcccaagaagcacgtgatacagatctgtgcaggtagttggtatacaaaacatgtttgttgattgattggtattttcctatattaatatttttaaaggttttacttgcattgatattaaatatttgttgattggataaaatgaatgatggaatatatttctttgtttattttctgcccctctggccagtcctcacctgctaccactcacttgaatgtacaagtcaaaggacagggcttttgtgttgttcacctttgtttccccaggacctagataagggcctgggccatagtggatgcctgataaatgtctgctgagtgaattgtcagcaaaatcaccccacgtatattaaatggaatcagtcttggaacccatttagtatttcattcatctcaaatgcttgagtattataggattggaagtgccaaatgtgtcaagcttcctgttgtcttcaagttgaaatccagtttttggtgaaagaagaccttttaatggcactgggatttctgtcacatgcacatacgcaagcacttaatgagtgtgatttaataacaactatgtttaggatccaggttttcagctgttttatattaaattgggctagtttaacatatttaagtggtggattctgggtgtagagcaagatggtagaataggaacagctttggactgcagctcccagcgagatcaacttagaagacaggtgatttctgcatttccaactgaggtacccagctcatctcactgggactggttagacagtgcgtgcagcccatggagggcaagctgaagcagggtggggcgttgtctcactcgggaagcacaaagggtcagggaactccctcccctagccaagggaagctgtgagggactgtgctgtgaggcacagtgcattcaggcccagatactatgctttttccacggtctttgcaacccacagaccaggagattcccctgggtgcctaccccaccagggccctgggtttcaagcacaaaactgggcagccgtttggggagacactgagctagctgcaggagtttttttcataccccagtggcacctggaataccagtgagacagaactgttcacttctctggaaagggggctgaagccagggagccaagtggtctagctcagcggacccccacccccacagagcccagcaaggtaatatacactggcctgaaattctcgctgcaggcacagcagtctgaagtcgacctgggatgctccagctttgtgaggggaggggtgtccaccattactgaggcttgagtaggcagtttttccccacagcgtaaacaaagccacctcaaagttcgaactgtgtggagcccaccatggcttagcaaagccactgtacccaggctgcctctctagattcctcctctctgggcagggcatctctgaaagaaaggcagcagccccagtcaggggcttatagatgaaactcccatctccctgggacagagcacctggcagaaggggaggctataggcacagcttcaacagacttaaacgttcctgcctgctggctctgaagagagcggcagatctcccagcacagtgcttgagctctgctaagggacagactgcctcctcaagtggggccctgacccccatgcctcctgactgggagaaacctcccagcaggggttgacagacacctcatacaagagagctctggctggcatctggtgggtgtcactccgggacaaagcttccagaggaaggagtaggcagcaatctttggtgttctgcagtctctgctggtgatacccaggcaaacagggactgaactggacctccagtaaactccaacagacatgcagcagagaggcctgactgttagaaggaaaactaacaaacagaaaaaaatagcatcaacatcaacaaaaaggacatccacacaaaaactccatccaaaggtcaccagcatcaaacaccaaaggtagataaatccatgaagatgaagaaaaaccagcacacaaaggctgaaaattccaaaaactagaatgcctcttctcctccaaaggatcacaactcctcgccagcaaggaaacaaaactggacgaagaatgagtttgatgaattgacagaagtaggcttcagaaggtgggtaataacaaactcctccaagctaacggagcatgttctaacccaatgcaaggaagctaagaaccttgaaaaaaggttagaggtattgctaactagaataaccagtttagagaagaacataaatgatctgatggagctgaaaaacacagcacgagaactttgtgaagcatacaaaagtatcaatagctgaattgatcaggcagaagaaaggatatcagagattgaagatcaacttaatgaaataaagcgtgaagacaagattagagaaaaaagaataaaaaggaacgaacaaagcccccaaagaaatatgggactatgtgaaaagaccaaacctaagtttgatttgtgtaactgaaagtgatggggagaatggaaccaagctggaaaacactgttcaggatattatccaggagaacttcctcaacctagcaagacaggccaacattcaaattcaggaaatacagagaacaccacaaagatactccttgagaagactaaccccaacacaaataaccgtcagattctccaaggttgaaatgaaggaaaaaatgttaagggcagccaaagagaaaggtcgggttacccgcaaagggaagcccatcagactaacagcagatctctctgcagaaaccctacaagccagaagtggcggggggggggggggggcaatattcagcattcttaaagaaaataatttacaaccaagaatttcatatccagccaaactaagcttcataaatgaaggagaaataaaatcctttacagacaagcaaatgctgagagattttgtcaccacctggcctcccttacaagagctcctgaaggaagcactaaaatatggaaaggaaaaaccggtaccagccactgcaacaacataccaaattgtaaagaccatcgacactatgaagaaactacatcaactaacgggcaaaataaccagctagcatcataatgatagtataaaattcatacataacaatattaaccttaaatgtaaatgggctaaatgccctaaacaaaagacacagactggcaaattggataaagagtcaggacccatcagtgtgctgtattcaggagacccatctcatgtgcagagacacacataggatcaaaataaaggaatggaggaatatttaccaagcaaatggaaagcaaaaaaaaaaaaaaaaaaaaaaagcaggggttgcaatcctagtctctgataaaacagattttaaaccaacaaagatcaaaagagacaaagaagggcattacatactggtaaagggatcaatgcaacaagaagagctaactatcctaaatatatataaacccaataaaggagcacccagattcataaagcaagttcttagagacctacaaagagacttagactctgacacaataatagtgggagactttaacaccccactgtcaatattagacagatcaatgagacagaaaattaacaaggatattcaggacttgaactcagctctggaccaaatggacctaataaacatctacagaactctccgtcccaaaccaacagaatatacattcttctcagaaacacatcgcacttattctaaaattgaccacataattggaagtaaaacactcctcagcaaatgcaaaagaaaggaaatcataacagtctctcagaccacaatgcaatcaaatgagaactcaggattaagaaactcactcaaaactgcacaactacatggaaactgagcaacctcctccagaatgactacaggataaataatgaaattaaagcagacataaataagttctttgaaaccaatgagaacaaagacacaatgtgccagaatctctgggacacagctaaagcagtgtttagagggaaatttatagcactaaatgcccacaggagaaagcgggaaagatctaaaattgacaccctaacatcacaattacaagaacgcgagatgcaagagcaaacaaactcaaaagctagcagaagacaagtaataactaagatcagagcagaactaaaggagctagagacacgaaaaacccttcaaaaaaatcaatgaatctaggagctggattttgaaaagattaacaaaagagaccactagccggactaataaagaagaaaagggagaagaatcaaatacacacaataaaaaatgataagggggatatcaccactgatcccacagaaatgcaaactaccatcagagaatactataaacaccgctatgcaaatcaactagaaaatctagaagaaatggataaattcctggacacatgcaccctcccaagactaaaccaggaagaagtcgaatccctgaatagaccaataacaaattctgaaaatgaggcagtaattaatagcctgcccaccccgaaaagcccaggaccagatgaattcacagccaatattctaccaggggtacaaagaggagctggtcccattccttctgaaactattccaaacaaaagaaaaagagggactaatattctcagtaaaatactggcaaacctaatccagcagcacatcaaaaagcttatccaccatgatcaagtcggcttcatccctgggatgcaaggctatttcaacatacataaatcaataaacataatccataacataaacagaaccaatgacaaaaaccacatgattatctcaatagatgcagaaaaggcctttgataaaattcaacagcacttcatgctaaaaactctcaataacctaggtattcatggaacatatctcaaaataataagagttatttatgagaaacccacagccaatatcatactgaatggtcaaaaactggaagcattccttttgaaaaccagcacaagacaaggatgccctctctcatcactcctattcaacatagtattggaagttctggccagggcaatcaggcaagagaaagaaataaattgtattcagataggaagagaggaagttaaattgtctctttgcagatgacatgattgtatatttagaaaatcccatcgtctcagcccaaaatctccttaagctgataagcaacttcagcagagtctcaggatacaaaatcaatgtgcaaaaatcacaagcattcctatccatcaataacagacaaacagaggcaaatcatgagtgaactcccattcacaattgctacaaagagaataaaatacctaggaatcgaactcacaagggatgtgaaggacctcttcaaggagaagtacaaaccaatgctcaaggaaataagagaggacacaaacaaatggaaaaacattccatgcccatggatgggatgaatcaatatcgtgaaaatggccatactgcccaaagtaatttatagattcaatgctatccccatcaagctaccactgactttcttcacagaattggaaaaaactactttaaatttcatatggaaccaaaaaagaacccgcatagccaagacaatcctcaacaaaaagaacaaggctggaggcatcacgctacctgacttcaaactatactacaaggttacagtaaccaaaacagcatggtactggtaccaaaacaaatatatagaccaatggaacagaacagaacagaggcctcagaaataacaccatacatctacaaacatctgatctttgacaaacctgacaaaaacaagcaatggggaaaggattccctatttaataaatggtattgagaaaactggctagccatatgcagaaaactgaaactggaccccttccttacaccttatacaaaaaataactcaagatggattaaagacttaaacataagacctataaaacccctagaagaaaacctaggcaataccattcaggacataggcatgggcaaagacttcatgactaaaacaccaaaagcaatggtgacgaaagccaaaaattgacaaatgggatctaattaaactaaagagcttctgcacagcaaaagaaactctcatcagagtgaacaggcgaccttcagaatgggagaaaatttttgcaatttatccatctgacaaagggctaatatccagaatctacaaggaacttaaacaaatttacaagaaaaaacaaacaaccccatcaaaagtgggtgaaggatatgaacagacacttctcaaaagaagacatttctgtgatcaacaaacatatgaaaaaaagctcatcttcactggtcattagacaaatgcaaatcgaaaccacaatgagataccatctccagacactggagaggatgtggagaaataggaatgctttttcactgttggtggatgtgtaaattagttcaaccattgtgggagacagtgtgacgattcctcaaggatctagaaccagaaataccatttgacccagcaatcccattactaggtatatacccaaagtattataaatctttctgctataaagacacatgcacatgtatgtttattgtagcacgattcacaatagcaaagacttggaaccaacccaaatgctcatcaatgatagattggataaagaaaatgtggcacatatacaccatggaatactatgcagccataaaaaaggatgagttcacgtcctttgcagggacatggatgaagatggaaaccatcattctcagcaaactaacacaggaacagaaaactaaacactgcatattttcactcataagtgggagttgaacaatgagaacatatggacacagggaggggaacattacacaccacggcctgttggagggtggggagctaagggagggatagcattaggagaaatacctaatgtagatgatgggttgatgggtgcagcaaaccaccatggcacgtgtatacctatgtaacaaacctgcacgttccgcacatgtatcccagaacttaaagtacaattaaaaaataataatgataataaaactttaaatggcatttattagcaagttcttgtactatttaaaaatggacacatctttttaaaaaagatgtgccagtaacattattttatccattgctaaagtgattttcaaaagagacactgttgcacctattttttccttttatgattatatgtatgaactgagttggggtgtttaattgttttgcaaaatagaataagttgacttacctgctttttgaaaaaagacatatggaatttactatcccaggagtattatgaaaaaatgcagcaaagctttaaaaaaaagttaatgaaaaagttctgtaggcaaaatatccttattttttacgacaattttttttttctggacagaagacttggttttccataggatgcctatgaaatcatggtttccatctgctgtgctgagcacctcttatattccttacagaacgtgtggtggtggaccactaacgaaaacacgtgagggaaatagaacttgaagcaaatttgaaaacttgaaggcttttaaatcttgtcagccatccaattcaagcagtgtatggcaggtgtgtcatatatttgtagagccaaaataaatgaccacaagaaattcagaagtaatacagatgtaaggaaagcttaaaatggaaacaaagaaaacattgttttcattgtttattcaggggttgataaatgcatttaaaggaagacctctttagtgattggtttaggtgccaaatatctttgtgatcttctggaccaggcactggcagtgttcttgttatgtgctggtttgtggaggggaggcaaaagaaagtaggagacaaggaaagtataggaaaactggggcaaaagtagctgatggcagtggccttgcaaacagctctaggacaagttactgtttccattagattagaagaaaacatgtctttcttctcttgttttactttcaagataacttccatgagaatgtgaattcttaaaaataataaaatctgcagttcttttttttcaaaggttgcacttaatagagaatctattatgtatgtaattttaaaatataagtttctacattttccttatattgtgtcttgtctaggactcttatagatgagcatcaattcaaagtcaaaattaactattttattttcatggaagaatacttatgaaaggtttcttcctgtggatcagagagaaatctcccccacccttactcccaccaccagttcagtttcatcatacctattattgagcaaaaacattccaaagatgaacatactatccaaagacacaaacagaaatcatctgggaatttcatatttttatacgatcttgttgctatcaaatggacaggaataggtcattctttgtggagaatgaatgcactgtatatgaagaatcctagatattgtcatcccaatttgaaggctaggattgtgagaaaatattcaacttcacaggtccaatcgattcaaaactaacagaggtggccaaagctcagctagcctagaggatgcccaactgacaaaactcttttctagtgtgatacaacagaagggttaatgttaaattactatttaatctttatagttttcaaaacaaaaaacctggggaatgctactgtaacccccagtgacaagatagagccagcaatgctgagcaagacatgatctctatgctcaagcagtttaaatctaataagggagaaaaggttaaggggcccagtcagcaagcatgaggaagaatatgatagatgccataagagtaacacagtattgtggtatggttaagtaggtggggggggggggggggggcggactctggagtcaggctgcttgagtttgaaccatggcttgatgacctgctagcttcatgaagttgtgcaagttaaattactcaacctttctccaccctcatttccccatctgtaaaatgagaacagtagtttccctctccaagagaaatatggggagcaataagtctcaatgtaattccaaggtattcctcttgatgacttaacttctatgcagtagtgtttgagtgtgcgtttaagagtattcttaaatcatagtgcttggtgtatcattcatggtgagttagaagtttgtactgaagtcagaattcctagtgtttacttccagctcttcataaattctaatactcatttcatttccttgtacatcaagttacttctctatttaaatgagcatagcatgttccacgggagcaaggaccttatcaagtcttgttcagtaactagaacaatgcctggcacatagtagatgctagataaatgttggttgagcacaacttacggagattatgaaaatgttgatacatcaggcatgaatgtaattctgagaatgaaccataagtactctacaaaaatgacaggtttctcttgtttaagattcccaggagagataagcaatgctatctatgacatttctcagctagaatctgtgcatgagatttggagtcagaagatcttgcctggagtcatggctctaccaccaggctttgtaacttcgaataagtaatttaacctctatgagcttcatttcagtcatcagtgttttgggttatcacttatgctttagaatatttttgagagatcgaaacatcaatgaaatacaagcacttgtaaacctgcaagtacaataaagtacaaatgcactaagaaatggtaacttttcatgttctgctttagaggactataaatcttaagaagcagaactgtattcctattacttaagtctaaggaagtgaagataaagctgtattatccccaaaacaaaactgatcttaagaatacagagacaactgacacttctccctgtcttttatacatagacaaacagagctgcatgagagaacttctccccatctttgcgccagctcccttgagtgttgcacttagtttcttctgagtcagccgctaaaatagttccagtctgaaggaagacatgtggtggctagaaatgctttgaagaattggccagggcttcatcataggttacaggccaaaatttttaaaaagaaaaagaaaaaagaaaattccttcttcccctatctctgaataaaatgcatggccagaagccaattcttttttgcagttttcatttgtaaaagttcagaattcacatgtatcatttattatgtttctatacttgatggacctctgtagaaaaagtctccagaccctcactgtttatgttttgagcagatcttgtatagatagatagatcttttttgtcattttccttccaaatgtgttcaggcagactatataattgggttgtgggattaggttggaatatcatactctttcagagtacttttcataatacattaagtcagttacagtgtggaaatgaatttactcttgaaattcaacttagtaacactactgagaaaaatctctggctaaggagaaactcagaaagcttgggatagctaatcccatcactagtcaggctgtttttgattgtcatgtctctttagactttttaaaaaatacataacagctttattgggatgtaattcacatattacccaattcatctatttaaagtgtacaattcagtgactgggttatggtatttcaaaaatcatgcaatcatcaccactatctaattccaaaacattttcatcaccccctaaaggagactctgtacccattaagcagtcattcgcccttatcccctcttcccatcccctggcaaccactaatctaccttctgtctctgtagatttggctactctgaacgtttcatataaatggaatcatacaatatgtggccttttgtgacagagttctttcacttaacataatgttttcaaggttcaaccttctggtagcatgcatcagtccttcattcctatttgtggccaaataacattccattgtgtggatataccacattttgtttatccattcatctggtaatggacacttaggttatttccacttttggctattatgaatagtgttgctatgaacattcatgtaggaggatttctttatcacttgttttcagatactttgggtatatactgagttgcggaagtgaggaactgtcagacagtttgccatagcaactgcaacatttcatattcccagccacgatgtatgagggttcaaatttctccaatttttctgtttttaaaattatagttagactaatgagagtggtcatcacattgtgattttgttttgcatttctatcatcaggttatttttaaaatacttttcctagaagtcatttgcctgcaacttcaacgctctagaacatggtcctgcatgtaacttgatgcagaagggcctgcatagaagtaagagcagtcatagaacttctgcaagaaagctctgcatcttgttccacaggcccctcattcagtgggtaactaattgttattcaacattcatgactggctattaggttttttggaagagagctggaaaattcactgtggtagatattgtgacagagaagtgacagtggatatgacaacagtctgccacttaaagaggagaactattatacttcctaatacattaatggtcccaagtctttaattagaggccaaattatgtttgatattttttaagaaggcaaagttacacagaatacattttagaatgatttccatgaagaatgactcagagaaaaacatgttttgctcttgagtagataagcttgcttgaactttctaggtatttaatttctcaatgatatttgaaaagtcaggtgatacttaattgcatcttgaatatggaaaagacaaagagaagatttagattttgtaaaattgttgaaaatattgttgaaaaaattaaatgaaatatttttaagaactttaatctcactttttgatgaagttaacagttatttgatttttctaatactcagagctcacttttgcgttaatgctatttcagtatgtgtttatggcatatgccaataaattaacctttcctgtatcttctcagctgttgctagaaattgtagctggttcacactgagttaaactgcatactttaaagctgcataatatttaatctatttcattaaacagcacattctgtctcacttgtttgtatatgctgaaaccttcttctgagttgctccaatttcccttcatagagactaaggagcctacacagaaaaaaaaaaatcttttcagatgacttttttctttatctgaagcacattttacgtttccatcctccaccccacctcatgtgaggttgttgcctagtcttgtactacaacagtaaatctaagcagttgcttgcttttactatacagttttatactgggaaatgccctttttattgacaatggctgactgtactatgttgcactgtcagtatctagatgcttcctgttttaaataggatatagttacttcttttccaaatctagagtttgaaacggaagcattgtattattttagctaattttatttatttttttcttgcaggttctgaaaagtgccttttctgaaaactctgctgcttggattctactctagagctgtctctttataaacccctctccctaccataccgttccctgccctctccacctccccgccgaacctggtgtgcttgtagtttactgtcagcagctggtccatttcttttttctgtgattctcaattttcttagtcattttccctccacttgattttgcaacgaaactttttttgggttctaacatccttcccaatcttgttatttaaagctaataaatagggagaaaaacttttctccccctgatctgagaccattccacaaatcgaagggcagccagcagcatatgttttttgcaagaataattgaaaacatcaactgcagagcccagaattcttttgaaagtctgccggttatttaacataaattcggcaaaggaacaaaataaagcattcattatcttaacagttggcttcttaagagttggtctctaatttcatttttagttattctgatagtttttatgattggctttttgtttgactagaccagatttgactttaatgaaaacctaagtgttaacaaatagacatttcaccaaagcaacctgttatctcttcgcacttagtttgaattcatttttaatcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaaggtgagtcccatctgaatgcacataatttaaatttgttgatttctatgttttttgaaatatgatgtgctttgaaatgagtaaaattaataatagcatgaaagtgataaattttgtttttttaacaaaaaaacagaatgtcaagatagaaggtcttaaagtcagaatgtcttaacgacaaaatgtcttaagtctttgtgtttgtagagctaagccaagtctaaagctcattccaccaaagaccacttaccacttatcaaaacagatatacttaaagaataaaaattgaagaatttttgtaggagtgagggattgtagccttgctatcgtttacttttttgtatatgatttagatgttacagtgatcataatccccatgtaacctagagaagcccttcactgaattatagcatattatccatagtaccaaaatgcacttaggagggacttgtcagctttcagaggataactaaagtcagactgagggagtataagggttccagaaggaaaattatggcattttgaagcgtctcaaagtatattttgaacctttaacttaaacgtattgctacaaaactaggttcacttaattttcctcctggacagatgattgaccaatttcagatttgtgagtatattttgtaaggaaagtcctattactaaggtcatcaagcctgagtattacatactagattataaacaaaatatgaggccagatgaggtattatataggacaggatgtatatgattgcagaaaaagaaaatgcactgattttcatgtgttattcatagttatccttaaattaaggataaaaagtataaattaaaacatagaagcaataaattataatggatttctggtttaattaagatttgctacaatgcatctgagacttttttcaaaatatgtcaaaatgaattaagcttaacaagaactttttcagtttcttgatattgttttaccttcatcatgaccaattttacctcattaacatttttatttatggctgcattggctaacagagatgtatcccttcgtgtgatggtttcctcaggaaacattttcttaagcgatatacaggttaagtatctcttatctgaaatgcttgagactgaaagtgttttcgattttttggattttagaatatttgcatatccataaagagatatcttggggatgggactccagtctaaccatgaaattcatttacattttatatacactttttacacatagcctgaaggtaatgttatacaatattttaaataattttgtgcatgaaacaaagttgtgtacattcagctatcagaaaacaaaagcgtcattatctcagccacccatgtgacatcatgttgacacttaaaaagttgaggcttttggagcattttatacttcaggtttttggattaaagatgcttaacctgtagtacttaaagggttacttttacttatttcgtgattactagttttttgttttttgtttttttttgcagaccattccattttaagaatagaaacttgttattgtaaagataaaggtaattcctaccattgaaaatctctgaattgcttttatttgtggtagacattatgactaaagaacttattttgttttcttcattttggtttcatttaagtttcatctacaattattttgtgtattatttaaatctgcagctacaggattgggcagtgccttgaagtggaaaagcatactgagttagttgggggaaaaatgaggtatctttcatctggtccatatagagggtcaggaactgcagtagaaactttgcattgttgtttcaggagatctggggtacagtcccagcctcactactgtatctgacctcgggcaacttaacctcacaatccttgagtaacttcatctgtaacagatagatagtatcttctgtacctaacttctgtgattattgtggagattgcagtaagctagtacaaatggaaaaccatatatcaatataaaagtgaattaaataaaaggttttcttcctatcaactaaatgtttgttgtaggcattctttaacaaagttctatttagttagggcttattatttaaaattacaaactcatgttccaaatgtacatgaccaaatctagttgctgtgtgttattagttgttcaagctaagtataactgtttttatggttactctgatatagagttccttgcaggctttgtaaattctatctttccaaacatcatagaatgtgaaaggagacatgtgatcttcctaatcattaataaactcaggtcagtaattccatttaaaggcaaaagagtgccataaactaaacattttgaagaaaagtactagggaaggtgactgtttacaaaatgcgtgctgcactacaactttagagcttggaaggtgtttaattcagagacaaaatagataatagccaatgaatattaataagccacttaattatttaaataagttgtctactcactgtatctagtgtttttaaagtaatgtttgcatcatgttaatatcctgatgaccagtcacacagggtaaagatgatttacataatccttacattctcatattttagtgaaaaccttaatatttcaaatatgtaaagccgttcaaacaattacttaatttgccatttagatagcacattaaacaaagttccatgtctgcacaagagctttgtagttcttatccatgacatgcatgaaggttaaattaagttgagggtaattgacctatgtgcattgtgctagtatcatatctataatatacaaataacatacctcagtggttactgcagcatttcctacttctcctgagtttttataattgaaacactgttgaacttcatctgtgtactatttcttctctcatgagtgattaaataactgaaacaatcatttgatgagttttgggctgctgcttttgtttttgttttgttttgttgttgttgtgtaagaattctattagtactagctactctaccagatgatggttattgccttaataacaggtacaacagatacaatgttctaactcacctcataatgagggaatgttatgaaaataagaagggcaaattggatggctgattgtgtattgtgctgaagtgctgtgcctatcaatccatgaatgttgagtgctcagtgatgaaggcagcaccatcttcaaatggaaatctagtgtagtccatggattaatttccagctacatagaatggtctcatatcatgttggtatgcagctgtttttgactctgttgccttgtggacttggcataatctgtctccaaagttttcttcaaagtatcgcttaatccattctatgccaatttcttgatattacagtttgccattgatctaggttggtatttttagtgaatgttccttggatttaacgaagggtcatcatttttaaaacgaaatcaatctttgtgattgttttcatagccaagttattctgcttcagcaatatcatgatgtcttgaacctttccctttatacttgaagcaatgtgttatcagtcactttttatccaggaaggatataaatgttgtcattatttcattatgacagatcaacacccatcacaactgtccacccctcttaccactttgggtagttttgtgccaagaatttcctggtaaaggccatagcagcagacatagttagaggatactcaagctaacctatatacattccttaaaaaatgggaactgggtaaggaatgcacataaaacagtcacatgccatgtcttcaaaatcacatatgatcacgagaaaaataatattttgacaagtgaaaccttgtcaaatattataagcatatcgatatgaatctatccttgtaggtcaaactggcccaagttaccagtatattctgcaatagcaacactagtcacagcagttttcattagtttaaaatttgactatttttgactgaatacttactcatccctatttgccaagggaaagtttaccagaaactagatgcctagcaacacaatcccaagggtcactggattatgcaagacttagcaccatttatcagctccatcagagaggtctgtctacactataaagacacataagcagcagctgtcatcttgagagtcaaggaaaataacattttatttaaggatctctattttctatgatgctaacctttaaagggaagtatctttgactggtaaaagtcaatgctattttggacatttcaaaaacctcttttgaaaggaaaatagaattacaattataggttggtgcggaagtaattgtgttttttgccatgaaagcaatggcaaaaactgcaattacttctgcaccgacctaatggtacccaaacaaatacatattgatagttcagcctcgccttttaaacattttattttgaaatattaataattttaggcttacagaaaagttacaaaagtgatacaggaaactcctgtatactttttatccagattcccctaatgtcaacaacttacatgccatgcattgcacagttatcaaaaccagggaattatcactggtacaagattcttaagtaaactcaagaccttatttgaatgtcaccaattttcttcctaatgttatttttctgttccaggatccaatctgggatcccacatggcatttattccttatatctccttagtctcctccaacctgtgacactttcccagtctttccttgtctttcatgaccatgacacttaggatgaatactggtcagttattctgtaaaatacatctcaccttgtgcttgttgaatgttttctcatgattagactgagatcatgtggttttgacaaataaaaaagaaacccacacgcagaaatgatgtgcatgacatctgagggtatgggatattgatatatcttattcattatgttaactttaattagctggttcaagtggcatctactggatttctccactgtaacatgaccagtttttcttttgtaaaaactgataactatgtcccccatttattcatcatcccctacaatatgccattgatcgtaatgggcatcccaatgtcctagatgttaaaaagtgaacaagtgttcatcttagaagtgattggtaatgtacttctataattatagtcaattaagaaagagagcaagggaaaatggaccaagagcatgacagagaaaatagcagcaacaagccactggaaagacagaacactggagagtgagcagtcctagaagtgatgtgatatgtgtgtgcctatcatatactactgcagagtgtgacagctgtccccttcttgttcatggccttgggacttagccgtgaaccagaaacagtccctgcctccatggtgcagacattctcattgggagttggaggaggagcaggtaaaaaataattaaatattcaggataacaatacattgtcaggtgtgaggaaagggtgcagagaatggcaggggctactgttttagatacagtggccaggaggcctccagtgaggtgacctttgaggagaggcatgcaggagatgaggggacagtgaagaggatttctaagaacattccaggcaaagagaatggcgacagctaaggccctgaagctggcggcagcctggtgtgtgtgaggaaactcaagatccccagcgtggctggagcagagccatgaagggggagggcagtgggagatgagggcagggaggtcccgggggtggggagatcaggtggggctctgtgtatcatgctgaggactttggatcctgttccaggagctggaaaggttgacataatcgggggaaagcaagcccacacaaagcagaggtgtctagtctttatattttttaagtggaaaagagaataatttccacgaagacaaataactcctgtttataggtgaagtagaagtcaaatggtgcccaatccctattcttcactcccttatttctgtgacttgtacctcaactccagttcataccccagtgatggggaattagcaataaagaaatctcatgtgaggaaagagttaatatagcaggtttggtggcttactctttgcatgtctcccagggaaaccttaactatcccctgggaatgtggccaccattcattttgtcactgattggttattgtgttgtatacacctggaacaatggaccatgccataacagcttgtcagggttgctttgctcaagatcaagattgatgactgattcattgttagggtcctgcattacagttgccatggccagttggtagcaggctgtgcatatgtgaccaggacccatctgcacctcagaccttgagactagaactgggcttcccagggtggagacattccatacatgcctctgtagtttgctgctagagagagagagtccttgtgcatgtggcttcgaactaggaagaacattggaagcttgtgctgggcttctcttgattctactgatacgtatatttttcctgttacttttcctctgtattccaagctgtaataaattttagttgcgagtgtaagttgctattgagtctgtgagtcctggcaaatgtcaaagaagcttttctgtatgttgttatttttcatacattatttgcttgattttttttttttacatttttctgttttttatgagaagggctttttcattttgtttctattttttaaagtttaatttttgaatggatattttcataattcaaaaatttagaaaaacagtcaactaatgagtacatcaacaaaatatggtatatacatacaatgtaatattactcagctacaaaaaggaacaaagtactgatccatgctacaacatggatgaaccttaaaaacatgatgttaagtgaaagaagccagacataaaaggtcacatattgtgtgattccatttatatgaaacatcaagagttggcaaatccatagagacagaaagcagattagtggttgccagggtcttgtgaagggcagtagatgggtgagtgaggggtgaggggtatgggaattaactactaatgggtacatggctttttttttaagggtgatgaaaatgtcctggaattagtgatgatagttacacaactttgtatataaatgtgttaaaaactactgatgtgtagactttaaaagggtgagttttatgatttgtgaattatactcaatgaaaaagtttaagaaatttcaacgatagtagagtatgcagcgaagttttcccctcatctcttttccccagttaatcagttgacctccaaactgatattttggttttccctctcccatagatattatatatatacatatgagcaaatatatccatacttattttccattttcacacagatagtagcatactgttttcctccttgctttttttgagtttaaaatattaacagtaaaaagatgggaaaagctatgtcatgctgacactaataaaaagaagcctggaggtgctatatttataataaagataaaaagaattgcacacaaatacaggattctagttagtaaatctgttcctcacaggcatatgtaagtatgtagatactgaggttgaacaaataaatgtatatagagtagataatgagagcctattttctcactatcagaggaaaaaagttaaaaataaaaagggaaggttaggatgaataccgtggtgtggattagaaaggacacatgagtatgtatacagatagatacaggaatagatattgatctgtgtgtatgcatgggttattatgtatgctttcatttcctagctctgtcttgggaagccctagaagcaattaacaccccaacagcaacgagtatacttagtacccacatctttgtgtctaatatcattctccaataaaggaactcgggatctttggaataatggctaattctggacagaagcagggaaaatacaagatgaggctgtaatgtcttttggtgtaagaatgtaagaaagtgctagagaaagggtgggggcatgacaagacagcatagtagccagtctgaaggagctcccaatggctgaagttagaataacttgagcaagaaactaaatgatgacagtattgaattatagctcatagaataaaatagatgcccatgagtccatagtttacaaaaaaaattgaataaatggataagttggggagaagggacaactcctccttacagaagaattccaattaataaatggagaacaaatgaaggaaacacaaaatcactagtaggcaaatgccatggtaataatggttgcaggcaagatccactgatatatgctgaaatcagtgggtaaaagttggaggagaaacaggatatttgcattgtcccaaagtatttctcccaggatatttatcaattaaaaatagaacaggcatggtctatttcatttatcaataaaaaatagaccaggcatggtggctggctcatgcctttaatcccagcactttgggaggccgaggtgggaggatcttttgaggccaggagtttgagaccagcctgggcaatatagcgagaccctgtctatacaaaacatttttaaaaaaattaactgggcataatggtgcatgcctgtagtcccagctactcaggaggcagaggatcgcttgagcctgggagattgaggctgcagtgagcagtgattgtgccactgcactccagcctgggcaacacagcaagaccctgtttctaaaataaataaataaagggaaaatagtcactttacagtggagaaacccagcagatgccactttaaccaggtgtttaaggttaacataatgagtgataagatatatcaatatcacataccctcagataggatacacaccatttctgtgatgttcctgccaaaaagacatggtctcggtctaatcatgagaaaacattcaacaaacacaaagtgagaggcattttacagaataaatgaccagtactcatccaaagtgtcatggtcatgaaagacaaggaaagacttagaaagtgtcacagattggaggagactaaggagaagtgaggaataaatgccatgtgggaacctggattggatcctagaacagaagaacattaggaagaaaattggtgacattcaaataagatctcttgttaagagtctcgtaccagtgttaatttcctggttttggtaattgtgttatggttatgtaagtatttaacagtaggggaatctgggtgaagggtatacagggactccaggtattatttttgcgatttttttgtaagttcaaaattatttcaaaatgaagtattttaaaagttagcttttttagtctgtcctttgaggctcagaaatattgtggggtattgtttcttttcatttttattcttaaaaaaaaaactttgagtatggggatgagaaaactctaaaatctagtcatgactgatcatgagattgcccccaccaaaagttcgatgactcagatatcttcatagttaagaaagcgctcatacatataaaagcacttcacaaacctagcaaacgaagaattttggctgtagaaggaagaacgttcagttcaaaattgttgccatttacagttgggtaaactggtgatccgttgagggagagtgacttgacctagttcacatatgcagttatcaaaagagcttgatgactccggcgttcttccaatcattattcagtcttctttcctgtggagaagaaggaaatggagagaacatcaattaggctattgctttagtaaaccaaaagcatccagctcttatcacagtcatgctgctccacatgacattgggactgtctgtgaagttttctggttctcctttactttttgcactataaagtaaggcgtggataagccaacttttcctttgctaatccctccctcttttattgtttctgattcatgataatttagattaagactttattaaccttcatatttagttcatggacaattatttggataacttgttttgaaaataaggcagaagagaagaatttttagacaaagttacctaactttgtgatactaaactttgcttaattgctgagtgtcagaacactgagctgtctctgctcccttgtccatccttctccccaaacaccgcattgttgagtttgctgaccagaactggggattgtaactgtggctgtgtatcacatcttcactgcatgaaactcattgatgtctgattctgttatatactcattagtacaatgccctggccagctaggaagaaacctgtcatagatcagctgaaatattgcagtagcaattcagccttattatgggtcaagtattttatacaataatttggaatctaatccaacttatttaaagtgttgttttatgggatcatagctcaaaatcatctcttcctggccaagttgtaattgggcatctggtgagaaaagacttgggctagggccaggcatgtattccccaactactgtttgatgttaccattaatactgaccctttgctacaggaactccattaagtaggagagatttggaaattggaaatttgaaaactattatatttcaactcttttgtctagaagaaactcttagatgttagggtaatatacatctgatcctacttggttagtaaataatctcttcatgtagcatagctgaaatgaagtctttttctctatatcagattttttcgaaatgtggatacaaggtacttctgtgcatccggaaatagcaattagttcttctaggaacatgacattattcatagaacattgtttacttactgttctgtttgcccttgcagatgacctttctgcatgtaccatccttgaggtgacccttgttttcctctcagtgtgtcacttggtccctgacttatggggttatatattccagaggaatcttagctgtctgctattttctgtaaatactcttttttttcttcagtgtttattctgctacataatcggtcttcagtttcttaaatttatggttttttttttttaatttttgatgtctaatccagatttgcagtcctgcttgggttttcaatgtttttgtttctgtgccttcaattctcaccccagggtcaagttttattgctagatgtcattacaagtttatctcacattttttgccatctttcttgatattgttttctttaaagtcagtaaacaattccatttgtttttcatccttttattttctaaatgatctccagtatttggattgaaccatgttgtatctagagatagagtaaatcatttttcggtatcttgtttatgatgagattatgtaaaattgcttaatgtcatgtctaatatgttatttagttaagtagatatggctatagaatctatctgttagaaacagttttgcagctataactcggtcataggcatttaaatgtatgccttaaattggatttttgtatatcataaataagctttttttctgttgaagctcaaattttttttaacccactggaaattggtagaaaataaattaggctttgcttctacctatattcttatgagtagatagtggacaatgaaggcagtttccacgttgaaaactgtacaaaaatttgaaaatgtaaagtccacagtaatataaatgtattacatatgacaaattccctttaattccattaaatatgacaaaaaacaagacatgtcctatgtatcagccatgatttgttagctaacggaacggtagtaatgttctaatttctgtcttagcgtgcaaaaatgcaaacagaaaacctttttctgtgactttaaactctttaaccatcttttatatgcatctaaatacagtgagtagattacattgtagtatcaataatctcttagctccaaatactttttagagatctcatttttaaaaaccacattgttttaagaccacattgtcacattgtcttaatatctttgttcatcttcccatttgtgaaagatagtaaaaccgaagtaacaatttgaggatttttaatagcttcatgtactctgtgttcttgttttaaatatttcacaaatacctatcctaggagttgttccacttaacaaacttaattttttccagcttttataaaaatgtaatctctagtgtttctgcaatttcctggttattttactttttttactaaccaaaaaaagtgttctatatagaaccaaattcagtcttaacttcagtattactaacaaattttaaaaccatagccatctttaatctcccagtaccccactgtaggaagaatttgactttggaatattgtctcatttttcaaaggagcctgagaagtagttttggaaaatacctttttcttgggtgaactctagatgtaaccactgaaaatatctgaaatgaaacattctatcagcaagtggcataaacatcgaaaatgctgccttgtcacacataacagttctaacaagggctccttatgtcatgggaatcctactacctctgtttctcttcatatgagagcaagcagcagcactgaatttgtaagactatttggttgtggtttcctagaaggatttgtataaatgtcaggggttatttaatgctgaaagtcctgttaaatccattaagaattgtatgtacattcaattccccaaagaaatgattcattcaacaaacatttattgcaacctcttacttgttaggcactgggctcagtaatgtggagaatacaaagttaggaaagatgtggttcttgcctgaccttttagtaagaggttacttgtgttatatgccataagccagatacaaactaacagctacaacagtccaagggcacaggtagggactgggattatattcagcagtggtggttgaagatggagtcatggcagagacactgtttgaggtgttctttgaagaaggaataggaaggtattccaggcagaggggataacctgagcaaagatagagggggaaaactgtgatatgtttggggagttgaatgttaagtcagaatggctgaagcatgagaaatgacaccatcagcttgtgcaaaaaaaatgacagaaaaaaagagactggcaagaggaagtacctcttagaaagttgttgaagtattgaaggtatgaaatattaaggttttgatttagatggtggtggtgggaagggaaaactagcgatggaattgagatgcagatgaagccaacatggttaagtagaaagcagtggatatttccctccagcctactgaccttgtgctcatcttaacatcagatttctttgaagttgcagtgaaagtctgccatactttttgttttgttttgcattagatgctatcttgtccaccaacatatcttttgtgcctagtacacgttagggcttggaaaaatatttgttgaatgaaacatgagattgttgaaacactttgaaagagggagaataaatatgggctcaactgagaggtacacagagatctcttcatctgcagctgtactttcactcccagttcagtttttactcaaatatagatgaaaattgtatacacccatgtgccaactttcctcactcaaccacattttaacctagatttgatggcctgcaaattgctgatatttgcaaatttaattccatcccttagcattatagaaatgatatttggctaaatgctgttggatattctccaactgttacattttcagtgcttttacgttatatacggatttttttaaaaaattacttagtggccattgttaagtgttatttttaagataattagtgtgattatgtagtaatggtctagcattttttgtcttaaaatgtttgaagttgaattttacagcagatgggtagcttgcaaatcaaggtattcttggaagcataatgagtgctaataaggtgattctaatcaagtacaagctcataatcttcaaaaagggattttgtggaaaaaggtgactgcctagttcaaaaatatatatatttaaagtttaataaagaactcttgttctaaatacacaatgacattttgaaagtccaaaaagtttgaacatagaaagacaaagaaatataataatagagagggtccatgaattgacactttttaaaaaacccacaataactgtaatttagtccaagcaatatgcttttaaaagaaataggaaaaataataggaaagtaatttcaatatcgaagtttaagaaaggatctctaggcttatgtactatatcttggagtttgtacagtcagcccagtctcttagactttctccatgttcatctccattcctggataatgattgctggttttctgtacaggcgatcctgaggtcttggtgcaatcctcaataaccaagatatgattcaggtttggacaattgactctgctttcaaaaacagggaaggtgtctggaacatttgagaaaagtgtttcaacaacaacaacaacaaaaccttaaaatgatttttaaatatttagcagcattcagctggtgtcaacatttggcaatgatttccataattgtgactagcatattttaataggcaactgacagataaaacagaaccaagactgtctccccctttttcccaattcttgaggcctcactttagtggcatgtgacatttacttcatctttgaaatgataaaacatttaaatatgtttcacttatttctccccaaattttcctattgtcccactaaagaaatacctttaaaaagtgacattgcttccaagtcagagatttaaaaaaaaaaaaacagaaggaaagaaggaaggaggaaaggagggagagagggagtgggtgaagaaagaaagaagttaagagacacccattgagaaaggcttttcattctgaaatacttcagctccaataataatgtatttgtaacaaaaacataaggaaagtgtaatgaatagagtaacatactcatgaaaagagggtaatatagaagagtgggattcctccacccccaagagagaattgtttgtgccatttttatcgcatatttttcattataaactcctctgctttcgttgaagcaaaaatgaatagctgtgattaattatggcccagagaagtctcattctccccatggaacttgctcttcctcattttcaacagcaccactaaacatgcaccactagttacctttgatctccccactgttcacaacctccaagcaggcgtcaagtcctaggtcccccaccagcacaactactcatgcctctagttatgggagagagaagatttgtaaactccttgtgggcagtttccatggcataatcttcatttcttccatagtatctagcacagtttttacttttatgcaggagaggtattaaacagtatgccttcttttatcaggctacaggagcaaatgcaattcagtacattttcctatttagtgttgccagaaaactcacagctaccttttgggcccagctgcagcaattaaccttagtctagaattttgaagtttttgatacaattatctccattgttccacctttcccattatatcagtctttacagttactgtaataatcttacttcaaaaatatctttcttgaaggtcattttgaagccttttgggaagaatgtaattgtctaagtagtaagagagcaagtcaacaagagaaggggctaattccatttctgcatttattatttgcagcttataaggctatctgagtgattttcatttggacatgttaatgtattccaggcattccagtatggttaactgggggcctcagtttaaaatgggcttccagtgatactcagaagtaaaccagatgcagctggggctactcgtaaaacagaaaggaataaataacaaatacttgaaactccttagacgtttactttttttcattaggaaaaaaggagaaagggttgtatgagatgtgttttttccttacttcctcgctgcagggtgcaactgatgaacttgtattcagtgcttattttgaggtttagtaatctattgatacttcggcttttgatcatctgtgctgaaatgctgtggtcagcattaaattgtttgcctaatcgatctggaaagtattttcctccttttagcttgtctttttctaggtatgttttttttaggggtgaggagaaggggtaatgttctcaaatgattgggatttctgtagtgagtaaaggtgtgagtttattggagagctgaggggcagtttttaaagaatcctttattcgttcaaatttgggtacacagaaaacatttagaaaacactctggaaatgtttatacagcaaatgtaagcaacatacaatacagagctctcatatacatacttaccatcataactaatagccctactttgtaaacagaaaatgaatgtgtttcctaggagtagtagaatagattttgagaaggccaatccttcttcatgacctagaccggccttcttttacgtggctgctaacatcattactgatgtcagagatgtagaattaaggtgtccaaatttctttagtatgaccttttggaaactgaattatcagtaccataataaaatgcatagcaaataactaaatccattgtcggataggacaatattcccttagagcaggggttctcaaaaatgtggcagactagcaacatcaacttcacctggacacatttagaaatgtaaattatcacctcacccacacctactgaatcagaaactctgtggggaggcctggcactttgtgtttcaagaaactctcccggtaattctggcaaacactgaagtttgggaaccattagtttagagaaaaccataattggtttagcagggtgtcaattaaggatgatgtttcaaagcttcataattctcaggattctgtgttgttcctctaatgcctcctccttcctcaccacttgttcaaacggccctttcttgatatatattcagatctgttggaagggaaatgatgtctattctggaagacttaatgtttctttgggagacctattatattttccctccaaggagcatcacaatgctttttagctgagaaaaggctctgagaggtattgcatgaaagacagtttagttctgttaactgcgtgttagtgtagtttagttctgttgaacccaagaatttctgtaaatcctttgatcacagaaccctatctttgtggagcatagagaaacttatggaatgctacataacaggtgactgggcaagaatcatgctggtgtctaaatgtgtggaacccaaaagaaatgaagttattttaattatttgactattataaccctttgaaaggattagtgacttttttgtaccctgaaaggcgtattgtaggtgttgctagctgccacacatggaccttcaaattttcatatgtagcaactgtgagaacaaaagggtgtgtatatgtacacacacacacacacacacacacacacatagtatattcagacatttcacatttatatgagtcaatcttcacttccataaggttagcctattaaaatgaaaaataagaaaaatgaaaaattagctcaaacatttataaacagttttctaatgagattcaattttattattttaccaatttatttaaatgatatttaaaatcacttcgctacaatttttttttaatattttaagcaccattaacatcttttatagtctcttatttggctttgtctttctaacttaccaggaaaaaatgacttgcctgctttcttgttatcattttaatatatgttataagtaaaatataacagtacccatggcaaaattagaataaaaatagtaccaactagagtgtgatgctccatgcttttttatataatacaaatgactttgaatgtttcattcattatgattttaaagtggatgttcgttatgctaaatcttaaagaagcttgtgatggtaaaagagtgtctcttgactaggtaaactagtctcctaagtgggcactggcttattaccacttgaaaagaagcaataattattttctccttttagttatttacgaggatgagattaaagcttggatatgcttcctttatcctctgccttttcgcctagaatactactaagttgtgggaacagcgactgtttgacaataatatccagttctaataagagaagtgtcctcagtttcctaacattatacgtatataaattctctccctaggcacatagtaatttatattactcatataattggtaattactctatgataatatattacctcttttagggaagtagaatgatttaaagtagttataatctgtcaaagttattatacttaattctcgggaaatattttagttctgttgtaaagaactaataaagaaaaatatattttttacattttgtactgattttacttgcaaaacagactaaattttactttgttccttttttctttcaaagcacctagaaagtatgtaggggcaggaattatttctagagaagttaacacgattggagaataatttaccgatgatctaaaactaaatagaattaagggcacttgaatctcagcttagcactctttctaataaaatactgtgttcctattgaaacttaaattcatttcttcttgggaacaaatacattagaggacagagtatgaacagcctgtgacctgcttccgaaacagttgattcatataacagtgttgttgttattattttccctattatattgtctttagaactattagtatacttttggattctgcatcttcagttgtctagtcactttttattttttctgagacagggtctcactctgttgtccaggctggagtgcactggcaagatcatggtgagagacaggactagctggatttcctaggccgacgagtaatccctaagcctagctgggaaagtgaccgcatccacctttaaacacggggcttgcaacttagctcacacccgatcaatcaggtagtaaagagagctcactaaaatgctaattaggcaaaaacaggaggttaaaaaaaatagccaatcatctatcgcctgagagcacagagggagggacaatgatggggatataaacccaggcattccagctggcaatggcaaccccctttgggtcccctcccattttatgggagctctgttttcactctattaaatcttgctactgcacactcttctggtccatgtttgttacggcctgagctgagctttcactcgccatccaccactgctgtttgccgccgtcgcagacccgccgctgacttccacccctccagatccggcagggtgtctgctgcgctcctgatccagcgaggcacccattgccgctcccgatcgggctaaaggcttgccattgttcctgcatggctagtgcccggattcgtcctaatcgagctgaacactagttgctgggttccacggttctcttctgtgacccatggcttctgttagaactgtaagactcactgcatggcccaagattccattccttggaatccatgaggccaagaaccccaggtcagagaacaagaggcttgccaccatcttggaagtggccggccaccatcttaggagctctaagaacaaggacccccagtaacaatggctcactgcagcctcagcctcccgggctcaggtgatcttctcattttaaaaagctggggagaaacctaatgataaatcacagaatagaattgttgtgtttattttattggcatgtttacatgatgcagccacatattaatttgtatttgaaaccctttagttttattttgtgaataatgtttgcttaaccaaaaataaattgccaataaagaaaagaaaagaaagaaacatgacttgtacatttgaagcactgaaaaagtcaaaccctagtgcctagggccgcagatcttcacctccactttgcagtatctcaaaatatatctactttacggtcatttaactaaaacctcctctgaaactgagctttcggtggggtagtcttttgtgaaatggtgtgtgcagttcatgtgcgttctcatttgcctttgtccttaggggaatgaaatgcttcagaagaacactttgtaccattttgtgttaaggttgatcttttctcatcatttggagactttctctgctttgtgatagtgtcgaacctacagcactcaacttgtcatctgagtaaacttgcttctgaatggcactatggtgtttttaaaagattcttctcttagggaggtgatgatagtcatgaagttcacagaccacctcttttgttgagtcctacttctatcggttctcaatctccatgggatactgctggactgttacttttgtcaagtcatggccgtttatgcttaagccctcatgacccaactcctgataattggacattgcttctcccaaaccaactagcgaaatgctactgtgcaaacatttactaaaaagctgtgttaacagataacatgtttatgctaattgttctgcttcaggaattatggaaggctatttctaacatttggttacctagggccaggtacagtggccctcacctataatccctagcactttgggaggctgaggcaggtggatcgcttgagcccaggagttctagaccatcctgtgcaacacggggaaaccccatcgttacaaaaaatacaaaaattagctgggcatggtggtgtgcacctgtagtcccagctactcgggacgctgaggtgggaggattacctcagcctggggaagttgaggttacaatgagctgtgatggtgccactgcactccagcctgggcaacagagtgagactctatcttaaaaaacaaaacaaaaccaaacaaacaaacaaaaacaaacacattcaattgccttgacacattcaattgccttgtcttattcattctcaagccatccaaaatccctgggttttgaacaaaataaatttgccataaaattgtgctagtaactagtgtctggacatacctaacagccagttgatatgcagtctttgttataatcttagagggaaagtgtggcccagacagtataaatatttgaaccagctcattcctctatttagaactatcacagtattatgaagcacagtatcttgattgagtatgagctctggacacagagcacgtaggttcaaatcccagctctgctacttattagttatgtcagcttgggcatgcgtcttcacttctcagtgcccccgtttcctcaattgtgaagattaaatgagttaatgcatataaagcactttgaacaatgcctggcacgtggtaaatccacaacaaagttagccattaatattaaggtggacatggtgtgaaaaaatggaaaccagtttacagtattctaaaaaatctctcaaattagttttgtttctatgactagttttgtttttaaaattagtttatgttttatgactactttcatgatattaatagaaaatataattttacaggggcctcaacctggtgtctaaatgtgtatcaacaattgtctcatgccaagtaacatgagctaaagctgtatatacaatatctgcagcttattcataagtgatctgaattagttaacatgaaaaggatcatttgaccttatatgcaagagtctagtataccaagtcaatgcaatacatgaaacaatgtaaaaccaaattaatagtctagttatctttagtagaaaaatgagtgtaaaagattagcacactgatgttttacactacctagtttctttcgctctatccactttgtcaaaatctttgagaatggaatttgatttaccttatataacagacataaactgacttatttttttttcagaaagatgttttctgaagttttctaattttatcttgattttgagggaaagcacaatggagctagagtagatttattttatttatttttcttcaccaaaataaggattccgctaattaaaaggcactgactagaatatcaccatggcctgaatgaccccagaaatcttttcgtgcttaatagaaaggatgcacatttttaatgaacactacatccttagacatgtactgctcttctaataagtcttgttccagctgtttaaattgactaagggagtacagttcatagattttgaagctaactaattaactctctgttctttgctttatttttttcttgttttgggtgtggagatatgcatcctttggcagtggtcatatttcaacttcttctctgtaaggccatgagacatttatggttgaggcattgatttattttaaagcaaaaagcctccctttatcactattttctttaaccccatttctagttacattgtttgtggagggccttgtttagttctttaaatattgggaacagtttcatcatcattaaatattaactgctcactggaagcagaagctgagcttaattaaggttgcagtatttactaaattagactgggagaggaacattttaagacacacacatatatgaaagagagagagagagaaagaaaaataaatattttacagtaatctcagcagtttcattagagctttgtcaattgtgttcgcatatctgaaacatttcatcccaaaatgaaagttacattttggatgaaacttaacatacttggtagatattcaggccaggcagaatagatctttatttttagaagagaaagcatttgtatcaataccttgttttcatgtctgtagaacaaaaacaaacagtaagttggcctaattttcagatgctttttaaaagaatcacttggctaaaaatgccacttaaatacacgatacatttagagtttggaattttccctgggcatatgcctgatactctaaattacatacaattatattttatttgtaattgataattattatgggaacataacagttgtgcatatttgtgggatacatgtgatattttgatacaggcatacaatgtgtaatgatcaaatcagggtaattgggatatctatcacctcaaacctttatcatttcttcgtgttaggaacattccaatcctactcttttagttattttaaaatatacaataaattgttattaactatagtcaccctattgtgctactgaatactagaccttattccttctacgtaattgtattttgtacccattaaccatcccctctttataaaccccttctcactaccctttctagcctctggcaatgatcattccactctctatctccatgagttgagtgggttttttgttttgttttgttttgttttgttttgttttagctctcgcatattagtgagaaacgtgcagtattgatctttctgtgcctggcgtatttcacttaacataatgttctccacttccaatcatgctgttgcaaatgacagaattttgttcttctttatggttgaataatattcaattgtgtatatgtaccacatgttctttatccattcttccattgatggaaacttaaattgattccatatctcggccattgtgaataatgctgtaataaacacaggggtgcatctctttgaaatactgttttcctttaggatagatacccagcagtgggattgctggatcatatcatagttctatttttagttttttggagaacctccatactgttttttttttatatatatagtggctgtgctaatttacattcttaccaacagttgcctactttcctacaattttaataacaagttagcacaaaggtttcaatagaacttttggtgatgaaatgtatattttccctaacaaaatataaacttagtccatgcctcaaaagtattttaatggcagtccatgtcaccaagtaaaaactttctgcatggaaattccatttttggtgttaggttggtagtagggtaggagtgtgaggaaaatgcttattctgaagtggagacatttgacctcattgggggattgaaacataatttcacactgattaattcaccctgtaaacaatcattttggtacaatgttttacatttctttatctgaaagaagattcatgtttaacaaaagaggaactgattttcatctttgtaccgctaatttcaaaatgcagaggtaaatcaatagccatatctaccctttatataaagtttgagtggagagatatgtggctggttataaagacataattatttaatttattctgagcagcacactgagccctgcaaagataaattgtttaaatctgaacaataatcagtgcctttctcaccttatactcttcatatacatttgtaagatatttttgcaaattaaattcttctttgaaacttttcattttacttagagacaggaaatttaattttaccaagtggaaaccccaaggtttaaggttagtgcaaaactaaaaccatttggaattgaggagattgcccaataccttctgacttcccaggtttcagtacagcgaaaactcacttgagacccttaagtcatggaaagcctaaaataattagcatggtttcaaggggcagaagtcacaatgtaggaaagccagttaggcagagaaggcttgacgttcttatttcagaagttccttgactaaagccttcaaatgaaagaagaaagccacggcaaccatttggaaagatctgacgaaacttacagctttgaaaaggggtgttgggaaggtgattgtgggatgttactttgcaatcataggaaaatatccatcttgttagcttttgggagatcagggatgggcaaaaatggcatttcaacagaagagccatttttggggagttcactctatttttctatttaagagaaatcaaaatgaaaatactaaggaaaacttgacctgtaaaacaccatacaacttggttgaagctttagtttctttacctatagaatgaggaagttggattagatcagtattttcctaagggtgtactaaagagagatgttaacgggaatatgatgaaaaaaggggggatggtttgtgagttaaacaatgttgggaaatgctgggttaacaaaggtaaccaggtttctttactttaggacatgtgagagcctttatcatactcttgtgtattgtcagcctacaagagaggaatataaagtgacatttcttatacccgattgaccagtgaacccagcttttgaggttcctctcttgggattagttgtctgtggtacacactctggcaaatgctggactaaatgatctctaagagcctttccagctttactatttgatctttctatgatatgcccataaacatataaacttccccagagcagtacaattttactatttctgaccttactaattcttaatctttgatcattccaatgaaagagtctgcattcttaatgaaaaaataaatttaggactgtgtctagcaattgcttaaatgttcacaattgtaatgtgaggctattgtggattgccatttttctcgaatatattatttggttcattagaattagccatacctctctactttgtgctctcttttaatgtgagtaatcagggattgactgaaaaagatatctatgcaaataatggctattcatctgcatgctgtgaatctgtacctttatagcgcttatgtgtgcatatagaaacatgtgctaagtagttatttccctgcactttaatgattgacttttactcgaatttgagtattccaaagacagggctgaaggaaaaaaagaaaagattaaccacccctcacctctgcacacataaataaaaaccttaaaaaacttaaaagcctcatctttatgtaacacctcatatactcaaaaatctgttctgtaaattcggagttacgggtttaggcaggtattggtcacacaccatccccctcttcatcctagcctaaagggggagctccagcagacatcgagggtatttaaatatactgttgcgccaccggtgggtgggaaggtggagtggctgccagggtagcgagccgtgtgaagcttttggtgggaggagctatggatcaaaaattgctgtctccaacagtcaacttccttaaatttccttgcagctgatcaggtaagctggggctgagagtgtcttctactttactctgggcaaatgaaggcctgggagagcctgggctgattccatggagagggcttctaagaatcttaaggtaaagaggtaaaatgggttttcaaggatttgcctttattgagctcaacttatcaaggcagaagaacagagcgggagagggctgccagataacatattgtatggggcatacttatactaaaaaattttttttcactgtttatctgaaattcaaatttacctgggagtcctgcatatttatttgataaacctggcatctctagagaggatcctaagcagaagccctagctggggaataaagggggcaagcagctggtaccctctttgtcctggcttctaaatcgttgtggcaagtgagtggatggggtgtccagaaaaaggaggtaaagaagcctaggagcaggagatttgactaatgggtcagagagaaacacctccttatgttctttcttaatgaagtccatgtagaaggagctttttgaagttatatgattttctgtgtgttttatttcttagagtaacaaattcagtaccattactttttctctccctttttttccattcttgatgacattttatgttggcagctatcagctgctctaaagacagcgtctagtaatactttgcatgaggaatgccttctgacttttgataacttggtaccaatgtgcttcgttgtgtttgggttttaattttattctggttggctggtttgtaaatagatgatgcatttttgaagagcttataattgaccagtcattcagttaatatttttctacagtgatgtacggtattcgatgagaaccgaggtaaaaagtgtgtaagtggggtggaatagggcaggaagtagatttgggttattagtgaggcaggcttgctttcactgtgaacaacttctgggatttttagtgttatttgctgttcaaaaaatttctaagaaaaagatcaagctcatgatcatttgaaaataaatgtttaacgtaaacaaagctaagcgtgggtcatgaaggaaagccgcaaacatttttcttgtaagaaggcatatgcattagagagccacaagaaggccccacctgctgtgattttcctaaagccacctttgtcttagtagcttcagggaatttgacttgcggcttgttcagagaaattcaggatggggggtggggcagttggagaacgcagtttttttctaaactgaccctggaaatgcagggccctcctgggcaggcccaggtgctgattagatatggatctgctgctggctcctttattcgtccggtggggccctatatcctgagggcctttgtggccagagaccccttggaatcagaccagagtttctgtctctgggtctcatggattcatgtcacttctggttaagttatactaaattaccaggatgtttcagccgtaatggtcacatattcctcagggtctatattcataggaaaaaaaaaagttaggaactagctattttctggacctgaatagaataacggttcatttggaacagacaaccaggggcagcctcagtcatgtgttgactattgttctcttcttggagggagaagaaagaacttatgaaagaaaatagcaagagaagcacttaggtttctaaggtagacttagtgttatgccctataaaattattctcacaaacttcaacaaacgtgtatggcagggcggctattcatcaggcacacacacatccctggagattgaaagtggaggaagatgtagttctgccgttatacaggctcaaagtctaatagaggagacaagcatgcaaacaatttatcgatgtacacagcgataagagctacgataaaactgagtacaaggtgcagttggaagcacaaaggagggagagataaatggggacaggaatggggagacggttccaggaaaatctttacagaggaaaagtgatttgaactgagaatccatattgggtagtgaaagtctggaaacttggcttgtgtgcttactgagctgcttatgaattaggacaagtcaccccacccctttggccttcacattctctgtaagataaaggtgcacaagatgttccctacaatccgattcagccctaaactgtttccatcctgggaatcaagttatcttagtgggctatttcagaacaaaagtgtgattgttgagcccagtactccctttgtcattgggagatcaaaatgtaaaagttctctggagacagataggcaagaaaattcttctgctctcaccccagcttctcgcctattcaaacttgttatctggtttgcgccaaagtcattgccctgtgtatgtgtgtatgggatgtgtcaagaaaacagagttgggacagcatgaagaaggtgggtacagtgctggctgcaatggtggggggtacttggctggccctctccatgggggtcaacgttcagcctcattaattttgccttcattatatttaagaaatggtttattaaagacttttccctctaaatttcttgcctgcatctcacatttaacttaaaagttgtatgcagaattttaaggctgctctttgtgcatctatatcaatatttatagatgatacaatatttggaggagaaaatgatgcagattatccatttttgtaaagacagaattctaagaggaagaaagtgggaaatttgccagtagaatgccgatatctggctaataactcgttgtatgttgatcttgactcaggtttttcctagctttaataaatctgtgatgcttgcaggaactagccaaactggtacatatgatttgtaattctgaaatcactgttacttcctctgagaagccatgtctgtgcatgtaagtatgttacagtggggcactatcatcagaattatttcatttaatccattatgattaaaatggaataacaacatttttcttcatagaacaaatcatctcttgggtgccttgatttaacatttaacttttaactgttggcagtctagcagatcagtgagattatgtatttgaaaagtaatccagttataattgtatttgagagaacatatttaggattttttttttctctctaactctgtatgtatttgaagaagcaagtcattctgcaaacagctgtttctcttaagatactgtggctgacaaagggtaatttgcagcctcccaggttccttttcttattctgatgtatggtagggctttttctcatgaacatgaagtacatttcacagggtttttctaccacccagtgcatgggaagtcttgtgacagactctgactctcataactctctagacataggtgggatttgaatctctacaatgagacttttctctcttagttaaaggctttgtattcatttgggagaagcctgaaggtaggaagaaggcaatagattgaatttgggaggctttataaatgttctgcaatgtatccctttgtctgtcatcaacttcttgatgcagatgtacttcagaaatgtcatcggctattttctccccctgcttgctgctttttgagtgcatttttcaaagacagtcgatgggaaaggggagctggaagattcatatgattcataggtgtagtagcacttatttcagcagagaatcgctttcctattgaatcactttgctattttcttaactcagtaacacagtgaaagaccagatgagaatgacatgttttttaagtccaaaaggaaatggaaaaggagggaaattgaggcaagcataaatgagcttgcactctaatcgcttcaacgtttctttaattttgagtgtatatgggagggggagagagagagagttgattttcatgtcttgactccccttagctgctgattttagtacgtagcctgctctgccagaggatggcgactgttgtaggtacgtttacagagtcgtttaaggcatgctctgatactttgcactagtgtgagccaactctgaacctgtgggtctagattggaagaaggagggcttgggacaccattgacttggctagggaaacatgaagggtgatttttcagagccaagatggctgctgggctatcacaccaaactgttatagacccaatgtgatagggtaccttgtggcccactcagagtgcttaggtggcctacagaaatcattggaaccttcctagtacagagtcattgattttccaaaggacaaaaacaatagatgattacctactccactgggacagtccctccctaatccccactctatcccaaccttacatgctttaccaaagccttaattctatacaaggattaaaaaacaagtgttaacagatgtaaaaaaaacaagtttgttctctcccaaacaccaattaaagtattttggcctataattacgtttgggcctcttgaagaatgaacgctatgtagaggagatttattatcaccaagtgttgtgtgtacaaatatattatcctgagttctaaagtcgttttgaaaaaacaggggcatagttttcttttgaaatgttgtattgcacggataatatagatgttaaattacttggtctcctcatctattgtttggatagagaatacagatttttattttattttataagctttctggaacataagcagcagtctctggtaagatggtgttgctatgcatttgcattgttatagaattaaattatggattcggtcattcaaaatagaagctttataaatcaagtaaaatctcataactaagatgaataagtttctttaagtctcatgctgcctcatattccatactttagttttatagcccaacttgatataattttttaaagtgtaattctctttttttctatttctgtgtactgtttttgctctgctaaactgtcattatttcccaagaaaaagcttaagataagttactttatgtaaaggatagtgatataaaagcacaaaggcatgttcacttctttatctgtatattggcaggaaatgtgccaaatacagtgtgttctctccctccctttcttcttctctctctgattacattcaatgtagatgatattaaaactcaattgtaacaaatggtgaaattccaattattcttttttctttttttaacttatctaatgtctggaattcctgaatatgaaagacagtcttcattatatagttgttttggagttaaaaattgtgttccacgcttgtgtatgctaattgtctaaacaagctatctaggtggctctgcaatccttaagcaatgctgctgagctgcataatttattttccccactactgctgtctaactaccccaaagcataggaattagagtggtggccctaactgggagtatgcagtaagatgaaaaatagtcaaatgagaaggaaggtcagtaataagttatttagacctggttaggcagcagggtctccaaatgcagctgcaattggtaaaaaaaaaaaaaaaaaaaaaaaaaaaaaaaaaaaaaaaaaaaaaaaaaaaaagactgaaattcagaagagaggtcaggggtagagatagagatttaagatccgagcaattgtacaaatagatggaactttgaaacaacttagtctctccagggaaaagagattagagaggagagcaagaggatttagaacagggccttggggaaatctttaatgttagggtgtgggaggaggaagagaaaccctgaagtagaagtataaactagcatgcttggctgtggaagtcaccaagtgccactccctccatcagctgttaattctgagccagatcacctcagttatgtagatggagagtggagaatctaggaactgaagatccttgtgactttctgccttgcttcacattggtgggtgtaaaaagaagcttatggtctctcttaggggtacatttatggggaaaagaccccaattattgtgatttagcacacacaggggtctgcttacactcattatatatgttgaaattgcgtagctattcctaggctacttttaagaatttaggaggattaggttaacgtgattcttaactcatactaccaataaattattctttctccaaggtttgcatagaaatataaaagtacataaaactaagatagtatttgattttgtaaatcactttaatttaattaaatgtaaattgagcaatgggaaaaacaaaaagacaaactcgacagaaaacaatgatgtgtcttttaatttctcacactgactttaaagttatactcagcttcttgccagaggaggtaaaacaatagagccaccttgccctagtgatctaatatttaaaaagagccgttgcaatgcatctgggtttgcattatatgtagctctagaaaagttttgaaggacacatcttgattctcagtgaaattataggaatattttaataacaacataactaaacaatggagaagccattgcataaactgtgtaggcatcataaataaggaaaatgcagatagcatgtgttgaatgaaaacacttggtgaacaaactcatttttctctcgggaattcaggtggcctagcagcttgcactctttggtccaaaaacaaagttgcccttttgctccccaccttccccttccccaataacctcacctactgtaaagaatcttagcatctgtggaaaatagaattgtttgcagttgtgctttcttaaaaggtttatggtggacctagtaatccaaataagagagaatcgttagcttctttatatactgctcatgagttcaacacagtaataggtcacattgtgacaatgtgaccaacaactagtccagtgacatcctttgctgctacatagtaaaccataatcagcagccatgccaacatttaggtgacaccaaaagcatgtttgattccacggaactgacatactgtcctgtcttgaaagtgcttaacatcaataaaaaacattcaattagctgaggatccaaaatacactttggtttccatcatgcaagtgatctagggccattgtctccggaacctaaagaacaaaatggctgccgggcatagggatttattatttcattaacagactgtcagtgaatttcagggtgtttctcgccttatatggattcaagatgaagagttttggagcttagattgtccccagataatggagtccaaaatttatctatttgtgtatagttttaatttaatattttccctattcttcattgtcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttgtaagtcgcagctatattttgaaaattgccgataaagatcaacagtggaataacctggcagggacttggggaaattagttgcaacaggatttaggacacaaactaatatgttcattgacactacagagctgtgcacttgaagagagcagtcaggtgtgttgcactgaaaacctggctgcatgagttcactttataaaagaatatggataaaggagcaggggcattttaagataaggagagttgattattattacatggaaacctttgaattctaggacattaattcaaacaaattttcttgttctttgatgggggttttgttgctttttttttttttttttttttttggtgagacagagtttcactcttgttgcccaggctggagtgcaatggtgcgatctaggctcattgcaacttctgcctcccgagttcaagcaattctcctgcctcagcctcccaagtagctggtattacaggtgcccgccatcacgcccagctaatttttttgtgtatttttagtagacatggagtttcaccatgtccaggctggtctcaaacgcctgacttcaggtgatccacctgtctcggcctcccaaagtgctggaattacaggcgtgagcccggcctgttgttgcttttaaataaacgttttattttgaaataattttagatttacagaaaagttacaaaggtattaatagtacaaagagttcctgtattacctttcacccagttctccccactgttaacatcttatattaccctggtagatttgtcaaaagcaagaaactggaatcacacatcattattattaactaaactccagactttattcagatttccccaggttttctattaatgtaatctttctattccagtgtctgattcagggtaccacagtgcattcatttgaattttgcctcccctctcttctctgctctgtgaccatttctcagtttttcccaatttcccatgatcttgatagtggctttcccttaacttagctacagggtttccctatgcagaaattagtaagattatgtcattctagactaatatctactattttctggacttgcaagtttaaatggatcctttataaagtaattaagctatatctgttcatattgttctattgaaaattcatcttgccctatgccttaaaatataaactttcattttgcttttacacctcttagggagaattgaaaactgtcccttttctgctgtagttcttcaggcctcacatttagctcagtggtgcctcattctaattccagctggcctacttcctttaaactattaacaggataaatttgaaaatcctgttttacctttatttgttacccatttaatcagtgatacaatgaacatattgaaagttgaaatatgtatatagtatttagatgcaatgaaaatgggggaggacaatcagctgtcagtaaagcctatctcattataaagttaattctcagaattcaaggatatctgtgttgatatggaaccctttaatgagtacatctttatggataaatgcaaaaacagatgggagaggcaatgatgaatcactaaaggtttgcaccatactctttttccagaatgtctagacagatttaagtaaaataaatagatgtcatgttctgtactattagtttaccaaaaagttttgccttggaactcagattaattatgttggtaaattagttcctagaaggtgaactcctcaaagctcctctttgaccctcagtaattctttacatcgttgaactccttgcgcaaacgctttttctgggctttcacatactgacgtatctcagtccctccctacttctaagggcagagggaagataaagtcttttggatactgaaaattgttatgaacaaaaccacagagaagtgatcgtgcttggtaagtccagaaaatgtgagtgggtggggaataaagcaaggcagcttctattttttcccccagctttattgaggtataattaataaataaaattgtgtatattttaaagtgtacagcgtgtgatgatttgttagacgtatacattgtgaaatgagatgacatggatgaacctggcaggcattatgtcaagtgaaataagccagacagagaaaaaacaaatactatatgatctcactcatatgtggaaccttgaaaaaactgaatgcatagaaacagagagtagaagggtagttgccaggggatgtgggtgggaggggatgggggaagatgttggtcaaaggtatagcaagggagattttaactcacaattattactctcagcttctcatgggatgtctcaatttcaaactgagcaaagaataggaagcagatttcattatcagacacctgagcccagtggttcctacagagctggagcatttatcttttcaaaggtcgagggatagcttcagggtactagtgaaatgccttgtttcagggaatcagagagcaagaagtggggtaaagtaggggtacagagggaagccgttctattcagcctctgctagagtctctccattccaagtctcaacccttcaagtgttattgatcgtgctggctcacactggagaatagggagtagcttttttgagaatccagtaagaaatccattgtgctttccagcctcttcacttgtgctttctaatttgattctctatgctttctatgttagaatatgtttccctatcttttcttcaatgagggtaatttcagatttcagatgacggaagatgactgctatgattcacaggagtacaatttattttatagaatgttacaagatacaaggcattacttagaagacccaagggaacaattggaaattgcttctctaccttgtagattatttaatgatagctgttatgatgcgatgagccgataaatgattaattcctgcagttattatgtgtacaaaaatctaactccgagatggttgatatgttcctcttctatggtctaaggaagccactttgtagacatggtgtaattgagctagtgtgagcaattttaagtaacatttaccagtctgatttggaaaaaaaatttctttattgtggatcctgatattattacagaagtaatatatgattttacttaatttctctggtacctactctccctcaaacaactctctatcccttttaatcacccctacccaataatctgattcttgtctctaagatagtcatacttttgtttaagaaatttccagtcctgatatttgtaaggttgcatattaagacccatttgtatgactggcttgaacttcatgtctttccacaaagaatactttgatctgtttctaggataccagaagagcacatctgcctttgcagaattgaatatggtttgcttattataagcccctagataaagggaatgtcaacctaaatgcgatggtacctagagaacagattctgttgagtgtgactgaacaatgaataaaagccacacctagtcaatttgggtggaatgcttgctggagcaggcaagtttgttcactctattaaacaggtctgaattgacatttgccagtataaaagtccatctctgaaagcttttttttggctttattaaggaagttcagcaggtgaaacaaaaggtgtgactccctagtatttttcaatgcagtttaagagagattgttcctgatgttcccagcaaaaaagtataagttgaagtatccccttgccataatcatgaggcaaatacaaccactgtagaagaatattagaaagagtaggcacagtggattaccctgaagcaaagctaatgttttaaaattttggttttacaattagaaattttagttatgaggaaagattctccctactgaatgtggtgtatgtatttataaagtgaatatgatattacaggctgttaaaatgttttatttggacattttgcatatctacacctgtccatatccaaactaaaggaaaacctgggaaattcccctagtttctctctttgaatgtggtgattcacatggaaacagatcctgacacacaggtgaacttgactcagtagagtgtattcatttgattatttatatagagattgttgattcagcacatttgaggttgcattgggatgtgccaagtcctcaggttctgttgtatgctattcatggctggcattcctgtggctaagttaccgagttccaaaccatgaaggccataaacaagtcttcctctctaggttttcctttatctcaaattgaatcatctgatagctgcctggatccctctccacctttttacatcattttcataattctgtttaccaaatatatttctcataaacaggcttatatgtttatctaacattaatatagtaaggaacgaaggtgatgtaatgcttcagaaccaagagaaaaaaaataatagaaagttcaaataggtacgaggaagggagatatactaattaatgaatattatttttagactcatgtttttaatgttgtttttttctcttttactaaagggctacaatgtattatattacttgggtttatattacttataaacttaggactagaacaattttaagtgactggagataaaattggaaaatatttatttactttttaatttttttttttttttgagacacggtatcactctgtggaccaggctggagtgcagtggcatgatcatagctcaatgtagctgcagacttgtggggtcaagtcatcatcctgccccatcctcctgagtagctgggactacaggtgcacatcaccatgcacagtaatgttttttaaaaattttttgaatagaaatagaaatgtgatctcactatgttgcccagtctggtactgatttcccagcctcaagcaatcctcctgccttgacctcccaaagtgctggcatgcctggcctactttttaatttttgtaagtcagtcattaaatgatatagtacttgaaaacaagaggacaaatattcatattagacttacagttttttagttcacataaatttagtttattgactgaaatatttatgctataaaaaagagtagttttgtcatggctcttttattaacaattattattttaaaaggtgacccagacattatgtaggtttaatagaaaagaaaattatgtccatattctaaattaccagtctcatggtcagtacagaaattataacattttaatgaaggttctgcagcaggtttttcagttcacctactcatgtaatgatgaatgatggcatttagttctttcatcttgatgtggtgacattacatgttttgtaaatgatttttgcaaaattttcaagttaggaaagacaagcattatgtaattataaggttaatatgctcttaatataattacaacagtcatgatcatgtgaacttccgcattgaggttgaccaaatcatatcacagaagtgcctggagtgctaccatgccatgatcatctggattttactacattttctgaaagattagacaaaattttacttttaggtatatcaactgaagcctactgtaatctgtttgttcaactaacattgtttttaaggtgtacttaccctgagactaacatgaggggtttagggatgctcatttgcatggtttccttccaaaaccctgagaggggtcctagcaacgtgtttaaaatgtgtttgtaaaatttgcaaaatatattcgtgtgtttcattcttaaggctccacttccccacccagtggtctaagcttcagaccccacatatcctagatttgctcctcattgcaattactggtccaaagtagagtagttattcgggccttttgctaataagactgtgtatgtcacatagcttaaagcttcttttacgttaaaacaaaataaatcccctagcagtccctttgctgctttgccccatctctgttaatagacactgtgaaatctgcttttttcaaaagttgaatgaaaatgctacacttttgcagccaaacagaggacacttgtacatgatatcttctttattttattttattattattatactttaagttttagggtacatgtgcacaatgtgcaggttagttacatatgtatacatgtgccatgctggtgtgctgcacccattaactcatcatttagcattaggtatatcttctatagtgtccagtttctttgatagtcacaaatctcaacattctccctttatcatcctttatatattcccgtgagataaattacatgtaacctcctctattttgtgtccttctcctctggggctggttagctcagttagttggagcctggtgctaatgagaccatggtggcctgtgagcttcactgttcgtggtcacagtgtaagctacagccagctaccttgagattgcttgctgttgatcacaaatgaggtgaaggctgggagtttggtgggctctgtgaatttttttttttttttttacctgcaggttggtatggctcagtaatttgtcaatgagaggagaccttatataaaaacctgtggctgccctaccacctgataattaaagtggtacccccaagcatttctaatttgccttaatatcctgtaatcatctgttaaatattcatttacacccttctttccgtggtcttctctcttgaaccactctggataccagtcacattagcaattcattaatcacctggattatacacattgtgaattactttgtgtataaaaaggtgtgaattactttgtgtattacaaagtgtataaaaaattactttttatacactttgtaataaagttacatatttttatctatagtatcactaaatcacttttttttagaactcttaattaggtaccttctagtatggatttagccactccaattttaaaaatacatacacatatgggattcatgtatgtacatatgtacatatgtatgtataaaataccctgtgcttttcatactgtttgatctagcaattcatatctttatcaaaagacagcttaggactagccatctgcctaaagtcttcctcagtggagaacaagactgaaggatttattcaatttctttgccaccatttttgaaactacttttacttctttttgcactctgatttttaaattgggttgatctatttagtaaatcaaaaattaattaatggtttaggaatccctttttattgaattcagtaagtattgagcatatactctgtgacaggtatttaaatgagtaaagggtggataaaaagatgatcaagaaacaaactctaccctctaggaattcgttatgtaacaaaagtaagatgttggatgaatattttctggtccccttaatttctgatttgtacctgattcttcatatttttgtagctttgggcctttcttttttcaacatagaattatctttctattagccatgcaaggttctgttttggtttgtgttgttttgatggtggtggtggtggtggttgtggttggtcaaacccttgataattttaaactcttagcctacctatttatctaactttcactgacatgttcataaatagtctccaggtttcctgtgggttccttgctttgctcagttcttcctatttatctcccaaaaacccacattttgtttataccctttgttaaaactagataaccacttaattctttgaactacttcaatgaggtatgattgacacacaaaagctgcacatgttcaatgtatacaaattgatgactttggagacaaacagatgctcatgatactattactacaatccatgccacaaacttgattttttaaaaaataatctttgtttcctactagaatactaaagttaattgaattgccattattattacacggtggtcaccaacaaatttttaggtcaattcctgttcacctcctcaggaacaatgtcaaagttaccctgcttataagtgtcaatcatttgctctcttcctaggtgatgtgctgatctgtgtttaggtactcctttatgattcctggcctgctgttgtatttctcctcccagcaaatatgggtagctctgaaccatgacttgtgttctcatttgtgttattctttatacctcttatactcacaatcacctattgatctttcaactaacctgcctgccttcaatggttcctcttacttggagaattctctgattaataagatcagaaaatccaggtctaggtgaggacaatggttcacttttgacccatgaactttttttttcttagctctctctagagccatggggacttattcattaacaagtacgattagtacttaaacaccactatcagcttgcatctgtttttaaagttaactctcaattattgagaaactaattaactagtctggaggttatgtgggtctcctgcagcctgcattttggccacttcagtccccacggaacattactcaaggagtgtggaaatgaccaagcaaatactgtgaaagagagattattcaattgtactctgtgtgaaagtgaagtctgatggaaactaaaattatggatttcagtgcattttgggattatctaaagatagaaatatgcatgatgaccgtaaaaagagccttccttttatattatataaatgcttgcaaatgagcaataaaatgaagatattatgacgctagtaaaatttatgagtgctatttttcttgtattaaaattgggtcaacaaattgttaccaaatgtttacccttctgtaaaagaaaatatctagtcattcaactctagacaggaactcagagatggaaggccccgattattctgttgaccttaggccaggattttgaaatattttacattcatccaacaataattgtaattgatcttggatatttttgaggtaactacaaatagatctaggctattgaggagacacaaagattgatttggcataacatttaattttcatttatttatactagcttgagaaataacctgttaagtcactgttcctaaagtgtgtgtaaactagacatttatttgaggcatagttttgcattgaattgcattgcctcagaatcctttaagagcaatctgtggtggcttttaaaatttttacctttacaggattccaactactatttccccattcttagtcacggagtagtgattgttctataaacaaatagttaaaaatcctaatcctaatattagtaactatgtaaaagaacattttagtgaataccttagtattggtttacaaagccaaacattttcaatttgtggaatcttgctacaaatactaaattcatatacatatatattcatatatattcatatatatatgaatatatatgaatatatatatgaatgtatatatgaatatatatgtatatatgtatatatgaatatatatatgaatatatatgtatatatgaatatatatatgaatatatatgtatatatgaatatatatatgaatatatatatgtatatatgaatatatatgaatatatatatgaatatatatatgtatatatgaatatatatatgaatatatatatatatgaatatatatatgaatatatatgaatatatatatgaatatatatatgaatatatatatatgaatatatatatgtgaatatatatgtgaatatatatatgtgaatatatatgaatatatatatgaatatatataggaatatatataggaatatatataggaatatatataggaatatatataggaatatataggaatatatatatgaatatatatatgaatatatatgaatatatataggaatatatataggaatatatatgaatatatataggaatatatatataggaatatatatgaatatatataggaatatatatataggaatatatatgaatatatataggaatatatatatgaatatatatgaatatatataggaatatatatatatgaatatatatgaatatatatgaatatatatttggtgctttactcctgaaagcgttggagaatttcattttttgaaatcatttagaaccaaggtcggtgaactttcttgtgaatggctaaatataaatattttaggctgtgaggttcaagatgcaaagttgagggtattatataggtacttatataacaagagaggaaacaaatatctacaattttttgtaatacagctctactaatgagcacaatgaaatttgtggatggacactggaataagagtttcctataattttcatgtttcactaaatattattctcttatttttttcaatcatttaaaactgtaaaaaacattcttagattgctggccatacaaaaacacaggcaggctgaatttggcttatgggccctagtttgcagagccttactctagaacagagattcttaaccagtaagtagttcataaccccacaccaggggtgagtgtcgtggggtccttgaacttgctgagatcacaagcaacattttttgcatacatgaatttttctgtggacagagtctgcagcctttatctgactcttggagaagtcctggactcaaaaaagattaggagccagtgttgtctagatatttcgttaatttttaggacacatttcctgagtgtctgatagttcctaagcaatctgcaagtcactgggaactcatgggaatttctactgtaggagctaatactgctagagacatggggataaatagttgtcaggtgatcttattcataaagtctgttgccaccaccattcttgctggttgacaacactcagaaagatgaaaatttacacctggttatgggagggacagccgtctcttttcaagtatttagtaaataatttaggttggaatttaaatatctgaaacatttaagtgttcagaccatttcaggctgtaaagataaatcagagtcagtatagttaaaaccttttcctttacaataaaaattaacccacagataggttcatgttagctcaactgacatcaagggctgagatatatatagagacaggattaaagttgcttattaaagctgagcttctgagcttgcaggctgcttgacttaacccatggctgttagtcaacgctaagcccttgaatgttcaaattcatgaaatggagtagttaccctggggcagaggtggtggtgagaaaacagaaatgtccaactgaaaataaataagccactcaggagttcctgcctctgccccagtattgagaatgggatagcttgcttcttctcaataaacagtgttatagaatgcatttcatactcaaggaggaaatagttataagagctaggatactaattttaagatctaaagatagcatagtttgtggtgaaaccttagaaaaatctaaatactttcagtaagccctttacattttatatgtagaccaatcattaatttatagcctttttttccatacacttggagcatataacaaacctaagaaagtttaaaagtattccaaagaaagcagaacttagctaggagaatttccctggtgagtcacctcaaaaaagaaaagaaaaaaattacagaagtaaaaagctaccataaacagaaagcattgctttcaaatacattaggcttcaatattgttgattgatcagcatttattagtgattaataactttttaatctggaaaattcacccacctccaggtctttctttcagttcaaaaattaatagatacaataatggtcctgctcatttttgtaaaaggcaagagcaaaaagtatgcaggagaatgggctggtggcttcagtgagaaatttaccaggaaagtcagagacaacgaaaagtcaagtgaagagcactatcgtgtgcttcaaaaatggactctttctcatcagagattcttggtgatcttgagacaactatgaatcattacattgataaagtctgccttattgcggaagcatgcctgggtggctgtttccagaagatttccttctcattatataaaatcatgtcacatcagctagttcctgagcttcacatctcattccatgacaagtatcccgtattcctgtagtctattacatcataagagctagttagactgggtcagcccttggctatttgcccccagactttagagtccttctcctgactacaccatcatctttcctggcacctggcgttccctttccacttaaggctcttggcaaccatgtctttcctactcaccctcgtgagtcttgccagttttttggtgccagattctttctgcccttcctaatgtcccaatcagctaatttgataaactcatctaaggtagaatgctaatgggggagtgcttccttctaagctgaatatggtttataacagagtcttcttggaatgctgtgtgggtgacaatttcaagtctgtgtgggggtgaggcaatgagtatacattgcccttcactttatattccacaatttgtatttagacttgtttctattaatgtgacttagcaggtatgggcacagtttggcaaatgcaacagattcgggggttttttcaagtgaaaaaattttataaagcaagaaggaacacatgcaattagtaatacacaatgagacaccaccagtttcacaataactaacttgtagagtcattattagaaatatactacatttagtcatgatttattattcattcattaagcttttaaaatgtatcattgagtatatctgtcaaccagtcattcactaagtgttgggtactataggggagatgagaactatcaaaggaataaaaccacattgacaagaaaagatacccacatgtggaacaaactggaaaacagcaaagtgataaataatatggcaacagataataaaggaaatacacatattaaactttttgaatccaggatctttgaaaatagaaaaagcagtaatagctttttgcatttctgaggttttttttttttttacaagttactctagtttgtgtaccatataatcctgttatcttatctcttcctgcctaacagggattcttgtagcatttctagtgccttcttttgaactatgaatatcatctggccccctggataaagacaaggctaggcaagtcagattagcttgtgaaacaggacctctaggatgactacagtaaacaataatttcttgtacacttaaaaataactaaaagagtataattagagtgtttgtgacaccaaggaatgataaatgcttgaggtgatagatactccatttaccctgatgtgattattacacacagtatgcctgtatcaaaatatctcatgtaccctataaatatagatacctactatgtacacataaaaatttaaaaaacaggacctctgatttaaaaaaataacaaaatataatggaccatactaaactcattttaggtagatattaaagcactcactttttctaatttatcactttcttcctcaactccttgctgtgttccataattgtcagtgggccaggaagacagaagcacagccagtatttggtagtacaggtggggcctgtggtaggacaggcagccttacagccaagcagtattgatggtgaagaggaaagaggaaggaaagggactgaatgcaaaggccatgcctgtgtaaggaaacaaagaagattgtccatatgtgtaatgtcattggtgacatggtttttagggaataaagaaagagttggaggaaacacatttggaacagactagcagtgagatttaatttggataattcatgactgttaaaatcatgtggcttattttatgagcttaccaataaagttagtacgtaaagagatttgttggtttaaaagcaactcctctatgggaattagtatgaggctaaaaataaatcagaagaaaacaatagtaaattttgatgtggcataagtaattttgatgtttctgaaagaatacctctttgtgtaatgacaggaagaatctttacctctaacatctttttttctcttttaaacatacagggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtatttgtgaacatatatataaatacctgtagaatagatattaaccttacacataaagcagtattctcagagcccagtgtgttgttttaaataagagaacccaaatttcttagcttatagggttgttaaacattttagtactgcaatcataccttgttataaagtgcattgattcacctgtatggtaggtcaaacaatatgttaagtgtacccagccatagactgtgcgatggcacaggaagcctctgtgggaatgttccttttacctaggctccagctttcagaaacagattactatatttgttaatgagtctctacttgctagaataatcaaagtgggaaaaaagtagacaatataactctctacgattgcagaatgtaaagctatatgaacacagaaggtaaattagtctcatagtgcctcaacttttttctccattttgagagtgatgtgctaggcagtaaataaccccgatgcctaagaaaagaaaatctgaaagaaatttcaaacagctttttgatttattgaagtccttcattcttctattgttattctttgtacattgaaataactagtctttccttacaaagtcagctccatttgcagccgcttaaatgcctagtaatgtattgtaatataatctgattgtacatataactcagttatggttcacaagttgactttggaaaaccagtgcattatggtgtgataaagactcatcttggacttaaaaaaacactaattatgcttaaggctgtgtattaactggagaattaaaactggttttcagtaatacttttttaaacatttttatttcaatgtaaggacaacctccttttggggagaatagaatttttttctgggaatagaaattctgtctgtttatatctcatagtgaatatggctttacattattctttatctttttagatttgttcacacataatatattcaatgtatatataattactgttacattcactagcaaaataaataaaagccagtcagcttccagtcatcagtgtgatgcgtgtgtatgtgcatgtgtgtgttctaaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggtaagaaaaggcctgcacttgtggcctgtttcagagtaaatgctttgtatattcctcaatttgtctaatatcctgtaaccatactcatggatggtcatgagaggaccttaatatgaacagtcaaggttataagctggaaaagaaagaacctatttattctactttatttactaagattttctaaagataattatttaaaagccttactaatgcttttaacctactgtgctctttctcccattttcagagtaagggtaaattatataatttaaacagtaagttatttttgagtgcttttatagtttcactaccctcaatatcctagagaggcagaaagttgcctctgctctgtgagccactttcatgggccctttgctactaacatccttaatgcctttcaaaaacacagcacttaaaagatagggtattaagtaggttgtaatttcctaaaggttaaggccacttttcctctctagaggcatagtatcaaggacagcagcctgcttagtctggggggaaatttctacgtggttgggagcagaggcctgactttggttttttttttttttttttttttttttgttgttgttgttgttttgttttgttttgttttgtgggggtggttgtgtgttttttgttgttgttgtttgttttgagatggagtctcactctgttgcccaggctagggtgcagtggcgtgatctcagctcactgtaacctccgcctcccaggttcaagcaattctctagccttagcctcctgagtagctgggactagaggcgtgcaccactgcttctggctaatttttgtagtttttatagaggccgggtttcaccatgttggccaggctggtcttgaacttctgatctcaggtgatcctcctgcctcaacctcccaaagtgctgggattacaggcatgagctaccgtgcgcagcccagagtcctgacttttaagttgctgtagaaagccagttttgggggaacagttagtgctgcttagtaatactgaaaggtaggaagcaggaaaaatatttgtgtaacactgcagtgtgatcactgagaaccaggaattctcgtgacttaagtttgccacagctgtccgttgttttgatgtgctgcttgctatgtctttctttttctccctggacctttccttgtgtaataaggcataacagccccagtaaaggacaaaacccacaggaaacctcatgttccctgggtgtggaaaaagcactgacatgaccctgaagcccaggagatgcactgtgagctaaatctcctcacaaacattcatagtttggactcccatgacagagactttgcctattcacaacagagagacacttattttcaaacatccctattaagaaggttttcctcataccgagttgaaatttatcttgctgcaactggaacttcacaaaagaagtcagtccctattccaagtgagagtgactctcatgtctcctgtctaagccaaatactgcaaattgctcccttttcctggtagtttatggtttcaaggacacagtaccatttttggactggctccactttttgtcagaactgaactcattacatcgtgaaggatctgagcaccaaagtagaacaaacttactttctcccttgatctgaacaacataatctgttaatgaatgttaaaaaagactttaccaaattctttttgtcttaaatgcttttgaaggggtaattataagctatgaaaatagcttcatatgcatctgtccatttctgattatttgagtgtgtttgatagaatgcataggttacaagtcagcctcaaatttccacgtagagagctaaatattatatcataggccttcaattgttacttgtgaatatcaatataaaattcccttttaagtaactgatcacagcagggtcttagcagtgagatcaagttggctcataagaatttgatagaggtaagattaaataaaggagggcttcatgaagaaattcaagctttttatatttttaaggattcatagtggacatgctttataaaagagacatttttaccttgttcatgtatatagctcaggttgagttcacagaaagcagcttgtatttaaaaaaaaaaagagagagacataaagggttgatacttagttcatccacagtctcacacctcttcggcaggtttatgagtttaatagtacaatcaccacccaattggaactgggcactgacccatcaggataaaccccagccataaataaacaagcagtactaccttaccagcgtctacctgttgaatgttcatctaggtttcaccccaatttgtagtttactagggaacataactggttctgatgatcataccatgctgccaactttcaagagagagaaggggacactccccgtttataccaaagggaaatctttttaacaaccagataagtaggtcttctgtcttagttaaaatgttcagcaaaaccattttctcccaatggtaataaaaggcattcgaaatgatagattttgttttatggtttatgattttagtactgacctttgccatctggtctgctgggataaatttggaaattttatatctctaaagctactcagtttattttatctcactcttctagcatgcttttctttatttaggtgaaatgaaaagcagatctgtcacagtgtgtgcactgacagtagagttcccaaaagaaaatagagataccttgagacctttgttatccacaggaacgaggtcatggcattacccttttggacacatggtaggatagttactcaacacaagcattcctgtttccttaagaatttggagcatacctaattgttgttgctgggacatgttttttaagtaacgtgcaatttgctgagaaaaaaaaaatgtaaagtaatgttaaacttctccaaagaatctgatccaggggcaagtttcacggagtattataagcacagtgggattttgaaagaactgtagacatgaaaggatggtttaaaaatgctaataggttttagaattaaaccttacaagaacttaacaaagcaaatggtacataccgaaatggacagcaagcctctataaataagaactgcatatattttgctaactatctacatagtacctgcgtgaggtaggtcgtgggggaggaaatattcatttgctttttccttacatgttagttaggaaatatataattataggacttgaacctgaagtctttgtataaactggattttattttatggggtgacagtgtcagactctgatctaccaacatctgttttatcacctatatgccatttatgtcctagatctgtattggagttttaacaggcagaaatctctttcctgctatatctgttgcttctgctaatctcatttttatagattcatagatgagtatccctgagatattaattataaatgattgtttactgtagtagctttctgtcatatcctgcccaaatgaggtctaaattagtgaagttgaaaacctttttttttttttgcatttttttttgttttgcactactgctcatgtagttggactacctctttttttttttttttttttcttgagacaggctcttgctctgtcactcaggctggagtgcagtggtgtggtctcagctcactgcagtcttgacgtcctgggctcaagcaatcctcctgtctcagcctcccaagtagctgggaccacaggcatgcaccaccatgcctggctactttttctattttttcagagatggggttttgccatattgcccgggctggtctcaaactcctaagctcaaacaatctgctggtctcagcctcccaaagtgctgggattacaggcgtgagccactgtacacggctgtgaacccccttatctctacatttggttaccttgctgtggggccactgcttatccagtgtcttgcccaatgcatacccttacggaggattcccaggaaataccttatatgactggtgcttgcttggtttgagtacatttgttactttctctagtactagtaccatctctccccccacaggccctgcagcctggtacactgcaactgataccaaagagatcagcactggaaaagcccaatggtgccaccccggtctttaatcccactgttttccactgccaacaggctctgactaacctgcagctcccacagccggcatttatccctgcaggtgagaacacagctctaggcactgcagcgagtttggtgatgttgtgaatgtatacaatgcaaaacagctttcaaagagcttgtataggaggactgtcgacatgtattttgattaaaaataaaacaaggaagttatgcttatctgctagtatctagaactacttgtttttctataattcatgaaaattcatggtttgaaatcaaactaggaaaaagtatcaacatttttctttttagcatttgttggtttttgcttatgattaattcacttggttcagtctcaaactaattccttgactcttaggtatcactgtcacagacagtagagtgctgtcaaataaaaaggcaaaaactcccagcttcgatattatggaaatgcgttgtcaatatgtctttgatatgccaaaggtagttaaaataaaactaccctaagtgcataatatagtataatatagattaaacagatagttttagcctgtaactcctgaatcagttaatataaaatacatagcagtttatattttctgacattttgcagcatattttgttatctcctacattcagctatatttaatagcctgttttacatgaaattgaacagaaaatgttaagccagaaatttgttcaattagatatcatatattggggggaaactaattttcttccagtggtttagtagtttaagaatgagcatatagtctcttaggaataaattgaaaattctaaccattgagagtacagcagttttttttttccatttttttttttttttgacacaatggtaaatgcccaagattggaaactatttttaaatgaaaataacatatgttttaaaaaataatttagaaatccttgttaatacccagacttgagaaaacttattggttaactagtaaattaatcagttaattaattttgaaaggtaccataaaacaccagtctttagttactagccacagcagtccttcatgccatcatttaaattatacaatttgtatacatttatatgatagtttctgagaggaaatatggaattcttcagcactttcttacatcccttataataagtaactactgatatctaataatttagatattttctcccaacctaagaaaaacacacataatgtctacagagtaaaagagaaaaccagtatgagttgacatgactttattcctagcattttttttcttcaaaaattgtggtaatttacctacacattagatcactctaccttggctacttccaatttgtattatagctgtggaatgaattcagtagccctggaagtctagtcaaggtggttgaatataataaaatgtatgctgttcatcatagtttttcttaatactacagttactttgtttccaagtttgaattttttgccagatttggccaacataaaatctagtttcataagcaaaaatgtcagaaaaattccctttcccttaattagtagcaacataaaagcctgtccagctaagaggtctctcttaatggaacctctttgccatatattcatagtcaagtcctattgactatgagacagtggaggagacagtgttaacagattaatactctaaatagaaacacggacaccagatacgagattctggagcatatttagaaaatgatatgtgtaataaattaaaattctcttattataaaaattatttaggatgtatttgtccacaataaatatgtaatttaagtgagttaattcttttaaagaaaaattatagctgattttgtacctaagaatccaagaattattttgattacctgggtttgtgaccttaaaactaatctgtaattgtaaacatgggagattgttggacttgcatgtgctgagtaattgatattgcaaagaaataatctttctgttaaaatgtatttctatcagtaaatccttaataatcaaatatctcttttactttccacgcttttctgcgtggtgtacagggccaatactgtgcatggcacccgcttcaaatattggtaggttttctacaaaaattatcaacattttctaatctgaaaaaatgtgtttttctgttgtgactatgaaagatgaatgactgaaagatgtggctggaaattttctgagtatgttaaggtttaacatggtgctttctgttttatgtctttgtagcatcaaaatagtcctactttctcaagtcctagttggttgccactgtggccaaatactggccctgtcatttctctatttctaccctaacaacagcaactgaaatattaaaaaatcgtttcttttacaatatttgaaactagccagactgggcagttttgttctttgcttaacatgtattatttaaaaattgtaaaatacttaaaatgtataacttgtaaagtacaatgaaacaattcccacctgaaaaagttatctataggacttaaagcattcaatgttcctatgttgcgagaggatgagttcagcaaagccagaggattctgcagtgttctgtaatgaatcctgtagtgttctagcctgaagcaccattggcacagaagctaggcacaacagaatcatttcaaaatgactctttgagtgttacgtgatttttaacaagcagttgcacacagatccttttgttagccactaacacaatatgatagccatctctaaaccattttatacagcactaatactgaagagcatgagaaaggaatggggagttcacagctcctacagtcctcatgggcacaaggaacagaccaggagaaaatagctctgttctatgcaaggagaaatgatcccaacccgtcccactctaccgtctcacatcaatccaggccatcccctcccttttgagagtttgcaacaaattgacctttgtcaccttggtggaccagaatagatgcagagccccaaaagcactactaacaggcttcttgagaataaagttcaaaatgacaaccacatagtagcagcactcactaacatagcgagatctgaaccctgggaatggaagtgaggcccctgttactgagggtttgactgtcttctgtaggaattaataaacatttccattaataccaacaggagcacaatatgtatacctttgaatcataatgtgtacaattagaacagacttctgcaagtttgagaaatgtgtctttgccttcatgttttgtgacagttttcttgaagatgctctcttgtcctttcaccttcagagctttgcttaggaatgcaaactgcattctttagtggatctgcttcctgtacaattgctgcactcccaaagggaaaacaagagtgtttttagaattggcatatgagacaacagggatggctctgggtaatgggtaactagagataaatggaagggataactatggagtttctgttaatcaccatttggggtacattttcagtttctatgacattgcacatgttaatttttctctggccattcattttctctttagactttcagaaaatctgaatttaattgatgtagacatgataaattattacatatgcatgcttgccattcacacattgccattcacacattaattccctggtttgctttctgaaatgagctagacatcagaaagcacccaaaacgctttctaaatgagatagaaactagaaaaggcaaagataaaacatcctgcaagagatttcacagctgctaaccattgtagctataatagttgctgtgaagacaagatttactgtgaagtactccatgtatttgtttgataaatggccaaagtttcccaggagtttgccagaggtgtacttaaaaacctgcatgcatagtccactgtattcttcatatctgcccccctaccacataccaaccagtctacctaccatgtctttgcatgcagatcaggtaagtatacatataactgcctgtttgcacctgcaaatctagtgacggcattcatgtccataagtcagtgaacctaaattccaatttatgattccttaattccattttgaatgtgcagtccagttacttgtctgcttaactagcttcagatagatagcccttgtaacattggatttttgttttcatatgcattcattatagccccttctgaaaatttagccttttgagtaaactacaatgggattctgctcaaaaacttactaaatgttgagaatggttccattttccatattggtaactataattggctttccccttttctctttttaattttccccccttccatgctgtgttgctttgcactgactgtgattgcatgaacaccctgatgtattcatcgttatgatgtcacatggcttgttgctgtgatacctaccacacctcattccatcgtaaatgttatggttgcataaatcctctaccctcccgtgtgttgcttctatggttttcaactgaaagtgcccatgatgcacggtgctacacctaccactgtgtctgcagcaacaacacctgcc

SEQ ID NO: 3722 - DNA, 214355 bp, human
ccaaacatccctggactagaagttgcaggggaaatcaaacagcccagaaagtttattctccttgctggtatttcttccacttgctattttgctgagagatgcatgcaaactacccttagactttcagatgcagtgcgttttacttagccgtgcctgacaaacacacagaacttttaccgtctggtagatccgccttgactttaccagcgaatactaaagtcacttaaaaaaaaatcacaaggctcgaaaacagcagcattagaagtagactttatggtactctgctcagctatgttctcatttgattccaaccactacacggcagaaaaggtaaccaatattcaagaaagatttgattggaaacggtttaggcctaaagactaatttattttaatcgttgattatgtataacaatttgcttggctggctcttacatgctgaagttttgttttaaaggccatcctatgtagtctttgaaattcaaaagcaagtagtaactctggtgttagattctaagtttctatttttagataaaattgttacttccgactatctttccctttgctagctttctatttgtaaactttgtgtcggatccacagagccccagggccaggagtctaggctgtattttaggtgtgtcactttcttttcaattcaagcatgtacccagaaacctgcgagactcagtggccagcctagcaaaaatgactccaaattcccttacttacaagccctaaatggccaaactctataaagagatttattactcagcctaaattgttggacattagaacacaggcgaatcatagtagtgtgaggtcccactgtccctccctgagtattccccaatgtcacttacagtcttcaaaggagagtttagttcaatttctccttgacctcaggccggtgccatctctccagcgaagtccccagctctggctccagctggcctgggccctgtgtcgtatcagaggcactgccctctgctggaaggggtttggtctgtgagttatgagtttccccacaggtcactgctcctttcacacgtgctgttgcctgatttggagctctgctgctcatctccctgcctagctgtctccagactgtctggtgggattcacagccctccaccagccgtgcttgtaactgagtctggaaattcctcttctgatccagccagtgttgagcaatcgtggcaagtctttgctctattactaaactgtcaaagcaaggagttctttttcaggtcatcccacctgttggcaattctaatatctctgaatgtgttggtcatgcttaggagagagttctttgtttctccacgcagtgaaacatactcctcccctcagtacagcgtcctgtggggtcactctcgtcaactacagtggacaaatattacactcagtctaaagatccttctaaactttcttaggaagggtattcattacagcattgattaggaaatcaaacaattggaagaagcttaaatgtccttcagtaggtgatttttaaaagtttcatagctctctatatctattatctatcatctatctatctatctaccaacctacctacctacctatctgtattcacagaataggatattatgcagctactttaaaagagaaaagcagatttgtaagtgtttatataaaaagatggccaagatatattgtagggctgaaaaagcaagatactgaacaaatgtctagttgctactgtttatgtaaaacgcaggtgtgtaatagttacatagccattcaaatctgaaacaaagtaattatgggtgaggactattatgaaatggcttttatttctccatattttaatttataaacaataattgggaaaaaggaagtaaatataactttataatatttttaaaggaggaacaaaagaaagttgttgatcttggttttgtaaaaaaaaaaaaaaaaaatcctgactgtctaggggtcagtggacaggtccgcccaatttaaacaaattccctacccttgcttgccctccccaaacatctctatacttagaaaagtattttcacatacattatctcattagactcctgttgtttgctagtgtactctcattaagcaatgagggtataaagagcaagcagaagagtgcggcctggcagttgagagctaaggctctgaaatgagacagaggtgcattaaaattgcagctccgccacattctagctctgtgtccccaagcaagtgatttcacttgtctgagcctctaactcctcacttgtaaaaaggagataagaagttaacgtgaaaatgtaatgaggtattacaggtaaagtgcttagcacagtcccttgcacattataaagcctcaataaatgctatttggtttttatttaaaagatttaatgaattgttaatttttaaaaaatagcaaacatgggggtaacaaaattttaaaagctcaaatatctgcaagtggcacgaaaataataattcagttactcttcacaaagatatttattgttaaaagcttcttatgtttttcaggggggaacattattcatatgtcagtgtatcaatctaccttctatatatatttttaaaaattactgtactacaaaagtaatcaactgtacacactattttttaccttgctttttaaactttaattaattaatttttttaagacagtgtctccctctgttacccaagctggagggcagtagcatgatcatagctcactgcagcctcaacctcctggactcaagggatcctcccacctcagcctcccgagtagctaggactacaggtacatgccaccacacacagctaatttaatttaatttaatttttttggtagagatggagtcttactatgttgcccatggtggtctccaactcctgagctcaagggatcctcccgacttggcctcccaaagtgctgggattaaaggcatgagccaccatgtctggccttcttaatttttatttcatggctgtatcataagctaattagccagctcccctttgaaggacactgattgcttctaggtttttgcactaaacgccttggacatatatcattgtcagttaatgtttagggtgaatttctagtaattcaataattgaaacaaaaggcacttgcacttaaaattcttctggtaagtattgccaaattgtccttcagaaaggtcacaccaattcacattcccaccaatgcagtatgaccgtatcattttataacctcacagtaggtattactaattttagcattttatagtgattgttacttgctttagggtattttcaggactaacaaatgcagggcagcgttttagaaggaatttggacttcagagccagacagtcctaacactgcccttttgcaagctacacctccattccttcatttgtaaagttgggcataatagcagtatctaactcatagaataataaatgagaaatccattcaaagcatttagccttccaaatattaattgctcaataaatagaaactgctcaagtaataattttctactccaaaggcttgaatatgggaagaggggaatgggaggacttctctagagatcatgcccttgagattcacaacttttgctttaattctgcatcaacctcctttccaaagtattgctcaggcattattttaaagaacacaacccatttttaccatagtgtgaagaaaccacagtgtatgcactatatgcagataatataagtaatagggccataatctcattttttgaaattagtttggcacaagtttaaagtgctggatgtttgctacaggcaccagttgcttacttatccctttcttcttttcgagttgttacctccttcagttgcaatccttggagccaccaactgcctgggatattttaccctaacttccactctccaaatgagccgtcttgccttctaggtcctgggaaaaaacccatggctatccatctactttctatacatggctatctattttccatccaggctcttcccttctcttttgctagaagttgctcttgaattaccagaaagcttgagccagtaatgtcctcagtctttgcctacagaaatcttatttcaatgctttagggaccccattgatatcagctaaattgtcctggattctttctagctcctaccctctaagattccaatcttctctttcaaatcctgcctccagctacaccaatcattagttaatcattagttctgcatgtcaggctcccccagtacacaaaaccaattttatacctttattattatcttttttctcatgaaaataatgttatttgcaaaaaattataaaagtataatcccactacctggagaaaattgctattaacattttagtgtctttcacaattttttttctggagagagttaaagaacattttttttttgtaaactaataatgggttcatataaatttgtgaatggcttctttcacttactgaaacatcatgtctgcataaagcactaaaaaatactcatgtatccctcatcccctacatgagtaagccttttttcctatagctttagctttcctacagcatcaatgagaatttaatcacattcaattttgctcacctggaatccttcatccaatcaatgagatttcactagaggtgctgctgaccacagaggacactaccccaacctggccaggcagacactcctacaaagtcacaaatttgtgcgactgctgacaaagttagtttctcagaactgagaggcgtactaaatagggatgtgtttaaaatagatctgaattccttaacaatttttccctctccacttcatccttgatttgaaagatagtagttagaaaattattttgtaatctatcaagtaccaaataaatttaaagaattagtactaataataactatactcccatactcctaatatatgtacatcagaatcacctggaggtgatgtgaaccacagacggccaggtctcaaccccagagttttttattcagtaggtctgggtcaggatctataatttgcatatctaagttcccagatgacactgttgctgctggcccagggaccacattttaagcaccactgttctgtaaagcggtaggacattatttggggctttcttgcttgatactcattaatgtatccactcattcatttatcacacagttattgaattcctactctgtgccaagcactttactagcatttttgaggaatatagacaatacaatcaacattacagtatagcgtggcacatcctgtgatacagatatcggccagggtgttatgggagacttaggaagggtatcagggaagatttcctagagaaggtgattgggcagtaggcaaggaggccagaagaatcggtaggggctagaaccataggggaaagccttgagtagtaagctaaggggtttgacttttcccctggaggctgtaggaagccatggaatgtgtttttacaaaggtcttaattgcggtatacaaaatcaggggctagcgacatccatgccaggttcaaccattggctgtgctgcatatgtagcctgaggcaagttacttcttaccttctctgagcttctctttcatcatgtgtgaagggaaaatattaatagatctaccttatttgggtattgtgaagattaagtaagaaaaagtgcctaagtacccatcatatggtaggtgtttaacaaatggtgattatgatcaggtttaagccatagaaagaaatgacatgtaagacatgcttctcaggttattaaaatccatttgaaattgccaagctagtctcaatatcaaggccatatttgatgtgaagattaagtaagaaaaagtgcctaagtacccaccatacggtaggtgtttaacaaatggtgtttatgatcaggtttaaaccatagaaagaaatgacgtgtaagacaggcttctcagattattaaaatccatttgaaattgccaagctagtctcaatatcaaggccatatttgatgtggtggcaagtcggatgatttaatcatgtaatgataatagtttatcttgtcttttgttttgttttgttttggagacagagttgctctgtcatccaggctggagtgcagtggtgcgatctcagctcactgcaacctccgcctcctgggttcaagcgattctcctgcctcagcttccccagtagctggggctacaggtgcatgccagaatccctggtaatttgttgttgttgttgtattttttagtagagatggggtttcaccatattgcccaggctggcctcgaacttctgcgctcaggcaatctacttgcctcagcctcccaaagtgctaggattacaggcttgagccaccacacccagcctgatgataatttcttgattacagattatttgcgaggcactgtgcaaagtgatttatgcacatcatttcatttaatcctagcaataaccttaagagttaggtattattattcccaattttacaaacaaaggaattaaggctcaaagaagttagtttgtacatagtcgaacagttgggtagtggtagagtttgaattcaaacctaagttagtctgagcctatcttatattagccaccttgttccacagaaagcagttttgtttctttgaaggacagggcagcgaatgggcagtgaggcaaggttaaagaatctagactttattaccctgtttctctgccctcgagtaagactgactgttcatactgatttcaagtgccctctggaaacatgcctctataacctcccaggggccccttgaccttggatctgtggcacctggtactgaacctgaggtggtcatagttactttccaaagtgctctggaacatttacaacaaggagcccccttgttttgacactaggacaatattagactctgtaagaggaggcattggggtaagcctagttatttttaatgctgctattactactattgtttattgagcacttgccacatgtcagaaattctgtacttcaatccttacagcaaccctataaggcaagcacattgtcatcatcatctctagtttagagatgaggaaactgaggctcacacaactaagttcacacagccggtagatgcagattcaagcagaaaactcgttcattcatttttacaaaccttgcattttcatttcttcctttgcctctgtacctataacaccttcaaacacagatgtaatcctcctgaattcttttactgcccacaagttttatttaccacatagtttaagccctatttttaatgatgtatatacaaatcgtgtttctcctcaaaattatttcatgccataaaaagtcactcttccctccctttatttacaaattcattcctctttagaaatgagcacttataataattacatgcaaggccaaatttttactgtttagtgtaaacccataatgtgaaattgagaatggttgaaaagcacggttatgaaaacatcgtggactccagactcatcccatacaatttccaaggggaatttattctaagtactttaaaacttacaaagagttgaattctgaactacttgggcctctatgcactcttagcaattcccccagcagggaaccaaaaatgagaatagaaagaaattgcctcaacattgaattcttagacatttagaaggcctggagtctgaatactttaaaaggctgttatttaaatgtgggaaatgatgtgaaaagtataatgtaaagataagataaatattgtttgctaaaataaatcatcgggtttttttttgtcaaattcatggcaattttaaaatcctgttaattctatttatttttttcttatttggagcaggtagctgaatatgcagagttctggcactaggtgtcagcaaaagattaaactaaaaacacccactttgggtttttttcttttcttttttctttctacacatatatatttgagacagggtctcactctgtcacccaggctttagtgcggtggcatgatcatagctcactgcagcctcgaactccctgggctcaggtgatcctcccaactcagcctccggagtagctgggactacagccatgtgccaccatgcccagctaattttttgtatttttttttttttttgtagaaatggggtattgctatgttgcctgggctggtctcaaactccttggcttaagcaatcctcctgccttggcctcccgaagtgctgggattacagtcatgagccaccatgcccggcctaatcttccatatatttcaaactttataaaaataaaaataaaatacatagtctggattttaaaaagaagagacaacacacttccttgttgccatgacaacgtcagcatgagagaggctgggttgctgctgctcaagtaggcaccttacagagatcctcatggctcaaggaattcaatgtaagaccgtttgacctttagcattgaatggctggggactcaattttgtgtcagctagaaagctggggaatgagaagtttggagggttggatggggtggtgaggtacactcctgtaaaccagatcttaaaagtctaaatattaaattattttacatagaaatgtagtgttcaagccaaccacagtgcttgtgcagacaaattcagtggatgcttttcccacatgacaagattaacaaaattaacttagaggctagctttgagaacccaggctgatcctaagggtttctcaaacttactatgttaattttagcatatcatagggtttttttttccttttaatatccagagctttccccccttcttgtgattcctgtcacagtaaatggtgttaccatccagcagtcattgaaagtagaacttagggtattgttttaggtcattcttgtgttgctagaaagaaatacctaaggctgggtaatttataaagaagaggtttaactgggtcaaggttctgcaggctgtacaggatacatggcatgtgcatctgctggcttctagggaggccttggggagcttttacttatggtggaaggtcaagcaggagcaggcaggtcacacggggaaagcaggagcaagaggaaaagagcaggaggtgccacacactcttacacaaccagatcttgcaacaactgactcactatagcaaggacagcaccaagccatgaaagatctgcccccatgatccaatcacattccaccaggccccacctccaacactggggattacgtttccacatgagatttgatggggacacagatccaaaccatataaaatatcactcttaactcttcctttatcctcatttcctataaccaaacaacccattaagtcctgccaagtctacctccttagtctttcttacatccgtcatatcctatgtctgctctagtgtgtagagggactggagaaacatttgtgtgacaactctttcctgaatgctgtaatagcctcctaaatcgtttgtatgtctctggtgttttctgcatacttttaccagtgttatgaaacaagtctgtttgaaacaagtctaactacatatttctgctgatttcaacaactctctatcagaaaaagcccaagtttatacgcatgaaatataaggtcttctatattcttattcctgcctaccttccaagcacatctcccaccttcacatcctttatgttctagtacaaataaaatcatcatggtttcagtgaatttgcacccagtcttatggctttaaataccatcttacatactgcagactcccaaatttacatctccagttcagactgctcccatagttctagatcaggggtccacgacctctgggccatgggccggtaccggtctgtggcctgttaggaactgggtcacacagcaggaggtgacttgtgggtgaggaagcattaccgcctgagctctgcctcctatcagatcagcagcggcattagattctcataggagcatgaaccctattgtgaacagcgcatgcgaaggatctaggttgtatgccccttatgagaatctaactgcctgatgatttgacatggaacagtttcatgctgaaaccatcccctgctgtcgccccccacctccccaccctctatggaaaaaattgtcttccacaaaaccagtccctggtgccaaaaaggttggggaccgctactctagattcatacttatactatagttccatttgtattactcagacatctcagatttaacatgtccaatgctgaatcttgataaccacctctcctcagaaatgaacacatgcctctcctgcagtcagtcttcctttctttctctttctttttctttctttctctctctttctttctttctctctctcttccctccctccctccctccctccctccctccctccctccctccctccttccttccttccttccttcctctctctctctctcactctctctgtctctcagacaagatcttgctctgttgcccaggaaggagtacaatggtgcaatcatggcttactgtagccttaacctcctgggctcaagcaatcctcccacctctgcctcctgaatagctgggactacaggcaagcgtcaccatacccggctaatttgtgtatgttttgtagagatgaggtctcattttgttgcccagactggtctcgtactcctgggctcaagcagtcctcctgcttgcaccttctgaagtgttgggattacaggcatgagccaccattcccagcctcccttctgcagtcttaaaaatctcagtaaatggcaactccagcttccagttgcacagactacactcttccagtcatcctagagtcttcttttccccttatgccatacaatccaacccatctggagatactgaagttcttatcttcataatatgtccaaaatgtgactatttcttaccacacccactgctaagaatctggcccaaaccaccattttcacttttctggatgattattgtattcttctaattgctcttgctgtttgtgaacttagcctccttcaatctattctcaacgcagtagccaaactgatcccattatagccacaaaatcctacagtaatttctcatctcactcagagcaaagtcaaagtccttacaataatctaaaaagcactacataatctggctcttcataaatgatagatatactcttacactagcctctgtacttgctgtgccatctagaacgttcttcccccagattctcagtttccttcctttcttcagctgttttactcaagagctcctactctgtgtaacattgcaccccctcctcatgcaataccttcaagtcttatttatttttttctcattagcacttacacttttctaatgtactatgttctttagggattttaatatgtttcccctattacaatgtaaactccacaaggatgggtacttttgtaaattttgttcactgaatatcccatggtctagaaaagtgcctgcaacgtggtaggtgttaaatagtgatgatgttattaaactgtttacacagttctgtacatattttatttgcatatgccttatatattacctctgcccagagggctttcccctatcttcatttttccccgctatggattggcagcattcttttttcttaaaaaaatcagctttattgaaatataatttacacaccacataattcatccacttaaggggtacaattcaatgatagtattatgttacagagttacgcaaccatcaccacattttttttcttcaaattctattttaagttctggggtacatgtgcagcatgtgcaggtttgttacataggtaaacatgtgccatggtggtttgctgcacagatcatcccaccacctaggtattaagccccgcatccattagctattcttcctgatgctctccctacccccaccttcccctctgagaggccccagtgtgtgcgtcaccacaattttagaacatttttatcacttcaaaaagaagccaggtactctagctattgtctctctatctccattcctgcagccctaaccaaccactaatctactttctgtctctctagatttgcctcttctggacatttcatataaatggaatcatataatatgtggttttttgtgactagcttgtttcacttagcataatgtttctaagcttcatccatgtgatagcatatatcagtacttcattccttttcatggccaaataatattatattatattatattatattgatataccacattttgtttatccatttgtcagttgatgtgcaattgggttgcttccaccttttgactattatgaataagactcctgtaaacacttgtgtacaattttaaaatgtggacaaatttaaaatgtgttttcatttctctctctctctttttttctttttgttcttttgagacggagtctcactctgctgcccaggctggagtgcagtggcatgatctcagctcactgcaacctccgcctcccgggttcaagcaattctcctgccttaacctccagagtagctgagattacaggcgtgcacaaatcatcccatcccctaggtattaagcccagcatccattagctattcttcctgatgttctccctccccccacccatgcgtggctaatttttgaatttttagtagagacagggtttcatcatgttggccaagctggtcacaaactcctgacctcaagtaatctgcctgccttggcctcccaaagtgctgggattacaggtcatcatgcctggcctcatttcttttgagttgagaattgctgagtcatatgacaactctaggtttaaccgtttgaaaaactgccagaccattttccaaagtgaatgcaccatttcacattcccaccagtagtgtatgagggttgaaatttctcctcatcctctccaacatttgtcattatctcactctttgattgtaatcatcctcatgggtgtgacatggtaacacattgtagttttgatttgcatttccccactgactaatgatattgagcatcttttcatgtgcttattggttatttgtatatctcttttggagaaatgtctagatcctttacctattttcaaattgggttctttttctttttatcattgagttgtaagagttctttatatatcctagatataagtctgtattaatctgttctcacactgctataaagaactacctggtactggttaatttatgaagaaaagaggtttaattggctcacggttccacagatttaacagaaagcatgactgggaggcctcaggaaacttacgataatggcagaaggtgaaggggaagcaagcaccttcttcatatggtggcaggagagagagagagcaaaaagggaagtgccacatacttttaaaccatcagatctcatgagaactgactcactatcaggagaagagcaagggagaaatcctccccatgatccaatcacctcccaccaagtccctcctctgattaaacatgagatttgtgtaaggacacaaatccaaaccatattcaagtcccttattagacatagatgatttgcaaatatgatctctcattctctaggttgtctttgggttgatagtatcttttggagcacaacattttttaagtatgatgaagtttaatttatctatttttttctttggttgcttgtgtttttggtgtcgtatctaaggatactttgccaattttgaggtcatgaatatttaccttataatttcttctaagagttttacaagtttagctcttacatttacatctttgattaattttgagttaatttttgtatatggggtgagtaagggtacaatttaactctttcacatgtggctaactagttgttccagcagtttgttaaaacaactattcttccctgttgaatggtcttggcaaaaatcaattgaccataggtgtatgggtttatttctgtactctcaattctattctattgttttatgtctatccttatggcagtaacacattgtcttgattactactgctttttagtacattttgaaatcagaagtgtgaatcttccaggtttgttcttctttttcatgattattttggctattctgggtcatttgcaattccaagtgaatattagaatcagctagtcaatttctaaaaggaatccacctgagattatggtaggaattgcattgaatctatagatcaattcaaagagtattgccaccttaacaatattaagtctattaagtcttctcatccacaagcatgggatatttttcaatttatttagatattctaaaatttattgaacaatatttgttagttttcagagtgtaagatttgcacctcttttgttaaatttcttcctaaacattttatactttttcaatgctactatgaatggaattgtttcttaatttcattttggactgttcattgtaagtgtatagaaataaaattgaattttgtatattgattttgtaccctaaaaacttgctgaatttgcttattagttctaatagttcttttcagattccttagcattatctacatacaagatcatgtcatctgtgaatagacatcattttatatcttcctttccaatcaggatgtcttttatttcatcttcttgcctaattgccctgcctaaaacttccagtacaatgttgaataaaaattgtgagaacagatcgatatcttcgtctgattttccatctcctggaaagcatgtagcctttcactactaagtacgctgttagctgtgggtttcttgtagataccctttatcaatttgaggatgttctttctaattctagtctgtggagtgttttttaaaatcatgaaatagtgttaggatatttgtcaaatggtttttctgtgtctactgagatgatcatgtaattttcttgttttgttgatataatgtgttatactaattgattttcaaatgttgaaccaaacttgcattcctgtgataaatctcacttggtcatgatacataattcttttttggattttgctggattcagtttgctagtgtttgtggtgaatttttgtatccatattcataagagatattggtctgcagtggttttttttttagttgtgatgtttttgtctgttttttctctcaggataatattggtcccatagaatcagttgggagatgttccttcctcctttttaatttggaagagtatgtgatgaactattattaattgatcatcacatgtttggtagaattcaccagtgaggctatctgggcctaggtttttctttgtgggtagttttgcctttttattttttttttaactacatcaatctcttacttgttataggtctcttcagattgcctaatttttcttgagtaaattttggtagtttttgtctttctagaaatttgtccatttaatctaggttatttattttattggtagacaactgttcatagtacacctttataatccttcttattcctgcaaggtctgtagtaatgttcccttttttgcctggctaatatatattcttcctctgagatccaattcacacaccatctatttcacaaagctttcttttacactcctcctacccccacccccaccccaaaaatctttctgaaataatattcaatacccctcttcattccctcatcatatcattttacagactgtattatttcctctttattatgtctattttcctcctagactgtgagaaacttgaggaaagaaactttggtcttaatgacacaagatgcttaatgaatgtttttggaaattaactgaaattagtgactgttatcaagctcccttagcctgatgcatctatatccactattgaactacatttgctactcagagtaaatattcctattttctcatcagtgtcccctcttattcttattactgatctctccctttgcctttctccacacttgtataatatgatgacctctctccctcatccacaagttgccaagaacttccttaaaaagctaaatctcagttttccatattccacccttctaaatcatccatggttcattgtaaaatctctggctgaaaaaaaaacataaagagccctaaactcatgaaaaggtactcagtctcactccgtaataagaaaggtgtaaattaaagccacactgaaatactgtttttcacctatcagattggcaaaagacaaaatgtttgataatacaagtagcaaagaggaagagaaggaaagaaacttgtaaccatcaagcaactacagtggaccaggcacattacaggaagtaagctattgatttcctccctctccatcttttacgtgaatttgccagctaaaatgaagtatgtacaaataaaatacattttgcttgaaaagtaagttatttctggacacatatttgtgtatcagaaaagataagtgtttcatattaagataaggaaagagtgtgaattaggttcaactatacataatttacagatagattataaatctttttccctgtctcttgccctgtgctcctcctaatcctcattagttaatgacatcaaatgagaatgcatgcaatttaggaaacgatagtagagagtacaaaaggggatttcagtaagttttcagacaacctagaaagttcagcctcctttcagtgtgatcaggaaagactgaactatgaacaggattccagattcatctaaagttaaggtcgaaatttctaaaagtggggctgtggatctcttagaggcttgtaaatccctacattgaattgtctgtacacaataaatagatctggtatatatgtgcaatgctttaaattcatattgatgttattgtgaagaataaaatataaattcacatatgtttacaaacaaattttaattttttcattttgcaaaagcagtacatgctaattgtcaaaaactatggactggcaagaggaagaacataaagttcacctaaaattctaccacccagaagtaaccatagttgtatattttttgatagaaatgatttagatttacagaaaaattgtgaagatagtatagagttccaatataacacacacctagtttctcctattattaacatcttatgttagcatggtacattcgttttaattagtgaaccaatattgattcattattattaactgaagcccatactgtgtttgaatttccttagtttttacctaatgctttttctctgttcagagatcccatccaggataccacagtcgtcatacctccttaggttgttcttggctgtgacactttctttgattttccttgtttttgatgacgttgacagtattggttagatatttgtagaatgtttctcatttggatttgtctgatgttttttgtaatttgacagaagttatggagtttgaggagaaagactatagaagtaaagtccaattctcatcagtaaaatgccattcccatcacaccatatcaagggtgtgtacattacatatatgtgcgtacatgtacgttgtaattatatgtgtatgtatatataattacatataattacaatgtacatactattttgtactctgctttcacttaaatacctggcacgaaaccctttcatgtcattaacagcaacatattaatatctacaagttcattttaaaatgttaatgattccagaggagatttatgtctccatgtctttcctcaaatgatggattctctgggtctacttcctatcatgtgcaagacagtgtcatttgtttacattatagaagtgggtctgattgtagagtttgcatcctagactccgacatttctctttgaggctgtaggttgggttgggttttgtgagctattttgaatattttgaattcctttcaggatcagtgataagtgaggaggtaagagagataaatacagaggatacgctatgtagagaattcagaaaaacaagagacttttggatttattatctaaagggagataatccaattcagagtcactacctgagatactatgggaactgacagtctccaaaggctatgttttgctaaaccacagcatatttccacgaattaggacacaagggatggtaaagatttgtggcaatagatatttgcgtcatttagaaatgtcaactagggggccgggcgcagtggctcatgcctgtaatcccagcactttgggaggccgaggcgggcggatcacgaggtcaggagatcaagaccatcctggctaacaaggtgaaaccccgtctctactaaaaaaaaaaaaaaaaaaaaaatacaaacaaagtagccgggcgtggtggcgggtgcctgtagtcccagctactagagagactaaggcaggagaatggcgtgaacccaggaggcggagcttgcagtgagccgagatcgcgccactgcactccagcctgggcgacagagcaagactccttctcaaaaaaaaaaaaaaaaaaaaaaagaaaaaaaatgtcaactagaactcatggtattttttatgaattgaaaagtgaccccaaataactagctaatttgtactttgtggtagcattttattaaatattaaaatttggttcttctgggtggaattttacctaagataattacaatatattataatttaaaccaacactgtggttgaacccaacgtcatattttgagtgttactgccaattggacaatgtttacttactaccccctatgggttagaggtaaactaactagattatttgtttgggcttatctctgcttatgttgatccaaaagatgtcattaatttctgctaacattattgtttgaatgaagtgaaattaagggtgtgttattatgactaatacggtgaatgtatttatttatttattttaagtatttgacactgactcctggggattacaataggagattctgctggcttttgcctacatatcaagaaaagtatgtatgcagtatcatgccaggaaatgagtggcagaggcttggactgggaacattataccaattgtaatgtatttgcagcagtaaaccagaggccaggggagttacaaaaacaagactgccaactcacaccgaatgtctatgcaaataagcaattgagagatcttagtttatttattcaaatgtggtatgctgacaacagcagtggactgagaagtatgaagttctgagtttggaagcctcctacaacaccaactccctgtgtaatcaagactcatcacttcctctttctgagttttcccctcccaaggctctttctagatctagcagcctatgaatcctatgattctactaggtgtgaggcattaggtgctttgtgagagccaaaattgtataagacactcttaaagttctttttttggaggctgtatatttttaatagaaatattaaaaatttatctgtcattgtgtcacactctgtcactgtgtcacccaggctggagtgcagtagcacaatcatggctcactgcagcctcaacctcctgggctcaagcaatcctcctgcctcagcctcctgagtagctggaactacaggtgcacaccagcagacatggctaatctttgtattttttgtagagacagggttttgccatgttgtccaggctggtcttgagctcctgggctcaagtgatcttcccacctttgcctcccaaagtgttgagattacaggtgtgagccactgtgcctagcctcaagttctctctctctttttttttttttttttgagacagagtctcactctgttgccaggctggagtgcagtggccagatcttggctcactgcaacctctgcttcccgggttcaagtaattctgcctcagcctcccgagtagctgggattacaggtgtgtaccaccttgctcagctaatttttgtatttttcgtagaggtgggttttcaccatgttagccaggctggtctcgaactcctgacctcaaatgatccacctggctcggcctcccaaagtgctgggattacaggcgtgagccactgtgcctggccctggcctcgagttcttaaaaatcaaagtaaggagttgaatattccatagatattctgcaaatatttgctcccaggactcaagaaggccccaagaactgaggcagagacagagcacataagtggacagttacacaattctaacaatgaagcaaggctacaatatttgtcttagcttcaattccatttattttgctccaacgatctatctatacacagctgaaaattagtgataacattgtctcttatctgttttgtgctgctataacaaaatgccacagactgggtaatttataacaaacagaaatgtatttctcacacttctggaggctgggaagttcaagatcaggtgctaacatctcgtgtctggtgagggcctatcatgcttcctcacatagcagaagagcaaaaaaagagcaaacccactacacgaaccctttttatagcagcactaaacacctcccattaggccacacctcccagcagtgttgcattagggattaagtttcaacatgcatattggagggaacaaaaacattcaaaccatagcacattggtttaaaaccaatataccagaacttaagcatgtgtatcatctctttgaagtaattgaacaattattcaaagacacttggaaactgcctacataacctgtggcgcatattcaaatttacttggttgggaatagccaaccaagtaaaccaaacatcacttagagccaaatgaagtgaatatgatgagtgatagactgggtgcagtggctcacacctgtaatcccagcactttgggaggctgaggcaggtggattgcttgaggccaggagtttgagaccagcctggccaaagtggcaaaaccccatctccacaaaaaatacaaaaattagccaggcgtgatagtatgcacctgtagtcccagctaattgggaggctgaggcaggagaatcatttgaacctgggaggtagaggttgcagtgagccgagactgtgctactgcattccagcctgggtgacaaagtgagactctgcctcaggaaaaaaaaaaaaaaaagagtgatagacctggtccataaattttgagttaaaaatgaagtatgattattaagaaatgagattggttttcttgaggtcctcataattggctctggagttttttgtttgtttttgttttgttttgtttttgacgtagtttcgctcttgttgcccaggctggagtgcaatattttactccttccccttgttatctttgtttagactgatgagcttctctgtgcaagggtgcctttttggagcaatgtccccattcggtccattgatatgaaccacttcattgaatgtcttagacggtaagtagtaacagctgctgtgcttgcttgtcaaaaggaaatttttcagagcctggacttttgtaatatatggcttctttctgttttctatagctaccaggagaaagtaatctttctctggagccatcccagaatgtagatcaaattacatcagaatacatagacattgacttactggttagtcaatcacataatcaatgtgaaaaaaatgatactgtgcatttttgtaccacacattttacttcttctgtgttcattcaaatatggtattgcattcagaccatctaccaattatctgaagggcagtaaggtagacatttctatccccatgtgaaagacaagaacacaggttcggaatgattacataaattacctagggttagatagttattattttattattatatagatattagatagttattcttttcttggttgtaaaaaagatttagaagcctagagactagttaaaatatttttttttcaggagctaagacgaatatacaatataggtaaaacacacttgaagctcaataaaacaaaccaaccacataacaaaagaggggaaccctttgtagataactgacaaatgtgaaagtgttattgttcatctatttattaaatcaatgaaaatttatttttataaaatgaatcaggctttcagccctgattcttgcccagagtttgaaggtgagccaggctctgtcacattatgataatcagtttctttgactaaaacatgacgagggacagagagaatgatacttgctttacttactcccttggggtactgtgaagagctttgccagttgtagagatctacacacaggtaaagacttaattaactcaacaaatgtttattgagtgcctaccgtgtataatgcacaaagggaaatattcatctgccttcaagaaactagtagcctgctacagcaagaataaaatgtataaaaatgagaaatgtgaggtagaaaatcctaagtgccaaaatagaggtaacatctctgaaaatattacagttactacatttctgaaaataagtaggtggttactggaattgatcaataaaatgattacaactataaaaatgatctttttaggcatgcagctttagcatcccatttgctttattcccagtacttaattaaatcattttcacttgacaaacatttattgagcaactactatgagctggtccctgtcctaggagctggagataaagttaaaaatgcatgtccttgctctcaatgaacttatggtttagtaaggagaaacaaacatgcacaataatgataaaaatttacaggtgcagtgggggatagcataagataagcagtggttagttctagctgatggtggagtgagcaaggatctgggaaacttcatggagaaggttgtgttcagtcttgaaggagagggaggactccctgaagcaggcaagaggcaaggagccatggatatctctggcagagcgaagggcatgaatacaaacacaaaggtgcaaagagcctgggagtgagggcaactgtaagtggtttccgttggcactattgaagtaggctgagggaagagaagtgcaacggaaaatatgaggcacttgttgatttctttacaactttgcccagattcaggcctataaccatccttcaatctgaattccttttgttttatgtaatagcttcaagtctgaatgatatggtttggttctgtgtcccaacccaaatctcatattgaattgttatccccacgtgttgagggagggaagtgattggattatggggcaatttcccccctgctgttctcgtgctagtgagtgagttctcatgaggtctgatggttttataaatggtagttttcctgtactcactcacgctctctctctgccaacatgtaagatgtgcctgcttccccttccgctatgattgtaagtttcctgaggcctcctcagccatgcagaactgtgagtcaattaaacttctttcctttataaattacccagtcttgggtatttctttacagcagtgtgagaacagacttatacactcacccacacacagttgaaaacacctgcatttgaaaaacaaacaaacaaacaacaacaaaaaaagcaaaaaaagttttgtttccaaaatgtattacaagtattttccatgtgaacatggtgcggaatggcacaactggacttggggtagtgcattactctctactgcatattcatccaagctggttaaaggctttctgtgtgaacttcttttcttctaggaaaaaaggagtctgaaaatttttaattaaccattcaggtttctagagctctgaaacagttgttagctcactaaatattagtattattctaaaatgtttttcaactaaagtctgcattttctgtgtttccattccttttttccctcactctgtggcttcacttgctatattgctttcaagtttggcgagaatggatcctttcccttttactgtgggccagctattctgtgttagagctcaccggaataaatgcttggtgcccctaagaagccatgttcatgctcttttgtgatatactccccaatcaaaattggaggcctgcctgtatctgctgttgactacaggctatcttgcatgagtatcattcctgccttttgaacaggagctagtctagcgcaatagtcatttgccataggggaattccattacctttccttaccaggaggatggattctgtctggtgtttacactgaagatgggggaaatttaattaaattctttcaagtgctagatttacttacactatcaatttactgctaaaaccgccattctcattttggagaatgagaataggaccatatgtcttaaacttatcaactgtcagcacttccagtaatagttttctgcttagaatcaaagaaagatttgggtttttgagttcccaaagccctctagttagaaccttgtggacctcatgatttggaactgaatttactatacatttttgcccactggaatgagttttgcaataaatctagtatcttatttggaaaatgtcttggggtaaagtttggcagcttcttcaaagagtagttcattcctcccataattgcctggtgaagactatgcagaaattagattaaacaacaccactgccaataaatcatccaggtgtttggccaaataacaaaatactggactatggggaaagctagtgaaagctaggataagtacacacaataattggcataaaaataaatcagtataaagagaaacagggtaaaaatttcagatgccagagataaggcattcttaatcctgtccaaaaattgatattatgggaaaactccccttgagtttcagtttagttcactatttgaaggtggaaaagaaatacatatggatttggttgggaatttgtttacaaaatgtttgacacttggataaaagctgaaaaaaatctatcaaaaatctaatgggacatgaaacctgttctcaagtagcttataacatagttgaaaagataagacttccacacttggcatcattaaagcttgcaatgatgagtgaaatgcatataacttagtgtaaacctgcatgatacagacacgcatcaaaagctatggaaattcaggaaaagaatcaaaggattaatgaggagctcaagtcttaggaaaagcttcatgaggtatgtgtgatttatgtagactcagaggctaggcacagtttggctgcacagaagggagagagaatgagatattctgattgaaaagggggaagaaaaagagcaaaagcatgagagatggaatgaaattggtgggcagaaggcaaagaaaaggtcagactacctagggtagagtatgtgacaaggctggcatggctgggtagactcagacttggcaatgcaggctttagaagttagtttgagttccagaggcaaagagccatcaggatccattgagcagcatagtgacatgatgaatgcagtgttatgggaaaattagaccaggatttatgggattacctatggccatccagatggcaaacacaccagttgcaaagattcttacttgccggtacaatgaatgtgaagggaaagaggctgaaggctggcatgaaatcaggctatgatggaggctcagatcaaccagaatgaattcagatggagggtacagatagtttccactggcatatgagagaggtgagatgaaatattctgatatagagtacccaaaagaaactaagagggtaaaagaaactaaggagaattagagagctggaatagtgaaggtccattattatctagcccctgcctctgactccaacttaattttcttttttttaattttattattattatactttaaggtttagggtacatgtgtacaatgtgcaggtttgttacatatgtatacatgtgccatgttggtgtgctgcacccattaactcgtcatttagcatgaggtatatctcctaatgttatccctccccctccccctacctcacaacagtccccggtgtgtgatgttccccttcctgtgtccatgtgttctcattgttcaatgccttcctatgagtgagaacatgcagtgtttggttttttgttcttgcgatagtttgctgagaatgatggtttccagcttcatccatgtccctacaaaggacatgagctcataattttttatggctgcatagtattccgtggtgtatatgtgccacattgtcttaattcagtctattattgttcgacatttgggttggttgcaagtcattgctattgtgaatactgccgcaataaacatacgtgtgtgtgtgtctttatagcagcatgatttgtaatcctttgggtatatacccagtaatgggatggctgggtcaaatggtatttctagttctagatccctgaggaatcaccgcactgacttccacaatggttgaactagtttacagtcccaccaacagtgtaaaggtgttcctatttccccacatcctctccagcacctgttgtttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgttttttcttgtaaatttgagttcattgtagattctggatattagtcctttgtcagatacgtaggttgcaaaaattttctcccattctgtaggttgccttttcattctgatggtggtttgttttgctgtacagaggctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaaggctttaatccatcttgaattaatttttgtataaggtgtaaggaagggatccagtttcagctttctacatatggctagccagttttcccaacaccatttattaaatagggaatcctttccccatttcttgtttttgtcaggtttctcaaagatcagataattgtagataagcggcattatttctgaggactctgttctgttccattggtctatatctctgttttggtactagtaccatgctgttttggttactgtagccttgtagtatagtttgaagtcaggtagcataatgcctccagctttgttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttcacgataatgattcttcctacccatgagcatggaatgttcttccatttgtttgtatcctcttttatttcattgagcagtggtttgtagttctccttgaagaggtccttcacatcctttgtaagttggattcctaggtattttattctctttgaagcaattgtgaatgggagttcactcatgatttggctctctgtttgtctgttattggtgtataggaatgcttgtgatttttgcaaattgattttgtatcctgagactttgctgaagttgcttatcagcttaaggagattttaggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagaaggcatccctgtcttgtgccacttttcaaagggaatgcttccagtttttgcccattcagtatgatattggctgtgggtttgtcatagatagctcttattattttgagatacgtcccatcaatacctaatttattgagagtttttagcatgaagggttgttgaattttatcaaaggctttttctgcatctattgagataatcatatgttttttgtctttggctctgtttatatgctggattacacttattgattttcatatgttgaaccagccttgcatcccagggatgaagtccacttgatcattgtgggtaagctttttgatgtgttgctggattcggtttgccagcattttattgaggatttttacatcaatgttcatcaaggatatttgtctaaaattctccttttttgttgtgtctttgccaggctttggtatcaggatgatgctggcctcataaaatgagttagggaggattccctctttttctattgattggaatagtttcagaaggaatggtaccagctcctccttgtacctctggtagaattcagctgtgaatccatctggtcctggactttttttggttggtaagccattaattattgcctcaatttcagagcctgttattggtctattcagagattcaacttcttcctggtttagtcttgggagagtgtatgtgtcgaggaatttatccatttcttctaggttttctagtttatttgtgtagaggtgtttatagtgttctctgatggtagtttgtatttctgtgggatcggtggtgatatcccttttgtcattttttattgcgtctatttgattcttctctcttttcttctttattagtcttgctagcggtctatcaattttgttgatcttttcagaaaaccagctcctggattcattgattttttgaagggttttttgtgtctctatttccttcagttctgctctgatcttagttatttcttgccttctgctagcttttgaatgtgtttgctcttgcttccctagttcttttaattgtgatgttagggtgtcaattttggatctttcttgctttctcttgtgggcatttagtgctttaaatttccctctacacactgctttgaatgtgtcccagagattctggtatgttgtgtctttgttctggttggtttcaaagagcatctttatttctgccttcatttcgttatgtacccagtagtcattgaggagcaggttgttcagtttccatgtagttgagcggttttgagtgagtttcttaatcctgagttctagtttgatggcactttcgtctgagagacagtttgttgtaatttctgttcttttacatttgctgaggagtgctttacttccaactatgtggtcaattttggaataggtgtggtgtggtgctgaaaagaatgtatattctgttgatttggtgtggagagttctgtagatgtctattaggtccacttggtgcagagctgagttcacttcctggatatccttgttaactttctgtcttattgatctgtctaatgttgacagtggggtgctaaagtctcccattattattgtgtggaagtctaagtctgtaggtcactaacgacttgatttatgaatctgggtgctactgtattgggtgcatataaatttaggatagttagttcttgttgaattgatccctttaccattatgtaatggccttctttgtctcttttgatctttttggttgaaagtctgttttgtcagagactaggattgcaacccctgcctttttttgttttccatttgcttggtagatcttcctccatccctttattttgagcctatgtgtgtctctgcatgtgagatgggtttcctgaatacagcacactgatgggtcttgaaggtttatccaatttgccagtctgtgtcttttaattagagcatttagcccatttacttttaaggttaattttgttaagtgtgaatttgatcctgtcattatgatgttagctggttattttgctcgttagttgatgcagtttcttcctagccttgatggtctttacaatttggcatgtttttgcaggggctggtaccggttgttcctttccatgtttagtgcttccttcaggagctcttgtagggcaggcctggtggtgacaaaatctctcagcatttgcttgtctgtaaagtattttatttctccttcacttatgaagcttagtttggctggatatgaaattctgggttgaaaattcttttctttaagaatgttgaatcttggcccccactctcttctggcttgtagagtttctgctgagagatcagctgttagtctgattggcttccctttgtgggtaacccaacctttctctctggctgcccttaacattttttccttcatttcaactttggtgaatctgacaattatgtgtcttggagttgctgttctctaggaatatttttgtggtgttctctgtgtttcctgaatttgaatgttggcctgccttgctagattggggaagttctcctggataatatcctgcagagtgttttccaacttggttccattctccccgtcactttcaggtacagcaatcagatgtagatttggtcttttcacatagtcccatatttcttggaggctttgtttgtttctttttattcttttttctctaaacttctcttcacgcttcatttcattcatttcgtcttccatcgctgatgccctttcttctagttgatcgcatcggttactgaggcttgtgcatttgtcacgtagttctcgtgccgtggttttcagctccatcaggtcctttaaggacttctctgcattggttattctagttatccattcgtctaattttttttcaaagtttttaacttctttgccattgtttcgaacttcctcctttaccttgtattagtttgatcttctgaagccttcttctctcaacttgtcaaagtcattctccgtccagctttgttccattgctggtgaggagctgtgttcctttggaggaggagaggcgctctgatttttagagtttctggtttttctactctgttttttccccatctttgtggttttatctacctttggcctttgatgatggtgacgtacagatgggtttttggtgtggatgtcctttctgtttgttagttttccttctaaaagtcaggaccctcagctgcaggtctgttggagtttgctggaggtccactccagaccctgtttgcctgggtatcagcagtggtggttccagaacagcggatattggtgaactgcaaatgttgctgcctgatcgttcctctggaagttttgtctcagaggagtacccggctgtatgaggtgtcagtctgcccctactggggggtgcctccgaattaggctactcaggggtcagggacccacttgaggaggcagtctgcccattctcagatctctagctgcatgctgggagaaccactactctcttcaaagctgtcagacagggatatttaagtctgcagaggttactgctgtcttttgtttgtctgtgccctgcccccagcggtggagcctacagaggcaggcagtcctccttgagctgtggtgggctccacccagttagaacttcccagctgctttgtttacctactcaagcttgggcaatggcggccgcccctcccccagcctcattgctgccttgcagcgtgatctcaaactgctgtgctagcaatgagtgaggctccgtgggcataggaccctccaagccaggtgcgggatataatctcctggtgtgccgtttgttgagcccgttggaaaagcgcagtattagggtgggagtgacctgattttccaggtgccgtctgtcacccctttctttgactagaaaagggaattccctgaccccttgcgcttcccgggtgaggggatgcctcgtcctgcttcggctcacgcacggtgagctgcacccactctcctgcccccactgtccggcactccccagtgagatgaacccggtacctcagttggaaatgcagaaatcacccatcttctcgtcgctcatgctgggagctgtaggctggagctgttcctattcagccatcttggctcccccaacttaattttcatgtatgctccattcatagggaactgcctgtggttccttgaaatcaatgttttctcatctttcgaggctttttcccagaacaccctttctctaatttttttccttgcatttgttgtaagcagaatggccctccaaagatatccaggctctaatctctggaatctgtggatatgctgcattacacagcaaaagggactttgcagatgtaattaaggttaaagtcttcaaagtaagggagattatcctggattttccatatgggcccaatttaatcacatgaagccttaaaggcatagagctttctctggttggagtcagagagatgtggctggagaaatcagatttgaagtgtgagagaaactcaaatctgtttctgaaattgagaggcacatggaaatcatgagaaggaacaaaagtagcctctaggagcaaagactggcctctgactgacagcgagggaatgagggacttcagtactaaaacttcaagggactagatttggtgaacaacctaaaatgagcttggaagtagattcttcccagaactctagaaaggaatgcagctgctggacaacttgattttgatcttgtgaggctcatagcataggaaccatccaaaccatactgtaggcagacttttaacataaagaactgtgagataataaatggatgttattttaaggcacaaattttgtggaaattgttatggcagccattgaaaatgaatgcatcatcctttaacactcagctccaaagtcatgcttctgggaaggctttcttaatcacagcagccaataattattgttcagtagggcttaggagcagtgtggtggccatagccactggagatgcaaataaatactaaaaggagactgaagggttagaaggaaatatcaataatagacaagctgattcatcctagaggactttggagaaggtcagaaattgcaggcattaagttctgccccactaatggaatataacttccaatgcactgtctagttcactcttaagcaggaatggatagccaaagatcaccagttatttgaaggaaaactccaatttgaaaaagagagaccaaaacaaagatgaagaaagaaaacaaatataaacaatgttaggtgtggccgacaaatacgtgaagaaaagctcatcatctctaatcattacataaatgcgaatcagaaccccaatgagacagcatcttatatcagtcagaatggctattaaagtgtcaaaaaacaacagatgctggcaaagttgcagagaataggaaaacttatacactggtagtgtgaatgtaaattagttcagccactgtggaaagcagcatggagatttctcaaagcagtgtggagatttctgtttaaaacaaaactgtcattcaacccagaaatcccattactgtgtgtatagccaaaggaaaataaatcattctaccaaaaagacacatgtacatgtatgttcactgcaatactactcaccatagcaaagacatggaatcatcctaggtgtccatcaacagtggattggataaagaaaatgtgccacataaataatagacacatagaacaatggaacaggatggagagcccagaaaatatgccacacacctacaacaatctgatatttggcaaagctgacaaaaacaagcaatggggaaagaactccctattcaataaatggtgctggggtaactgactagctatatgcagataattgaaactggacccccttccttacaccatacacaaaaatcaacttgaaatggattaaagacttaaatgtaaaacctaaaaatataaaaatcctggaagaccatctagaaagtaccattctggacataggaactggcaaagatttcatgacgaaaatgccaagaacaattgcaataaaagcaaaaattgacaagtggaatctaattaaactaaacagcttctgcacagcaaaagaaactatcaacagaataaacagacaatctacagagtaggagaaaatatttgcaaactgtccatctgacaaaggtataatatccagaatctgaaaggaatttaaacaaatttgtaagcaaaaaacaaacgaccccactaaaaagtaggcaaaggacatgaacagacacttttcaaaagaagacatacatatggccaacaagcatatgacaaaatgctcaacatcattaatcattagagaaatgcaaatcaaaaccacagtaagataccatctcacatcagtcaaatggttattattaaaaaataaataacatgctggcgagttgcagagaaaaggaaacacttatacactcttggcaggagtgtaaattaattcagccattgtggaaagcaatgtggtgattcctcaaagagctaaagacagaactgccattcaacccagcaatccctttattggcatatacccaaaggaatataaatctaccataaagacacatgcacatgtatgttcattgcaatactattcacaataacaatgacatggaatcaacttaaataccaataaatggtagattggatagagaaaatgtggtacatatacaccatggaatactacagagccataaaaaggaatgagatcatgcctttacagcaacatagatggagctggagaccattatccttagcaaactaatggaagaacagaaaaccaaatactacatgttctcacttgtaaaggggagcccaataatgagaacatatgaacatgaagaggggaacaaaagacactgcagcctacttgaggacggagggtgggaggagggagaggatcagaaaaaatacctgttgaatacgtggcttagaacctgagtgatgaaataaactgtacaccaaactcctgtaacacacaagttcatctatataacaaacctgcacatgtaaccctcaacctaaaataaaagttaaaagaaaaaaagaagaaaatatggtacatatacaccacggaatactatgcagccatgaaaagaatgaaatcatgtcttttgcagcaacatggttgcagatggaggccattatcctaagcgaattaacgcaggaatagaaaaccaaataccatgagttctcacttataagtgggaactaaacactgaatacacatggacacaaagatgggaacaatagacactggggactgtttggtgggggagaggaggaggggagtatgagatgcaaagccacctattgggtactatgctcagtacctgggtgatgagatcatttgtacaccaagcctcagtaacatgcaatttacccatttaacaaataggcaaataaatgtaccctccagaacctaaagcaaaaggagaaaaaagcctgtaatcccagcactttgggaggctgaggcaggaggatcacctgagctcaggagtttgagaccagtctgggcaacatagggagaccccatctatacaaaaaattaaaacttagccaggcatggtggtgcatgcctgtagtcccaggaggctgaggtgggaggattgcctgaatcctgccagtcgagactgcagtgatacatgatagtgccactgccctccaacttggacaacagagtgagacctcatctctaaaaataaaaggaaaaagttctgagaaagtgattattttcacccatgaattttatcctcagctaagctatcaatcaaatcagagggtagaataaaaacattttcagatatgcaaagtctcaaaaatgttacctaccatgcatccttattcaggaggtggtgctcaaccaaaacaacgatggaaaccatgggagagattcacaaaacagggtgctatccaggagacttgggacaggaatgtgcaagacgacagctgtgcagcaagctcagaaagcaaacagttcagactggagcagaccagagggcccaaagggggacatttctaggggaaatccccctaaacccaaacaaacaaaacaatagccaaacagagaatctaaaagctttgcttatgtgaccatgtgaacattttgctgaggcatttgacaagactgttggcaagtataggaagatttggttacaggttcaaataaactatgcaaaggaaaaagtgaatcgtgtaaattatttacttttattttattttacttttagaaacagagtctcactctatcactcaggctggagtgtagtggtgcgattatagctcactgtaaccttgtattcctgggttcaagtgatccttccacctcagcttccctagtagctgggagtacaggcatgccccaccacactggctaattaaaaaaaaaaatgttgtgtatgtggagacagggtcccgctatgctgcccaggctggtctcaaactcctggtctcaagtgatccttctgcttctgccttccaaagtgctgggattatgggcatgagccacggtgcccagccagtcattatcttttttaaaaacagaaatggtacaaaaaatgttatcacagtatacttcttggttcagtagtgaacaatattagcatagtcataatgatgcaaattttaaaatgtgatatataactctattggtagaacagagaaggggaggggatttgtaagcaaattgactcctcatctaccattacaagatggcaatagattaattataatggatcaaaagacaacaatgcctgcttgttatttaacaatatgaaagtaaatgtcagaagaaacatttaaaaaattgaaagtaagatggggcaagtgtgagggcagagggagaacaaggagacaggagtcttgctttttgttatagcataaaccttttatactagggtaatataacattgtaattcagtatatattatttagttaaaaatcatgatcagtttgaaaaagagtcaatggtggttaaacataaggtagaggttatattcacccccattttctgaactgtctgctcccatacatcctgtggtttcctcctggccataattggagaggaaagagcctgaaaagctctttcacactgagatcttagtctactacaatccagcctgggcaacagagtgagactatgtttctaaaagtaaaaaaatatttatgaaataaaataaaataaaataaaataaaagtaaatgatttaccagattcattttttcctttgcatagtttatttgaacccatgaccctaggcacttaagggtctatcccttcaagaagagggtactggaggtaaaatctacaatttttttaaaaggagtttggagcaggtcaatgctaagcaagaaataatttctaaatatggatatacaggcatttgtacatgttctgaccaaaatggggtttggtggtttggttttaatgggtgggcaggtgacatactttctttctttcttttttttttttttttttgagacagagtcttgttctgtcacccaggctggagtgcagtggcgcaatctcggctcactgcaagctcctcctcccaggttcacgccattatcctgcctcagcctcccaagtagctgggactacaggtgcccaccatcacaccggctaattttttttttttttgtatttttagtggagacagggtttcaccgtgttagccaggatgatctccatctcctgacctcgtgatccgcctgtctcggcctcccaaagtgctgggattacaggcatgagccactgcgtctggccacaggtgacatactttctagtggggaagctttcactttgttctcaaatagagcaatgtaataaaaccaaacatttgtattgcatttataaagtactttcacctaggtcatcttatctgagtcccataaggccaaggtcatccagctaatgcatgaacaaagatggagcagcactaggatcccagaccggctgccagggatcccagcctctgtaccacttcattgaagtgccctcactgtccttagaagaatcactcagccagcaaactagtgatgcacatgccccagctcctcccagtatccctccaccaacttgccctgctcactgcctcttttctttctaagccctaaacaaaagtaagcaaaggaaaggcagggacatcagaaaaaggaaggcaaacagatgaggttaggtggagaagcagagaaggtaaagtaatccccaggtccctttctgcttggtgactggaatcacaaacatggcacctgtgtacactcaacgctcatctcatcagattcacagacctgaatccttttcactgctaacactcaaggcagaagaagataggcattaaggatcacgtgtactgacagaaacacacaaggaagggcataatcattgccccttgatagcaaaccaaccaaagtgcaaatgtagtagtcttctcacagagtgtatcagccttcccagcaagaaactaaaaattccatgcagggtctgccccatcagggattctctgattgccttcaaccacacacctggcaagttggaggtcatcctgaacaatgtcccaatcagcatctcaagaaaacctgccaatcctagcctggagcctgggaagtttccccactatgggaatattgggagaaactgagcttgagaggtgaaaagaaatgagtgatgagaactttgctccaaagttctttaaggggtggcccctgggaatgcccagagacccactgttttggtcagccttgggaatctaatgtgttaatctttgccccactagtggctgcattttcacaagcaggcctccctgtcaagctagggcagagactgatggtgcctgaagcctgaacagtagggatgtccctgctgcatttcttcttttccccaatagcttatccctccccgtgttccactttgtgaccaatggaggaggccatggatcccagattactccttccctccatcttgagaaaacaaagggatcaatggaaacaaatacattgaagcgttaagaagaatctcagaagccttgcattttaacagaggcatgagagagcaaatctttacccagaactcaggacaatgacagcctatggctgccctcaaacctatagaaattgagagctagcagaaccactggaaatcacctgtctgcatcctcattttacagaaggcgaaactgaggtccacatagctgaagggatttgctcatcatccttaaggagttagtggcagagaaccaaattcccttgccagcaggccaagattctttgcagttaaccacaccatctttaactcatagttcaaaacaaattccttagaaacaaactgttggagaacagttcattcataagacagggtttggtagcaatgtacacttttctgtcttctatgtagaaacgaactcttggagaccagttcattcataaggcagagcttgatagcactgtatatttttctgtcttctatgtaaactatcaggaagttcattcattaagtaaagtagtaagtgaatgtgtagtatcagatatggggaattggccgggcctggtggctcatgcctgtaatccgagcactttaggaggccaagtttgggtggatcacttgaggctaggggtgtgagaccagcctggccaacatggcaaaaccctgtctctactaaaaatacaaaaattagctgggcttggtggcagacgcctgtaatcccagcttcttgggaggctgaggcacaagaattgcttgaacccgggaggcagaagttgcagtgagctgagattgtgtcactgcactccagcctgggctacagagcaagactctgtctcaaaaaaataaaaataaatttaaaaaaagatacggggaattcagagaccttggaggagttcataatctaatggaggagaaaatgtagaaaggatgattaaaatgcagtgtgattattgttggataaggtgataaatcagagttgttgagattctgtaagtgcatggaggaggggcacctcatcctatctgaagaagacgtcatagaaggtttttcagagtagctggtgtccaaatcaagtcctaaaagtgatgggacaagaataatgaacaattcagatagggtataactgtaaagaaactcactctccagttaggaggatagataaataaaaaccctctgtgctaagggctggcagaaaggtaaactcagggatctttgggaacacagaaaaggaattactattggacataggggcagggaatggggtggccgggtcacctttacaatggtgatgacgcctgagtttggtcttcattagcactgaccaaggtggcttgatagaaggctgaagacagactatgggcccgagtatacagaaaactatcccctgtgttatgagtgaaggacaacatactgtgtattagggttcagactaaatttctgttaatagagattcaaacaggatagaaatttctctttgtctcatgcaacaaatagagggagaacaggtaggctgctttgctccaaacgatcttccagagatcttttactaccttttgtagtgccatcatcacctagaatattgtcctagtctgcacagtcaaaactagttcattaccactatgttagtgttttagcctctagggggaaaggggaaaaaaagaagtgcaggacaaaacatttccttttaaggaagcaactcagaggttgcaggcatcactttcacatatgaacacagtgacatgaccacacatagctgcaagggaggttgggaaaagtagtctctattctagccaggttccttactaagtcttagggatttatgttactaaaagaaataaatagaaggaatggacagtgggtggtggggggaagtaacagtatctaacacatgctaatttgtttccccatgtacagggaaaggcagttttagagaggaaatagttaaatgatagactgcagagggtcttagccatggacagttaaagagttgcagtgtctcaaggttgctggtttgggtaatggacaagctaagagtatgtccaagcgttctgaattggcgacccccccaaaaacttagcaggccaggacaaaaagatacaatccttgataggagtgtcccagatagagttactgctgtctttaagctgtgttgctcaggcctctactcaattctactttgcctgacttgaagatgtcaggctagtctctctgcctgttctttaggaagaacatcttcaccagatagagaagtctgacagggctatctaaatatttctgaaccggtccagatcattgctgtcattctctgaggttggcatgccaagtcctcagcatcagtacaaagacattgctgtacactcacaaccagatagaagcagaggcttgaacaggatcagtccactgagatgaggtataaagcaggggcaggcatagcttcaagcaagtgatcagcacttcttggcttgtaggtggccatcttcaaccagtgctttcacatggtcttccctatgtatctgcctgtatccaagcccccaagcactggaagaggtctgagacctcctggactacagggaacaaggagtcagggtggggaccagagcaggtgcagaggattatgagctatgatattcaggtaaggaagaagggaaggtgactcaaggagcagtaatcccagggcttaagctttatctcagaatgcaggaaagaaagagggtatgcttctatctcagaagacaacttttcccaaaccatgttacttccattgtcctctactctgtgctcaaattagaaaattgagtatcatcctagacttgttcctcatcatcttaacatatcctatttataagtaccaaatgctatctattctatcttctaattttctcttgaaacaattcagttacctccagcccttctaccattactttgtccaattttccaaagccctcctctcctggattactgcaacagctttctcactggcctgcctgactccactcttgctgccctccaacccatctgtcatgtgctaaattgtgccaccttccccaaaatccatgtgttgaagtcctaactcatgatagctcagaatgtgactgtatttaaagatagagtctttagagaggtaactaagttaaaataatgtcattaggatgggcccaaatccaatatgatggtgtccttacaagagaaaatttagatacaggcagatacatagggaagaccgtgtgaaggcactggttgaagatggccacctacaagccaagaagggaggcctcagaagaaaagagcaccaataccttggtgtcaaacttccaggctccataattgtgagaaaataaatttctattatttaaaccactcacttgattttggggtactttgttatggaagctcaagaaaattaacacatcatcctttacactgcctacaaaatgactcattaattacaaagttgatcatgtcactcctctggttaaaactgagacaaatgggacaaatgggattccatcaaactaaaaagctcctgcacagcaaaggaaacaatcaacagagtcaaacgacaacccacacaatgggagaaaatatttgcaaactatacacctgataagaggttaatatccaaaataaataaggagctcaaacaactcaacagcaagaaaacaaataacccaataaaaatgggcaacagacctgaacaaacatttctcaaaagaagacatacaaatggctaataggcatatgaaaaaatatgtcaacattgctaaccatcaaggaaatgctaatcaaaaccacaaataaaatattacctcataccttttagaatggctattattgaaaagatatagaataagtgttggagaggatgtagagaaaagagaattgttgtgcactgttggtggagatgccaattggtacacccattatgtaaaacagtatagaaggtcttcaaaaaattaaaagtagaactacaatgtgatccagcaatcccactactggatatatatccaaaggaaataaaatcagtatgttgaagagatacctacactcccatgttcattgcaacagtattcataatggtcaagatatagaatgaacctaagtgctgatcgaagaatgaatggataaagaaaatgtggtgtacacacacacacacacaatggaatactattcagtatttaaagcagggaatttgcaacaacatagatgagcctggaagtcattgtgttaaattaaattagctaggcagagaaaaacaaactacatgatcttgcttacatgggaaattgaaaaaagtcaaactcatagaagcagagagtagaatgatggttgtcgggggctgggggttagagatattggtcaaacaatacaaagtgtcagttatgcagactgaataagttctgcagatctaattatgtcatagtgagtacagttaataatactgtattatatacttgaatatgctaagtgagtatattgtaaatgttcttactgcaaaaaaaaaaaaaaaacatacatgctgtggctcatgcctgtaatcccagccatttgggaggctgaggcaggaggatcactgaagcccaggagttcgagaccagcctaggcaacatggtgaaaccccgtctccataaaaaataaaaaatgaggcaggaggattgcttgagcccaggaggtcgaggctgcagtgagctgtaatagcaccactgcactccagcctgggtgacagagcaagcaagaccctgcctcaaaaaaaaaaaaaaaaaaaaaaagacatacaataaaataattaactctatgaggtgatgaatatgttaattagcttcattgtggtaatcatttcacaagatatacatataccaaaaataactcaatcagcctggtacagtggctcttgcctgtaatcccagcactttaggagtctgagatgggaggatcacttgaggccaggagtttgagaccaacctggtcaacatagtgagaccctatcccttaaaaataaaagaaaaaagaaactcaataaagctgaaaaaagaaacttaaagctataagaaagctccccctaaagctccctcaatgggcttctgctttcagtcctactaagaataactagaaaatggttgtttaaaatttttaaaagtctctgtaaaggcatagaaagctgctgaagcaatcagcattggaggggccaagatttcaaagaaggttgaaccactgaaaggagagctacattttccccgtgggctttggcaagtttggggtgtatagttagagattgagaatctgggctttggccagacagagggccactgctggggaatacgggaaaaacagaacttttgatggttattgagggctgggttgagaggccaagaccccagtgaaagggaaaggaaaaaaaaaagaatatgacacatgtcgagtgttttttgatgagactaagaagctaagcaggaagcctcgagaaacagtagcattttgggcagtctcactatgctgagtaatgtaaggatttgattttaatatctgccaggaataagagccccattgaacacacaagattatcagatgatagctctgaaaggtaatgccttaggagcagggaccaggggctttaccaacattgaacctgaccttgattcagcttagtcactgatttggtaaaggtgatctgcccctacttgatctgcctaacagagaaaacagtaaattctctctgagggaagatagcatcatctggagccttttaaattatttatacacaattggatggcattcattgaaaactttctaggaaatataagagatgaggccatatgactgaaaacctagaaggaaaaaaacagacaataggaaaaaacccatgggtgatccgaatatataagttagcagacaatgcatttctaacaactatatattcagataatagaggaaagatggtgaaaagaaatataaaaaaggaaaatttaatccaataattggaatctataagtaatcaaatagaaattctaaagttagaaaaaaaccctaaaatctcaatagatgtgtttaatggatgattgtacacaacagaatagaggattagtaaactagaagacacgttagagtaaagtatttaaactgaagcacatagagaattaactaatagaaaagtaagagtataatagacaggtgagatataaataaaaggtttaacatagttttaattggagttccagaataaaaagggaggaagggaaaatgagcagtgacgatatatgaagacaccgtgaattttccaaatctgatgaaaggcatcaactcacagattcaagaaggtctgtcaaccccaagaaggataagtgcaaagaaaatacacctaggcccatcataataagacttttgtaaacaaagaaaaggagaaaaatcataaaggcatccaggagaaaagaaacattgtagttggctgaataatggccacccaataatatcagatcctaatcctggaacatgtgagtgttaccttataaggtaagagtttttgcagatatgattatgttaaggatctgaaaaatggagaaattgttctgaattatctaggtgggtcccaaatccaatcacaagtgtccttataaaagggaggcagaaggagatttctcatacacacaacaaaacaacaacaacaacaacacacacacacacacacgagaaggtgatgtgatgacagaggcagtgaatggagtgatgcagctgcaagcaaaagaactccaaggcattctggcagtcagcggaagatagaagagacaaagaacggattctcctttagagtttccagagggagaataaagttgccaacatcatttatacagacttctggcatacaaaactgtgagagaatacatttctgttgttttaggcccccaagttgtagtaatttggtacagcaaccacaggaaactaatacaataatgacaagaatgacatttgatttaacagcaattttggaagataaagaatagaatcctcacaaccatcctatgaaatgaatcctccaccatttccgcattaagtttagaaaactgaggctcggagactcaagtgacttatccaaggatcacatggcggagacgggattcaaggtcaggcccgtcttattcaaaatactatttttttttaaacgtactcaccatcgtatatagcttttcatactccttggcatggtatataatccttctgggtttggttccttcctgcctcttctgtcttatctctcaccacatcttctttcagactctgtagcctatcattgctgaactccctgggattcctggtgtctttgctctctgcttggaattttctttccataccctacttccacacaccatcacttggctaactccaacttgttcttggaattcagcttaaatgagaactttcactcagaacgcctttctctatgcttcaagatttagttagatgtctctctgtcctcccacaatctcctattttcatctttatcacaatgccaatcttccttattagactggaagctccttgaggccaggggtcatgcccagaatgatacttggtacagagtgggcactcagtaattgctgaatgagtgatacatggcttttcagaattgtggtggtggaaagcactgagttttaagccacatttgtctgataattagaataagggtaaatttgtagttggagggatatttggaacagcatgaggtatgtctgggataggtggtgattttaccttattactttccccttgtgtcacaagcctccatggagcttgctctagtttcttcaggtggttaggtagaacatgctcccatcctggtcctgttacaggcgcacagagaatttaaatttaattttttttaaatcctaagttatgaagaactcttgggttgaattatcacttggtgcccaataccatgcagactcattactctcccttccagttgtacatacgtgactgcaaactccaaatattgtgaccatagttttcccgctaaatttggacagttggttggggtcagcttccaaagctcatatatgtgtcagagatacaaagacataagaagtgattataaaatacaggatcgggaaaaagttaaataaacctttgctggtactccaaacctgagtttcttcagccaaaactacagtaggaaagataatgtggttccttgaggaagtgccacaggcagtagaatgttagagcaagtagaatatcaggttgctcttttcaatacctagtctccacagatggccctcaataagccactcttcctgctctttgcaacctagtgttgtctctctccacattgactctagggtggcctgcgactgtcaataacaaatataatgcaacagaaatgaagttgtgagagttctaatcctattatttaagaggactgacagttttcactccctgtcttttatgacaggggtccccaaccccaggccatagactcagggtgagccatgggcaggcaagcattgccacctgagctttgcgttctgtcagatcagtgggcagcattagattctcatacgagcttgaaccctattgtgaactgcacatgtgagggatctagtaggttgtgtgcttttccttttttttttttttttttttttgagatggagtcttgctctgtcacccaggctggagtgcagtggcataatctcagctcattgaaacctctgcctcctgggttcaagtgattcttctgcctcaccctcccgaggagctgggactacaggcatgcgccaccacacctggctaatttttgtatttttagtagagatggggtttcaccatattggccaggctagtctcgaactcctgacctcatgatgcatctgcctcggcctcccaaagtgctgggattacaggcatgagccaccaggcccagctggttgtatgctctttatgagaatctaactaatgcctgatgatctcaggtgaaacagtttcatcccaaaaccatccccccaaccccccctccccctaccccatgccatggaaaaattgtcttccacaaaacgggtccctggtgccaaaaaggttggggactactgttcctttcttggcaccagggaccccggttttgtggaagacacttagacaatttttcaatggacaggatggagtgagggtggggatggtttcaggataaaactgttccacctcagatcatcaggtattagattgtcataagcagcgagcaacctagatccctcacatgtgcggttcacaatagttcacaataggactggtgctcctgtgagaatctaatgctgctactgatctgacaggaggcagagctcaggctttaatgctcactggcctgctgctcatgtcctgctgtgctgcctggtttctaagaggccatggactggtatgggtcagcagctcgggggttggggacccctgttttagaacacttgctttgggaagccctgaaagaattctggttcccctgctggagagaccatgtcaagaggagagctcctgagactatatgtaaataaagagagggccagccatctcagattcccagttgagcctctggatgactccaactgccatctaactacactgcctgagtgagatcagcagaagaaatttctggctgagcccagtcaatccacagaatagtgaaacaaaacagatttatgtttagccattaaattttggagtagtttgctaggtgacaatagatcatagaaacactctttttcatgactgcctcataccctacactatgagatagggtaacagaaatctgatttccaaactttcctgaacccacaggccagctttacttgtcagaaacctgttcatctctccatggaaaagacatagctcctgaatcatccacacttctgtgtgaagcaagcctcagtacatcttcctaaaagatagtattccaagtctcttgagttgtgcatgaaaagcttcagtcccagaccttgacatttctggtatcaaaaagcaggtgtgaaaactctttggatgactcataatcaatcatccaaatgggtggcctcctccctctacgtgcctgcctgtccagaagcagataactgctcaatggtattgcctttctagggaaccatatccacccaccaccatcataaacccttagaagtcttggtttcactcaaaaattctcacatatgaatacatgatgtcatcctgaggtttgcatcagactgagttcagattgcatatttttccacaagcatcattctgctgcaaagttagaagatgtattgctgctggctttatttacttatttttgtttccttgacaagagttctgcttcaacaggtcctgtgaaaacattaatttatggctataataatttcgaataatattctggagatagctggtaggcatattatccaagaagaccacttttatatagtgaccttccttgcattgttttatttagaatgcacatctttatttttataaatacagccaactcaattatctaggttaccgaaagggcaaagtggtgcaaataatctaaaacgctggggcgaaggtcatttgtatttgttttgcgaatgtattatagtttatttttccagcagcagcaggtgttcctaattatggttttctttaggctaatactggaattagctgacacactctgagtgtgtgtgtatatatatatatagaatatgatatataaaaaacatgttgggtaactgagcagggagaaccgacccaagactcaagctgtttgatgtacaatttgcctgcaaagtcttaatttttttttttttggtaacttacctgtcagatttcacacattaaatgagaactgttcctcaccttgatgggctgcataccaactctaaagacgccataatttttctgacattctcaaaatttctatttgtgatttacctccttttcctcagtcatgggagaatctgggcttctgtatcagcctgttcattgcaacgtctgtccctgaaggactttgggggctgggaggaatgcactgggatcagaatgagactgcagggcttcagccaccatctgtatctttgactcccaaattcatatccctagcccagacctccctcctgaactcaagtggtgtatacatcttcctatttatctcccccagaatgttccacaggaccttcagctgaactcctcttccttactcctttcagaatctccacctcctcctatgttcattacatcagtggctggtaccattatccatccagtcctcaaactatgaattcaggaatcattcttgccttctccgtctccattcttcctcacattcttcagttcttgctgattttactcccttattttcgcttgtgtctgcttacctgtttccatcctcacttccactcagaccaaacacctatcacctcgtctgttccactaaaacattttttttttttttgtagcccaggctggagtgcagtggcacgatctcagctcactgcaatctctgcctcctaggttcaagcaattctcgtgcctcagtctccagagtagctagggctacaggtgtacatcaccatgcccagataatttttgtatttttagtaaagaggggggtttcaccatgttagccaggctggtctcgaactcctggcctcaagctatctgcccacctcggactcccaaattgctgggattacgggcgtgagccactgcgcccggcctcattcagacacttcataacttgctttcttgcatcaaatcttgctccctgcccccatctatcctccacagagcaaagacacagaagggttgttctgatacctatatctcaagtcactcctgtgcttaaaatcccgaatgtcttctcattgcccttaaggtaaagtgcaaaactgttacctagcctacaaaagtcctgctcaaatatgacccctgccaacagttatgtctcttttcccttgggtctccccactttcctcccttgcttctccccacctcaaccatgctctagttttttctgtcttagcacatgccaggctctctagtctctgggcctttgtggggagctttccctctacagtttcctttcactttcctcttcatctggctaaatcctcctcattcttcagatctggataaaagtgtcaccagctcagaacaattttctctgaccaccccccagacttttaggtctctgtttcatgctctcctagtaccccggacttctttgtagcactcctcagactgtaagtaccacaaggggtcaggacaggcatgtattaattccctgctcaagttgttagcactgtggtggaaacggaataggagatcaataaatattttctaggccaggcacagtggctcatgcctgtaatcccagcactttgggaggctgaggtgagtggatcacctgaggtcaggagttcaagactagcctggccaacacagtgaaaccccatctctactaaaaatacaaaatttagctgggcgtggtggtgggcccctgtaatcccagctactggggaggccgaggctggagaatcacttgaacccagaagggagaggttgcagtgagccaagatcacaccactgcactccagcctgggccacagagtgagactctttctcaaaaataaataaataaatattttctaaatggccgactaaacaatgacctcctaattggtctgccttccttcagggtcttccctcctgacctattttatccactctcagcagagcgatctctaggcctagaatctaaggtacagccccaatcaaatcactttggagcttaaagaaaagtcagttcttgccctcacctaccaaatgaagtctgaaggcttttgtatgacatgacattaaggtgttctgtaatctggtcctaaactacctgaccaaccttatttgtccatcttgttttctgcttagaagaaactccagattctagtcaaatagaattgcatgctatttcctgccagtgcttcacgttttctagcctttgtgcctttacttctggtgatccatcctcctggcaagccctcactgcatttctgcctaagtcccatctctccttcatgatcctccttaaaagtaatgtcctctctgaagcttttgcaattccccctggcagctgaaaatgacccctgctccctctgaacatcccagccctttctacctccctgtggcatcgatcctattatgtgcacgcaaggctcattctctactagactgcaaaccacaagggagaagagcttggtcatttctgtatgactgacaggacttgggcaacactagaggttagggacctgtttggaggcctaccataagttttataactttgtacacaaagtgttttctaaggaccagctgcttagatatcacctgggggcttggtagtaatttacaatcttgagcctaccagatttagcaaatcagaatctgcattttaacaagatccccaggtgatccacatgcacattaaaatttaagaagcagtgcactgttttattacacaaggtaagagcatccgtaaaagaggataaacaccacatcttgtaattctgtgctctcagacatggtatcaactttcatatcagccgcacagtgtgtgtttctctgcttttgaatcaccagcccaatttccttcctgctcttagtttggaaccttccccttcttcaaaaacatggaaggatccctgtcttggtcaagggaaccctttctcctatgagaaagctgtggatgcacaaagctggccccaatcagaaagggaggttatgattccttacagcttgccataatttatgtagtctctggccaaggtgtgagtcaagcctcgtgtcctctgttaaacatcagtgcaagaatgccacggaatgatgtcaagtgagcttttgagctaaccactcctagaaacatctggcgctggcagaggatcatgactatgaatacagaggaagggaacacttgagcaatttgaattaatcacagttttaagtgtcttgtacaaaatgtttttatgttttgatctaaataggcaaacaactaagcaatgctttcctaggttttagaagagaggtaaagatcccattgaaatgacttttttccctctgcactttctctttcctcacatcattcgaacaagaataaccttctcttcttccctagggctcccttaattattaacacagctgtgcatggtgttcagcgcccaccttgtctgtagatgctgataggtcctgtaaaacatattatctcgcttctttacagtacactgcagagaaacttgataattggaaaaaccctcaagttcaggcaaagcagctaaaactagaagtggcagaacctgctgcttttgcctcaggcatatatttgctgctaaatcactgctcctaaaaactcctctcatttgagctccttggcttctaatcagaaccacacccagagtgagacaggagtggtttcagactagcttctgtctgacactgggaaagaaaaataaaactgtctttctgccactgaagtaacagaaaaataagggcttgctggcaacctccgtgtcacaggcctctgactgcatttaatcagaaatgtctattgttgaattgagctttgctggccaaagaaataactgttttgaattagaaactgaaagatgatgaacaggccactgatggaagctattcttcccctgagaaagttgtccctagacgagattgtgaaatagacgcatttcacattttctcttaaactgtctctccatttgctgggtgtatcagttagggttctctagagaaacagaatcaataggatatatataaagtgggggagggaagggagaaagagaaggagagagattgatttagagttggctcatatgattttgggaattggcaaattcaaaatttgtagggcagaccaggagctgcaaactcaggcaagagttgaaatcacgattttgagttagaaattctagggcaggccagcaggctagaaactcaggcaagatttctatgttacagacttgaggcagaatttcttctacagtataccaagacaattctggcatttcaacttcatttcgtatgggccacattttattcaaagtttcatgcaaccggtcaaactactagactgggctagggtcaactggtcttactgactgaaggctatgcaggttcaaaattgttggtctggaccataaggaaacatggtagggctccctgtgaaattagaaagccaggaaggtttaaaagacaggggtatttgtctgaccactctaacttgcacagaaggagtctctgtggccatgtcaagagagccaaactctcagatatcacatccttcaggagacgtccatgataggcagtgactcaagaactactctaaggccttactttgccttttaagccaagacagtttggccctccctgttctgtactgccctatcctgactgactggccatcccctctgaattagaagagtacttactggtcttttcttcaatgcctgccgcttgtctgaagcacagtgaccccacatcctctctcccagccacatgcctttgttggccttctggtcatccagcattctgcattgcagtgtcctggacaggcttaccctctccctgctcccaaataagcttgttctacccttccatgtgttcaaaccttgttgccagctcatggagcactggatatctctttgacaaagtggagaggcaacatggtatgaataactgataatctacttatatttatttattcaatcaacaaataggtactttagtgtatcaggccttgtgctagaggctgggaagaaataagtaaatctgacatagttcttgcccacaatgtactcatcatctagttaaggagacagacaagcagttgaacacaaacaattgccatacagtgtaagaagaataatggtagaggtatgttttgagaacagttgtagcagagagaaaaagtgagtaacgcttcatggcctgggagagtggagaggatttcagctgcttcctgagaagtaagtagtagttcaccaagtaaacaaggcaaatgaaacatgccagagtgaggtaacagcaggagcagaggcacagttgtgtactcatacacagcttattggaataatggagacaagtcaatctagtatggctacatatgacatggtgcatgccagggattggacatttatgtaggagtaaagctctggtgttccgggcaactaaccttgtacttaatgctaagggcaacagaaagctatggaagttttttcttttcttcttcttttgtactaacagctttactgaagtataatccacattccatacaattcacataaagtatacaattcatggttttaagtatactcacaaagttctgccattatcaccactgtctaattccagaacattgtcatcactccaaaaataagccttatacagtcactcctcaacttacgatagggttacatcctcaacccactataagttgaaaatttcataagttgaaaatgcgtttaatatacctaacctactgaacatcatagcttagcctagccaaccttaaacatgttcagaatactcacattagcctacagctgggcaaaattatctaataccatgcctattttataataaagtattgaatattgcatgtaatttattgaacacgatactgaaagtaaaaaacagagtggtcgtattggtgctcaaagaatggtgtctattgaatgtgaatctctattgcactgttgtgaagttgaaaaataataagtcaaaccatcataagttggaaactatctgtactaattaccatccaccccccatacccattaccttccagccactggcaactactaatctatttatacatttatatatttgccaattatggacatttcatatgaatggcatcaaacaatgtgtgatcttttgtgactggcttctttcatttagcatgttttcaaggttcatccatgttgtagtatgtatcagtactctatcccttttcatgcccaaatgatattccattgtatggatgtacaacatttcatttatccattttatcagctgatggaaatttggttgtttatactttttggctcttatgaataatgctgttataaacatttttacaattttttaatccatcccctcaagcatttatcctttgagttacaaacaatccaattacattctttaagttactttaaaagatacaattaagttattattgactataatcatcctatcgtgctatcaatattaagtcttatccattctttctatttattttgtatgcattaactatccccaccttgcccccagtctcccactacccttcccagcctctggtaaccatcctgctctttatgtacatgagttccattgttttgatttttagatcccacaaataaatgagaacatgcaatgtttgtcttcctgtgcctggataatttcacttcacttaatgatcttcagtttcatccatgttgttgcaaactattggatctcattctttttttatggctaaatagtactttattgtgcatatgtaccacattttctttatccattcatctgttgaaggacacttaggttgcttccaaatcttagctatcgtaaagagtgcagcaacagaggagtgcagatatctctttgatatactgatttcctttcttttgggtatatacccaaaagcagtgagattgccagatcgtatggtcgctcaatttttagttttatgaagaacctctaaactgttctccatactggttttactaatttgcattcccaccaacagtgtacaagggttcccttttctccacatccttgtcagcatttgttattgcctgtcttttggataaaagccattttaactctggtgaaatgatatctcagtatagttttgatttgcatttctctgatgatcagtgatgttgagcaatagagtaccttttcatatgcctgtttcccatttgtatatcttctttggagaaatttctattaaaatattttgcctattttttgaccagattattagattttttttcctggagagttgagtcccttatatattccggttattaatcccttgtcagatgggtagtttgcaaatattttctcccattctgtaggttgtctgttcactttgttgactgtatcctttgctgtgcagaaggtttttaacttgatgtgatcacatttgtccatgtttacttgtctgtgcgtgtgggcttactcaagaagtctttgcccagaccaatgtcctggagatttttccccaatgttttcttgtagtaatttcatagtttgaggtcttagagataagtctttaatccatttttatttgatttttgtatatggtgaaagataggggtctagtttcattcttttacatatggatatccagttttcccagcaccatttattgaagagattgtcttctccccagtgtatgttcttgacacctttgtcaaaaatgaattcactgtatgtgtgtggatttgtttctgcgttctctattctgttacattggtctatgtgccagtaccatgttgttttggttactatagctccatagcataatttgaagtcaggtaatgtgagtcctccaattttgtcctttttgcttaggctacctttggctattctggatcttttgtggttctatatacattttacaattgttttttctatgtctatggagagtattattggtattttgatacagtttgcattgaatctgtagattggtagtatggacattttaacaatattgatttttccaatccatgaacatggaatatttttccatttttggtgtcctcttcaaggtccttcaccagtgttttatagtttacattatagagatcttttacttctttggttaagtcctgggtatttaattttatgtgtgactattgtaaacgagattacttttttaaaaatgtcattgtcacattgttcactgttgtcatatagaaaggctactgatttttgtgtgttgattttctatcctgcaactttattgattttaacagctctaacagttctctttaaagtctttaggtttttgcaaatgtaaaatcatattaccagcaaacaaggataatttgacttcttcctttccaatttgggtgctctttatatctttctcttgtctgattgctctagctaggaatcccagtactatgcttaataacagtggtgaaagtgggcatccttatattccagatctgagtagaaaagctttcagtttttccccgttcagtgtaatactagctgtgggtctgtcatatatggcttttattatgttgaggtatgttccttctatccccagtttttttagggtttttatcatgaagggatgttgaattatatcatatgttttttcagcatcaattgaaattatcatatggtttttatccttcattctgttgatatgatgtatcacattgattgatttgtgtatgttgaaacatccttgcatcccagggataaatcctacttgatcatgatgaatgatctttataatgtattgctgagttcagtttgctactgttttgttgaggatttttgcatcgatattcatcagagatgttggcctttagttttctatttttgatgtgtctttggttttagtatcagggtaatactggcgttgtcgaatgagtgtggaaatattcccttctcctctattctttggaatagtttcagtagaattggtgttcgttcttctttaaatatttggcagaattcagcaatgaagccattgggtctcaggcttttctttactgggagactttttactagcactttgatatcattacttgttattggtctattcactttttggagatcctcctggttcaatcttggtaggttgtatgtatctaggaatttgtcaatttcttctagattttccaatgtactggcatatagttgctcatagttagccactaacaatcttttgaatttctgcagtatcagttgtaatgtctcccttttcatttctgattttgtttatttggattttctctcttatttttcttagtctggctgaaggtttgtctattttgtttaacttttcaaaaaaccaactttttgtttcattgaccttttgtatttttttatttcaattttatttatttttgctctgatttttattatttattttcttctactagttttgggtttggtttgctcttgcttttctagttctttaagatgcatcgttaaattgtttatttgaagttttttctcttttttaatgtaggcatttacagctatacatttccgagtattgcttttgctgtatcccataggtttcggtatgctgtgttttcattatcatttgtttcaagaaatatttcaatttccttcttaatttcttcattgacccactggtcattcagaagcatattgtttaatttgcatgtatttgtatagtttccaaaatcctcatttttaatttctagttttattccattgtggtcagaaaggatgcttgatattatttcatttttttaatgtttcaagacttgttttgtgtgatctaacgtatggtctatccttgaaaatgattcctatgctgaggaaaaaaaatgcatattctacagctcttaggtgaggtcatgttttcctggatggtgttgatgctagtagatgttcatcagtgtctgggctttgagggttaggtatttattgtaatcttcgctgtctggacttatttgtagcatccttcttgggaaggctttccatatagttgaaagacgtgggtgttgtgatctaagctgtatctgctttaggggacaccccaagcccagtaatgctgtggttcttgcagactcatggaagtactgccttgatggtcttggacgagatctgggagaattctctggattaccaggcagagactcttgttcttttcccttactttctccaaaacatacagactctctctgtctctctgttctagccatctaaagctggggctggagtcacacaagcacccctgtggttaccaacactgtgactgcactgggtcagacctgaagccaacgcagcactggatctcacccaaggcctgctgtaaccactccctggctactgcctatgtttgctcaaggccctggggctctacaatcagcaggtggcaaagtcagccaagcctgtgtccttcccttcagggcaacacagtcccccgagccccaggtgagtccagaagtgccatccaggagttatggactagagtcaaaaaccttagatgtctacctggtgttctattgtattgcagctgagttgaccctcaaaccaaaagacccagtccttcccactctttcctttcctttccaaaggcagaggagccccaccctgtagccagcatcaccccaggccatgaggagtactgccagagtagtgctgatgttcctttaaggccccaggtctctaaagtcaacttgtagtaaatgctgcctggcctgggactcacccttcagggcaatgggttcccctctggccaagggcaagtccagaaatgctgttcaaaagtcaagtcctggaattggggaccccaggagcccagttggtgatccacccccttgtggccatgctggtacctaaggtgtaagacaaagtccccattacttttccctctgcttttctcaagcagaaggagttttgtgccataaccaccacagctcattaggtgcacagtctcacctgaagacagcaagtctcagaggctcagccaaggcccttgatgtagtacctgggtgttgctcctggttgttcagggcccaagggctcttcagttagccagtgatgaatgctgctgggactgggtcctttccttcaaggcagcgggttccctcctggcccagggtgtgtctacaaatgttgcctggggactagggcctggaacggggtgagggggggtgcccttcttgacactggccagtgcccaatcctgctgtggctgagctggtatcttagatgtaagacaaagtcctccccactctttcctcccttctcaagcagaaggaaggggtctcttttggatcaatgacctgtgcagcttggggttaggggaggggtgatgccatcagtcccttggctgctccagctggtgtctcagtaggtcatgtgccccccagtccactgtctctgggcctaattcagcacgaggacttgcctaggagttgcagtcccttatggcctagactgtctttcaagtgtacttggagacacagtgctgtagccctgggtggtgaagtttgtaggcactcaagttcagacccacctgggatcaatgattcctctctggctagggctggtttaagtactccttccatgggtgggcaccagctgagtttggtttggttttcctttctgttctaacaggacagcactgaattcaatgattcacaattgctatgctctctcttccccagtgcccagagttgttctccgcaccacgctgctgctgctggggtgggggaggggtggcatcggctattcaggattgttttttctatctcttcagtgcctctttcagcgatatgaggttaaaaccaggtactatgagtgctcgccagatttcgccagatttttggtccttaggaaggtgttttttttttctgtgtagatagttgttaacttggtgtctttgcaagggagacaattggtggagttttctattctgccaccttgctctgccctttgcccatttttacaaacttttgagttgacatgttttcatttcttttgcatacatacctaggggtggtttttctgggtgatatgctaagtctatgtctttgaataagtaccaaactattttgcaaagtggctatacccttttacattcccaccagcagtgtaggagagttccaatttctccatatccttgccaatacttattatctttcttcttgattaaagccatcctattctagtgggtgtgatgtggcatgttgtccctttgatttgcattttcctgatgaatttgatgttgagcatcttttcatgtacttattagccatttatatatctttttggagaaatgtctatccagatactttgtccaacatttcattggattatttgtcttttacttattgagttatgagttctttatatattcttgatgcaagctcttatgagatatatgatttgcaaatttttctcccactctgtgatttgtcttttcagtttcttgatggcatcctttgaagcacaaaagtttttatttggatgaagtataatttatcaatttttaattttatggatagtgctttgggcattgcatccaagagctctgcccaatctgaagtcacaggattttttttcctatattatcttctaaaagttttatagctttagcccatacatttaggtctataatccattttgagttaattttttaatacggtgtgcattaataatctaaactcctctttttgcatgtggatatccaattctcctagaccatttgttgaaaagactattctttctgcactggcttgtgttaccatgtttgtcaaaaatcaattgaccataaatggactctcaattctatcccattgatctctttgtctttgtgacagtactaaactgtcctgatttctaagttttaaaacaagaagttttgccttttcaaagttgttttggctattctatatcctttgtatttctacgtaaattttgggatcagcttgtcaatttctacacaaaagcttactgtggctttgacaggacttgaattgacattatacatcaattttggataattgccgtcctgacaatattgagacttccaatccatgatcatggattctgtctcctttatttagatctttattttctctcagtaatgattataattttcagtgcacatatcttttgttagatttacctgtaagtatttcacatttttgatggtattgtaaatggcatttcaaaactttaatttctgagtgtttgttgctagtatatagacacaattgaattttgtatactggtcttgcatcctttgacttttcttttttttttattatactttaagttttagggtacatgtgcacaatgtgcaggtttactgcagcgctattcacaatagcaaagacttgggaccaagccaaatgtccaacaatgatagactggattaagaaaatgtggcacatatacaccatggaatactatgcagcatcctttgacttttctaaactacttattagttctttttttatggattccttggaattttctacatacagggtcatgtaatctgcaaataaatacatttttacttttttcttttcaatctggatgcattttatttatttacgtacttactacactggcaagaacttccaattaaatgttcctgaaggacattagaagtgctattccagtgaatacatgaaaaataagaaacagtcttattgctgatatggagaaagttttagtgatctggatagatcaatatagccacaacattatcttcagccaaaacccaatccagggtaaggccctaactaaattcaattccatgaaggctgtgagaggtaaggaagctgaacaagaaaagttggaagctagcagaggctgattcatgaggtttaaggagagaagtcatttccataacataaaagtgcaaggtgaagcagcaagttctgatggaagttgcagcaagttatccagaagatctacctaagataattgatgagggtggctatactaaacaacagaatatcagtgtagatgaaacagctttctattggaagaagatgccatataggagtttcataactagagtggagaagtcaatgcatggcttcaaagcttcaaaggacaggctgactctcttattaggggctaatgcagctgatgacttaaatttgaagccagtactcatttaacattccaaaaatcccatggccctcaaaaatcacctaaatctacctgtgctctataaatgaaacaacaaagcttggatgaaagcatgtctgtttacagcatggattactgactattttaagcccactgtttgagacttgttgctcagaaaaaagattacttcaaaatattgctactcattcacaatgtaccttttcacctaagagctctggtggagatatacaaggaggttaatgttttcatgactgctattataacatccactcggcagcacatggatcaaagagtaatagcaactttcaagtcttattatttaaaaaatacatttcataaacctattgccgccatagatacttattcatctgacggatctgggcaaagtaaatcaaaaacctctggaaaggattcaccattctagatgccattaagaatatgattcatgtgaggaggtcaaaattattaacattaacaagattttggaagaagttgagtccaaccttcagggatgattttaaggagctcaagatttcagtagaggaagtaactatagatgtggtagaaatagcaagagaactagaattagaagtggagcctgaacatgtgactgcatcgctgcaatctcatgataaaaatgcagcaaataggagttgcttcttatgaatgagcaaagaaagttgtttcttgagatggtacctattcctggtgaagatgctgtaaacattgttgaaatgacaacaaagattttagaatattccataaacttagttgataaagcagtagcagggtttgaaaagatggactccaattttgaaagaagttccactgtgagtaaaatgctatcaaatagctttgcatgctacagagaaatctttcatgaaaggaagcgtccatcaatgctgcaaacttccattgttgtcttctctgaagaaattgccacagccacccagccttcaacaaccacctccctaatcagtcagcagccatcaacattgaggccagatcttcctccagcaaaaagatgactacttgctgaaggctcagatgatccctaccattttgggcaataaagtatttttaaatcaaggtatgtacattgttttgtagacataatgctattgaatacttaatagactacagtatggtgttaacataacttttatttttaaggataacctaggatccaattgccatttatttcaagagtgccacacggacaggagacaactcaataaattattaaatacttgcactatttcagtatttgtatgtaattgtaaagataaatacattgtgtatgattcctctgcttctattttgtttgattttcctgataatccatcttgagcccagagaactgtacttgcatgtacttcctgtacttagcaaaaggaaagcattcaaaggaaggacagttaaggaaggaaattagtagatggtacttggcaagtatagtaaggaccaatttggaaggtccagctgaattttgaagattttgtttttaatttttttatttcaatagctttaggaatacacatgagttttggttacatggatgaattatatagtggtgaagtctagaattttagtgtacctgtcatctgagtattcaaatggtatacattgtactcaataggtagttttttctccctcactccactctcacccttcccccttctgagacgccaatgccagtataccactttgtatgcctttgcttatgcatagcttagctcccatttttaaatgagaacatgtggtattcgattttagattcctgagttagaataatggcctccagttccattcaagttgctgcaaagggcattattttgtgcttttcaaatggctgagtagtattccatggtgtatatatacagcattttctttatcaactcattggttgatggggacttaggttgattccatatctttgcaattgtgaattgtgctacaataaacacatgtgtgctggtgtctttttgatatagtgacttcttttcctttgggtaaatacccagtagtgggattgctggattgaatggtagatctacttttagttctttgagaaatctccatactgttatccatagaggttgtattaacttacattctgattagcagtgtataagtgatccttttttaccacatccacaccaaacttttttttttgtactttttaataatggccattctggctggagtaaggtggtctctcattgtggttttaatttgcatttccctgaagattagtggtgttcagcattgttttcatatgttttttggccatttgtatatttttctttggagaaatgtctattcatgtcctttgctgactttttaatgggactttttttgtttttttgaggttttcttttttgtaaattctggatattaattctttgttggatgcatagtttgcaaatattttctcccaatctctgggttatctgataatttttaaaaattttattattattatactttaagttttagggtacatgtgcacaacgtgcaggtttatttatttatttttattatactttaagttttagggtacatgtgcacaacgtgcaggtttgttacatatgtatacatgtgccatgttggtgtgctgcacccattaactcatcatttacattaggtatatctcctaatgcgttccctccccactcaccccaccccacaacaggccccagtgtgtgatgttccccttcctgtgtccaagtgttctcaatgttcagttcccacctatgagtgagaacatgcggtgtttggttatttgtccttgcgatcgtttgctgagaatgatggtttccagcttcatccatatccctgcgaaggacatgaactcatcattttttatggctgcatagtattccatggtgtatatgtgccacattttcttaatccagtctatcattgttgggcatctgggttggttccaagtctttgctattgcgaatagtgccgcaataaacatacgtgtgcatgtgtctttatagtagcatgatttataatcttttgggtatatacccaataatgggactgctgggtcaaatggtatttctagttctagatcattgaggaatcgccacactgtcttccacaatggttgaactaatttacactcccaccaacagtgtaaaagtgttcctatttctccacatcctttccagcatctgttgtttcctgactttgcaatgattgccattctaactggcgtgagatggtatctcattgtggttttgatttgcatttctctgatgacgagtgatgatgagcattttttcatgtgtctgttggctgcacagatgtcttcttttgagaagtgtctgttcatatccttttcccatttttttaatggggttgtttcttttttttcttgtaaatttgtttaagttctttgtagattctggacattagccctttgtcagatgagtagattgcaaaaattttctcccattctgtaggttgcctgttcactctgatggtagtttctttggccgagctgaagctgtttagtttaattaaatcccatttgtcaattttggattttgttgccattgcttttggggttttagacatgaagtccttgcccatgcctatgtcctgaatggtattgcctaggttttcttctagggtttatatggttttaggtcttacctataagtctttaatccatcttgaattaatttttgtataagatgtaaggaagggatccagtttcagctttctacatatggctagccagttttcccaacaccatttattaaatagggaatcctttccccatttcttgtttttgtcaggtttgtcaaagatcagatagttgtagatgtgtggtattatttctgagggctctgttctgttccattggtctataagtctgttttggtaccagtaccatgctgtattggttactgtagccttgtagtatagtttgaagtcaggtagcatgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcatgataatgattcttcctacccatgagcatggaatgttcttccatttgtttgtatcctcttttatttcattgagcagtggtttgtagttctccttgaagaggtccttcacatcccttgtaagttgggttcctaggtattttattctctttggagcaattgtgaatgggagttcactcatgatttggctctctgtttgtctgttattggtgtataagaatgcttgtgatttttgcacattgattttttatcctgagactttgctgaagttgcctatcagcttaaggaaattttgggctgagacaatggggttttctagatatacaatcatgtcatctgcaaacagggacaatttgacttcctcttttcctaattgaataccctttgtttccttctcctgcctgattgccctggccagaacttccaacactatgttgaataggaaaggtgagagagggcatccctgtgttgtgccagttttcaaagggaatgcttccagtttttgcccactcagtatgatattggctgtgggtttgtcatagatagctcttattattttgagatacgtcccatcaatacctaatttattgagagtttttagcatgaagggttgttgaatattgtcaaaggccttttctgcatctattgagataatcatgtggtttttgtcattggttctgtttatatgctggattacatttattgattttcatatgttgacccagccttgcatcccaaggatgaagcccacttgatcatggtagataagctttttgatgtgttgctggattcggtttgccagtattttattgaggatttttgcatcgatgttcatcagggctattgggctaaaattctctttttttgttatgtctctgccagtctttgttatcaggatgatgctggtctcataaaattagttagggaggattccctctttttctattgattggaatagtttcagaaggaatggtaccagctcctccttgtacctctggcagaattcagctgtgaatccatctggtcctggactttttttggttggtaagctattaattattgcctcaatttcagaacttgttattggtctattcagagattcaacttcttcctagtttagtcttgggagggtgtatgtgttgaggaatttatccatttcttctagattttctagtttatttgtgtagaggtgtttatagtattctctgatggtagtttgtatttctgtgggatcgttggtgatatcccctttatcattttttattgtgtctatttgattcttctttcttttcttctttattagtcttgctagtggtctatcaattttgttgatcttttcaaaaaaccagctcctggattcattgattttttgaaggtttttttgtgtctcttatctccctcagttctgctctgatcttagttatttcctgccttctgctagcttttgaatgtatttgctcttgcttctctagttcttttaattgtgatgttagggtgtcaattttagatctttcctgctttctcttgtgggcattcagtgctattaatttccctctacacactgctttgaatgtgtcccagagatcctggtatgttatgtctttgttctggttggtttcaaagaacatctttatttctgccttcatttcgttatgtacccagtagtcattgaggagcaggttgttcagtttccatgtagttgagcggttttgagtgagtttcttaatcctgagttctagtttgatggcactttggtctgagagacagtttgttataatttctcttcttttacatttgctgaggagtgctttacttccaactatgtggtcagttttggaataagtgtggtgtggtgctgagaagaatgtctattctgttggtttagggtggagagctctgtagatgtctattaggtctacttggtgcagagctgagttcaattcctggatatcctcattaactttctgtctcgttgatctgtctaatgttgatagtggggtgttaaagtctcccattattattgtgtgggagtctatgtctctttgtaggtctctaaggacttgctttatgaatctgggtgctcctgtattgggtgcatatatatttaggatagttagctcttcttgttgaattgacccctttaccattatgtaatggccttctttgtctcttttgttctttgttggttgaaagtctgttttatcagagactaggattgcaacccctgcctttttttgttttccatttgcttggtagatcttcttccatccctttattttgagcctatgtatgtctctgcatgtgagatgggtttcctgaatacagcacactgatgggttttgactctttatccaatttgccactgtgtgtcttttaattggagcctttagcccatttacatttaaggttaatattattatgtgtgaatttgatcctgtcattatgatgttatctggttattttgctcgttagttgatgcagtttcttcctagccttgatggtctttacaatttggcatgtttttgcaggggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggttgaaaattcttttctttaagaatgttgaatatcggcccccgctctcttctggcttgtagagtttctgccgagagatcagctgttagtctgatgggcttccctttgtgggtaacctgacctttctctctggctgcccttgacattttttccttcacttctactttggtgaatctgatctttatgtgccttggagttgctcttctcgaggagcatctttgtggcattctctgtatttcctgaatttgaatgttggcttgccttgctagattggggaagttctcctggataatatcctgcagagtgttttccaacttggttgcattctccccgtcactttcaggtacaccattcggacgtagatttggtcttttcacatagtcccatatttcttggaggctttgttcatttctttttattcttttttctctaaacttctcttctcacttcatttcattcatttgatcttccatcactgataccctttcttccagttgatcgaattggctactgaggtttgtgcattcttcacgtagttcttgtgccatggttttcagctccgtcagttcctttagggacttctctgcattggttattctagttagccattcgtctagtcttttttcaaggtttttaacttctttgccatgggttcgaacttcctcctttagctcggtgaagtttcatcgtctgaagccttcttctctcaactcgtcaaagtcattctccatccagctttgttccgttgctggtgaggagctgcatttctttggaggagtagaggtgctctgatttttagaattttcagtttttctgctctgttttttccccatctttttggttttatctacctttggtctttgatgatggtgatgtgcagatggggttttggtgtgtatgtccttcctgtttgttagttttccttctagcagtcaggagcctcaggtgcaggtttgttggagtttgctggaggtccactccagaccctgtttgcctgggtatcagcagcagaggctgcagaacagagaatattggtgaacagcaaatgttgctgcctgatcgttcctctgcaagttttgtctcagaggagtacccggctatgtgaggtgtcagtccgcccctactagggggtgcctcccagttaggctactcggggatcagggacccacttgaggaggcagtctgtccattctcagatctcaagctgcgtgctgggagaaccactgctgtcttccaatctgtcagacagggacatttaagtctgcagaggtttctgctgcgttttgtttggctatgccctgcccccagaggtggaggctacagaggcaggcaggcagacctccttgagctgtggtgggctccacccagtttgagcttcctggccgctttgtttacctactcaagcctcggcaatggcggtcacccctcccccagccttgctgccgccttgcagtttgatctcaaactgctgtgctagcaatgagtcaggctctgtgggtgtaggaccctctgagccatgcgtgggatataatctcctggtgtgccgtttactaagaccgtcagaaaagcacagtattagggtgggaatgacccgattttccaggtgccgtctgtcacccctttccttggctaggaaagggaattccctgaccccttgcccttcctgggtgaggcgatgcctcgccctgctttggctcatgcttggtgcactgcacccactgtcctgcacccaccgtctgaaagtccccagtgagatgaacccggtacctcagttggaaatgcagaaatcatccatcttctgcgtcgctcacgctgggagctataaactggatctgttcctattcagccatcttggaaccgcttctatctgataattatttcttttgctgtgcagaagctttttagtttaattaggtcccatttattcagttttgtttttgttgcatttgcttttggggtcttagtcataaattatttgcctaggccaatgttcagaagagtttttcctaggttttcttctagatttttaatggtatcagttcttagatccatcttgagttaaattttgtacatggtaagatatagggatctggttttgttcttctacatgtagctatccaattttcccagcaccatttattgaacaggatatcttttccctaatttatgcttttgtatgctttgtcaaagatcagttggttgtaagatgtggctttattcctgagacctctattctgttccatcagttacatgtctacgtttttaccagtaccatgctcttttggttactatagccttgtagtataatttgaagtcaggtaatgtgatgcctcaagatttgtttttctgcttaggattgctttggctatttggacttttttctggttctatatgaatttaggggatttttctaattctgtgaaaaaatgatgttggtattttgataggaattgcattgaatctgtaggttgctttgagcagtgtggtcattttcatcgtattgattcttccagtgcatgagcatgggatgtatttccatttgtttgtgtcatctacaatttcttgcagctgtgttttgtaatactccttacagagatgtttcacctccttggttaggtatattcctgggtattttattttttgcagctactgtaaaaggaattgagtcttgatttgtcattcagtttggtcattgttggtgcatagcagtactgctcacttgtctatattgatgttgtagcctgggactttaccaagttcatttatcagatttaaaagtgttttggaggagtctttagggtattctagatataagatcatataatcagaaaacaaagatagttcgatttcctcttttccaattgggatgccctttatttctttctcttgcctgattgctgtggctagaacttcgaaatgtaacttttatatgcactcagcaaccaaaaacattatgttgctcactttattgcaatatttgctttatggcagtggtctgaaagcaaatccacaatatcttcaaggtatgcttatttatgcaggacatcctttgttggataagtttgaaggtggagagaccaatcaaaagatgattgtcgtagcacaggtgagagagatgatggaggctgtgactgggttgttgctaatgcagatgaagaaaagtggatgaattgggcatctataacaaatgctgaaaccacaaccatttcagttttccagttgagaggttatgaggtcagatccagcacagtgtatgtagaaacagaaaataagagatatcttagagatataactttgaaggaagtctcaaagacttaatgccagggagaattagagcatattgagggtgcgggagactgatttgtggtctcaatcattagggagattgaaggaccagacaaagaaatgaggagcaaaggatggagacagggtgtggggagaagtgaggagggggacagttttgggaaaattttaatgatgaaaagtcagaggatatccaaatgaacatgccccataagcaattggaaatgtaggtctggagctcaggagcaagaaaacactgcaaacgtaatgggacaaaagatctttcacatttatatttaggtagagatgtatccagagacctgtagacgtctttggtattactttttttaaaaacaaacatgtgatcatccatagtctctaatacttatctacaaccccaagaaggtctttcgttattgttgttttatttttgtttttgtttttagggagttgggtatggagtgatcatgtgggaaggaacatacggacaaggtaaaagagtgtgggattggggagaaattgagaacaagagaggagaaaagcacataaagcatatcagaagctgctcccaccaccatctctctaaagctatgattgagatgctgggccaggttgagtgattgtgttaattccccctccctaccccattttcagtgaaagtttcacctagcttcatgaataactgtgtcttgctctgtctcacttgctttggccttgtctttgtccttctctgtctttgtctctcctagtttccttatcgagctttccctcgggggactttttcattcttcactagcccaatatttcatccttgggttggttcatgtttctccaaaatgctgacagctccatcagagaatgcaaggatgaattgccacaaatatatttctgaactgccactagatggcagtgtctgggaactttgttaactcggtctaggcattcatgagtgcctgactgctgagtggtagggagtttcatttgattattctgcttttaggccgttgcaaccagttgctaacacaagtgctagacttagctggatctctttctccatgatagaagaaaattcatgtttgtaaagcacccagggctggaaaagcctgttctttaagagggttagcgttttcctctacctcaattctcacacaagttcctagcccttagattccttagattcccttttgttcccccttcagctgttgtttgttgtttggtttcattttttatgcaaatatatttcctccttccccagctttgttagtaagttggatcaattctctttcctctttttgaggatggacttgtagaatcatctgctatcaaagcttgaagaactcttagatgtcgtcgagtccaatccaatcatttacagatagagaaactgaggcaaagacaggagcagaaacttgttcaaggccatataaaaattcaaggcagaatcctatgggacaatctcatgacatacttgtaataatcaacaaaacaaccagaagattatttttgatccattaattgtggatctagcacaatagaggaaggggagggagacaggaggtataggacatggtgcctgttctcaaggcacttagaatctaggtgggaatatagacttttacacaatgaaaaagaataaatgcattgtgtgataaggtaatctaagaaaaaatgctaatgtaggcaagtggtacagggattcagaggaacaacagctctaagagaaaacaaggcaatgggtgggggtgaaggtgaagctgggagatgagaaattcaaagattattattattcagggatcaaggcctaataagtaggcctgacaagtagagggtaggggtcaataagaagtaaaagataagactcagtgataggctgggactgtactgtacaggctcttaaatgccaggctaattcctggtaatgctgaacagaaactttcaaatgctttcaatctattttctatttacggtggtaactttctgctatgtttgattccccaagaagtagcctctttgctctgccgtgcttttccccattagtctcatgttgccggcccagcagaagggagatgaagtagagctgaaaaatcagtctggggcttatttccactacagcttttccctagtgattcaatcaagagtgacctggacattctccaatcctaaacccatttcattcattttatttccattctccacccactcatgggagtctgagcacctggcctctgcatcccacaacttcctttgtcacaagggctttccagaaggtttggagagctcttgacagctgagaaacacctatagaaggtgagcatgacttcatgcaaatgaaagaggcctccatacaaaacagctctttaaaagcagtctgaacgtaggaacaatccaagagccctttcaaattgtcaagagcacatcagtgcccaagcatcttggccagccacatttcaaagccaagcaatgccaccctctccccttctcaactctccctttatactcccaaatggcttgaggtctttctaccaggatacagtggatacctctgcctcagcaccttccatctggctttcttcccgccatttgctgtcttctcgtccccacagaatgctatatctttcctcttagcctctgcttagtatacaacctgacacagtaggtactcaatacacggtgttcttttccttcacaaggaccttagagattatctaggcctgaatattatggagccacctaatggaccactgggggtagggatcattgggaaataaggaaatactctgacaattacagtcttcatttctgtaactggtcacatggttgtagttggaatttataactaccttcttctactacccattctgcatcttctttgtcttcagcaaacacctcagctggttgtggttctttacctggaggcatgacccaaaccctcattcctgaagggtctgggccattagtagtcttgcctggattggtttgttgtcttttccatttaccttaatcacagggcgtggaaatactaagatgcatcttaagggatcctctgtattccagacatattcttccttacctacattgtggagttatagttcaatttctccttggtattcagaatcaatcaactcagccagcacaataactcccttccttgcctcctgttgattcagaggcatgaggagcccaaagtggccaggcagcagccttaactttcaattcaatggaatcattgttgtgtcttctggcggaagcattcctccctttggaactaagacttcttggccagcagaccataaattcatgaaaagaggcagtagaaattttgctagtagatcactaggggtgatggtgagtggtaccactccctttgccaccccttaattgctggacccatgaatcctggctatgggagaaacagccccatctgaagatgctgattcagagcatatacagccttctggagaactttccccttgccctacaaggtattgccagctggctggtgctgtaacagagtttttaaaaagccagtttgcagtgaagtgagttcctttatcagaagcaatgctgggtggaatactatgatggtaaatagggcattctgtaagtctacagagggtagttttgaaagaataattgtgttcagggaaggcaaatccttatccatagtaagtgtctattccagtatggacaaaacttccacgatggaagtggcccaatgtaatcagcctgccactgtatcagggattcagtgttggtctctgctgctggcagattggacaccccgccatggccatagccaagttggccttgttgaatagaagttcatgttgctgattccatgcataacctccattcctgccaccatggtcactttgtttatgagcccattgagcaatgacagaggtggctgggaaagagactagtatccataaatgggtgattctatccacttgattattaaaatcctctgctgaagtcaccttttgatgagcattcacaaatatcttcatttttttacccattcatagagatctatcccatacctcttccccaaatttctttctcatcaatgttccaattacgttcccttcaagtctctgaccatccagctaaactattggccacagaccatgaattagtgtataataatgtctagccattttttcttccaaacaaagtgaatgacaagtgcactttttcaagttctgcctactgggaatatttcccttcatcaatgtcctttagggatgtttcagagaggggctgtagtcctgcagctgtccacttttggatagtgcctgtatatcatgcagaatcatctataaagcaggtctgggtcctctcttcctccatgacctgatcataggaaactcccccatgaggccatagctgcaagcttacagacagaagatagtgtagcaggaatgaggctcatgggcatttaggccacttcttcgtgtaacttatttgtgctctcaggtcctgttcagaccaatcaagaataatatcactttcatttaatgatgaagtattttggtgcatgcccaattttatggcttggtgggtcagataatggtcagttcaggtcacatggtaatgtggtggcctgtggttaagcattcagtctctactaaggcccagtagcagacaaacagctctttctccaaagagtagttatttgctgagggtggtaagattttactccaaaatcctaagagccttgtgtagcaattcacctatggggcctgacacggtttccaaactacattcctatctgccactgatccttcaggcaccattggatctgctggatcatgtagcccaattggcagagcaacttgcataccagcctggaccttgttctgggccctactcaaaactagcagctttttgggtcactcagtaaatgggctggagtaatacactcaaataaggaatacgttgaaatccaaagaggcccaccaggcgatgtgcctcctttttggaggagaaagatgcaacaatctgttttttaccttcgcagggattcctccacatgccctactccacttagcccctaaacatttcactgaggtagaagccccctgaatttttgatagatttatttccaaacctctgcaaggtgttgctccactgtcttgccatttgcataatttccaatctgctgtcacctatatatatgttcttctgaacataacatatctcttttatctggctactttaaagagtttttctttgtcactggttttggacaacttgactatgatgtgcccgattctactattcttcatatttcctgggcttggggttaattgagctgcttggatctgtgggtttatagttttcatcaaatttggaaaattctcagctattattccttaatatattttttctgcccctgctccccccacctcaggggatctgattacatgtgtattaagccacttgttgttttcctaagctcattgatgttctatttatttagtttttttctgtttcacttgagatagtttctattaatatatcttcatgttcacgaatctcttctgcaatgtgtactctgccattctatccagtgtatttttcatattagacattgtatttttcatctctagaagttcaatttggtcttttaaaaatttatttatttatttgtttagagacagagtcttactctgtcacccaggctagagtgcagtggcacgatcttggctcactgcaacttctgcctccggggttcaagctattcccttgcctcagcctcctgagtagctgggattacaggcgtgcaccaccacacctggcttatttttgtatttttagtagagacagcgtttcaccgtgttggccaggctggtctcaaactcctgatctcaagtgatctgcctgcctcggcctcctaaagtgctgggattacaggtgtgaaccactgcacctggcccattttattttttaaaattgtaaaaacacagaacccctggtttataatcaatttggtcttttttataccactcatatcttcactgaactttttgaatatatgaaatacaattacagaaactattgcaatgtccttttctctgctaattctaatatagttattctcctcattatggatcattctttccttcttctttgcatactgataatcttttatcggatgccagacattgtgacttttacctcattgtatgctagatgtttttgtatttctaataaatattatagaccttcgttctgggatgcagttaagttactcaaaaatattttgatcctttcaaggctaacttttataatctattaggcaggtctgaaagaatgttcagtctatggctaaatagtctttataactgaggcaaggccttcctgagtactctatccaatgccctagaattatgaggttttccaatctggctggttgggaacaggcactactcctagccttgtatgaatgctaagtgcagttacttctgatccttttgggtggttcttccctcaatatcaggtagttttctcacatgtgcagtttagtactcagctgaatgcttgtgaggaaccctctatagatttctcaagttccctctctatgcagccctctcctggtattctgttctgaactccagccttcttagtcaccccagattatcagctccatctcttcagctcaagaagtctgtcagactctacctgggtttccccttcctaggtttactgcattcgtttttcataccccggggattagttctcttcattgcctgatatacactcatgaaaagtgttgtatcatatattttttctaactttttggttatttcaagtgggagatgaaatctggtccctgatactcatcttaatcagaagcagaggtccatcttcaggaaagctcttctaacaacatctcagcttcttcattatgcttcctctggagcttgtcccatatagttcatttagctgcaaaccctctgcatccatgggctccaccaaggacacatacagaacagggatattctctgtctctatccaggatctgttttccctcttagtcttctccctaatggccactgtctttgtcccttcatattggcaaactcatgtctcacttgactggaggcccttgacaccttccccagagtatagtttggtgtctcctccccaaagaacttcatcatggtagttcagagtttgacattttcccctagatttccctaatttccttccttttaacaggacatacttagaaaattaccagggggtttcactggatctaagtaggtcataaggatcctaagatttcccatggctattccatcaccacccaacactagtggaagtatgatggaaggggaagttgaaatggaaaactgtagtcttaactaattcaagttaaactattttatttctgcaaattttacaaaaacatgactagtgctataataattcccagggccttggaaaggttgcttgaaaagggcccagaagctttaaggttaattagctatgtggtaaatctaccctggtgcatgtaccattttgatgttctaccttactccatatgctagaatcttcctttttgagtccatctctgtctctttcataactcccagctgagcaaccaatctctacttttgaactttgtcttaataattggttttggtcactcaacgacctgctttccaaaatacataactttcccattatctcaattatctcatcctggctcattcttcacatagtatgctagtgtaaacactagcaccagttcatgctcaaccttcatgcttccacacgggctaaactctgaccaacttctcaaatgtatctagacaagccatttagtaagagacaaaattgaatgggtatagattatagtgacacatgtcatcaaacttactaggagatataaagtcacctgccttttataaagttttgagaaacaatatgtacaaatgtgagatgacctagacaatttccagacagacaatgatatatgtctatgaaaatttttgtttctacccaccagtcctcacagtggatgtgatggacaactatagagcttggatctttagggactggtaggataaattctaactaaaagtcttggagtgaatacaaaattaaagaacaggatagactagttggaatagtaggagaagggtgataaacgaaggatacaatcaagattcatagaataggatgaaactgggtctcagtagaagcataccaggaacaagcaaattttcttggacatcggtggatgtccacagttcattttcgtggaccaatagatgtgtggcgccctcatcaagttaataagtacgttaattcaagaattagtccattcatgtaaacagacccccacatatgccaaatctgcctctctctataaaaggtaaacattattattatttgactcaagcttttaaccacatctatagaaaacctgaactcaaagcaaattgaagacagaaactgttgtttcatctccaactagcaatgactggcacagagtaagagttcagtgaacatatgttgaacaaatttgctactctgtattttaccaatctgtgtacccctatctctgccatgaaaaagtgacaattcttatttattttcctaccctcagtgtctagcactatgtctgggactttgtgcattattgataagtggtttccagatgaatggaaaaccttggaagtgtgacgcattgctttgtgaatcacgtcaatgtgacactggtggcaatgtttaacacttacccaagaatctaagaagattccttccacatcttgaaaaggacagagctagaactgatttaaattataggagggagaatggaatgaccagaatcagaattccaggtgtgccttcccaccatagctcaggtggccaaaaggtaatggagaccataccattcttagctgctgtcaccttgaagtacacgggtcttttcttttatagcatctagtctgatgttaagcctattcagtacattttcactttagacattgtactttgcaactctaaacactcaattatttttagtttaaaatgactttttttatctttcagaaggtgttgattatttattatgtgataggagttgttaacttattggttttcaaaccttaaatcagttacttattgagcatagtagatacaacatgctttttttaatcaatattttataccgtagatctgcagtattttaccatttactttaaaatcagcaaagcaagcaaaatactcctgtaatagtttatgtagtcagtattagacttccaaactgatcagaagttggatatgtcattctacttgagattaagtaaaatgtacataatccaaagatatttgtttagagtttcttttctcctttagatttatttttttaatttatttttattttattgtggcaataacacttaacatgagatctactttcttaaattttgaagtgtagaaacattttcgttgacttataggcacaacattaaaggtacagcagatctctagagcgtattcatcttgcttaactgaagctttatgccaattgattagtaactcccagtttttcactcccccatcccctcacaaccattattctgttctttgattctattaaactattttagatagcacatatatgtggaatcatgcaatatttgtctttctgtgactgacttatttcacttaccataatgccatcaagtttcatcaactctgtcccatatcataatttccttctttttaaaggccaaataatattcatgtgtgtgtgtgtgtgtgtgtgtgtgtgtgtgtgtgtgtatgcatgcatatatttaccacattttctctattcattcatttattaatggacatttagattgtttccacatcttggttattgtgaataatgctgcaatgaacataggagtgctgagatcccgatttcaatagataaatacccagaagtgggactgctgggtcatatggtagttttatttttaattttttaaggaacttccataccactttctatagtggatgcaccattttcattcccatcagtggtgtattttttgggtaatagccatcctaacaggtgtgaggtaatatggttttgatttacatttccctgatgattagtgatgatgaccattttttttcacatacctgttggtcatttgtatgcctcctttggataaatgtctattcaggtgctttgcccatttttaaatcaagttattagttttttgtttgtttgttttctcttttttgctattgagttgtaggagtttcttggatattttggagattaaccccttatcagatggatggtttgcaagtattttctcccattccataggttgctttttactctgatgattgtttcccttgctgtttggaaactttttggttagctatagtactatttgtctatttttgctttggttacctgtgcttttagtgtcatatccatgaaatcactgcaaagatctatgtcatgaagatcttctcctgtttttttttctaagagttttacagtttttggtcttacatttaagtatttaaccattttgaatttattattttgcatggtataagttaagggtctaatttcatcattttgcatgtggatatccagtttcccccaaattctcctgcttcagcctcctgagtagctgggattacaggcacttgccaccacacccagctaatttttgtatttgtagtagagacaaggtttcaccatgttgaccaggctggtctcgaactcctgacctcaagtgatctgcctgtctcggcctcccatactgctgggaatacaggcgtgagccacccagcctggccctgatcttttcctttgatctagtctgctgttgaacttcatgagtgaatttttcagttcagttattgtgttctttagctctatgattttggtttggtagttctaatattttctatctgtttgttgaaattctcactttgttcatatattgttcttttggcctcaagagcatctttatgacaatgttttgaattcttggtcaggtaaattatataactctacagtttctgaaaagttatcttgttcctttgtttggaacttctttgcctaattctttattttccttgactctctgtgttgtgtctgcacattatgcaaagcagccacctctcttagtcttcacagactagccttatacaaaagaagacctccaccaatcagtattgccagagattctgggggtctctcaaaccttcgtgctagtccaacctgctttttgtgctttgtagtccccaagcatatagggtatgttgaatcctatcagtgtagtgcaacaagtgtaaatgcaattggttccttagaaactcccagaaagctggattgttggatgctccattcaattctgttttccagtccattcaactctttttcttctcaggggaaagctgagacctgttttattaaaattcccttgctctgtgctgatagggggaaaggagctatggcatctaccagcccaagccaccatctctgttctcccacaggtgacagattatgctgggcctgtcagagctctaagactggcaagtagcaaaacagtcctctagtgagccccctcagaaaagttgtggtgcttgacatgcaaaccaactctttaacctccctttggagaagctgggagtttgaaggtctcttccctctcatgtgttgctgtgccagaggtagggatttcaatgagagggtgtcctgaatctctctactggcttccgtgagtctggtttcacatttgcccaggttgcaagatactgtcatttaatttctggatttttcctaaaggcaattttctgtgaattattgctgaatcaatgtgtctgtaaggggaagaagggtccagggattcctattctgacattttgctgttatcactctttgttttatatgtttttcctcatatcttccatttctcttctctttatgctcatgttttccttccaatatttcaatagttataatagctttctaaaagtacttgtctgctaattctatcattcctgtcatttatgagtgtgtttatatggattgaattttctcctggctctggatcacattttcctgccttcttcatgttagtaattgagtgctagacatcatgaatattacattgttcagagtctagattttgctatgtttctgcaaagaaggttgaagtttgttctgacaggaagctaagttacttgtggatcactttgattctttcaagtcttatttttaagtttcattcaggtgggtctagtataacctctagataagcgctgatttaacccactatgaatgcatgaccctttcattatttactgaatgttccagtgttcactgtggcttcttcactttggcacgtcagaattcaaatgcctcctggtaaatgtcagtttggaaattattccaattacagttccctagtagttgttccttgcctggccttgtggagtttcaccatatgcatatgcagcttaatattcagcaaaagactcaaggggactccaagaagttttcttgggctttgtctctgcatagcaccctttcctctggtactctgtctcacaaattccagctttgtcatcctcaatgaaccctaatttttgccttcttaactcatcaagagtaccatgttctgcttgtgtttaccctccctgtgcaaatggtgtgggaagtacattcagtcagaaggctgaggtaatcacaagacctaccttatttattttccatctctaagggatcaaatttctccactttttgttgcccaatgtttgacaagagttgttttctatattttgtgtacttttatagttatttatgcagaaggtcaaattggctgccatttactctatcatggtcagaaggactgctgtcaccttcagaattcattgactcataaatttttattcaatgtcttctatattcccagtgtgtactcaatctcagacgatatacggaagagaaataacacagaatctctgaccctaaggggcatacaaacagctaatgggaaaagataaataggtactaactcactgttccctttaattggaatattctctccagtttgcctttctgcttagccaaaaattgctcatctagctcagactactttgtgtatgaggccataatttggatggaactaactatgctctcctttgaacataacaatatcctgcacatatttctgtcagtgctcactaaacatcttcttgtgtttctctgtttatatattactcttcctcactaaacagtgagcttctgtaagacaaatgtcatgacttttttcccagtatccagcacaatcactagcacagagaagatatccaaggcaataaatactagtaaaatgaaggaatggatgagtaagtatacagataggagctaattaaagaataacaggtgttaaagggagtggtacccactcttatgcaataatttttttttcaaataaagagattatggagctttgggacaatcaggaaaggcagtgatattgatttggtgtgataggcagaataatgcccgcccccaaaatgtccatgtcctaatgcctagaatcagtaaacatgttaccttacaggcaaaagggactttgcaagtgtgattaagttaatgaccttaagatggggagataatttggattgtcagggggtccacaatataatcacaagagttctttaatggtatttcttttttttgtttattatactttaagttttatggtacaagtgcacagcgtgcaggttagttacatacgtatacatgtgccatgttggtgtgctgcacccagtaactcgtcatttaacattagatatatctcctaatgctatccctcccccctcccccaccccacaacaggccccggtgtgtgatgttccccttcctgtgtccacgtgttctcattgttcaattcccacctatgagtgagaacatgcggtgtttggtttttcgtccttgcgatcgtttgctgagaatgatggtttccagcttcatccatgtccctacaaaggacatgaattcatcgttttttatggttgcatagtattccatggtgtatatgtgccacattttcttaatccagtctatcattgttggacatttgggttggttccatatctttgctattgtgaatagtgccgcaataaacatacgtgtgcatgtgtctttataacagcatggtttacaatcctttgggtatatacccactaatgggagggctaggtcaaatggtatttctagttccagatccctgaggaatcgccacactgtcttccacaatggttgaactagtttacagtcccaccaacagtgtaaaagtgttcctatttctccacatcctctccagcacctgttgtgtcctgactttttaatgatcaccattctaactggtgtgagatggtatctcattgtggttttgatttgcatttctctgatggccagtgatgatgagtattttttcatgtgtctgttggctgcataaatatcttcttttgagaagtgtctcttcatatccttcacccactttttgatggggttgtttgtttttttcttgtaaatttgtttgagttcattgtagattctggatattagccctttgtcagatgagtagattgcaaaaattttctcccattctgtaggctgcctgttcactctgatggtagtttcttttgctgtgcagaagctctttactttaattagatcccatttgtcaattttggcttttgttgccattgcttttggtgttttagacatgaagtccttgcccatgcctgtgtcctgaatggtattgcctaggttttcttttagggtttttatggttttaggtctaacatttaagtctttaatccatcttgaattagtttttgtataagatgtaaggaagggatccagtttcagctttctacatatagctagccagttttcccagcaccgtttattaaatagggaatcctttccccatttcttgtttttgtcaggtttgtcaaagatcagatggttgcaggtaatgtggcattatttctgaggactctgttctgttccattggtctatatctctgttttggtaccagtaccatgctgtattggttactgtagccttgtagtatagtttgaaatcaggtagcgtgatgcctccagctttattcttttggcttaggattgacttggcaatgcaggctcttttttggttccatatgaactgtagttttttccaattctgtgaagaaagtcattggtagcttgatggggatggcattgaatctataaattaccttgagcagtatggccattttcacaatattgattcttcctacccatgagcatggaatgttcttccatttgtttgtatcctcttttatttcattgagcagtggtttgtagttctccttgaagaggtccttcacatcccttgtaagttggattcctaggtattttattctctttgaaacaattgtaaatgggagttcactcatgatttggctctttgttgtcagttattggtgtatacaaatgcttgtgatttttgcacattgattttgtatcctgagactttgctgaagttgcctatcagcttaaggagattttgggctgagacgatgaggttttctagatatacaatcatgtcatctgcaaatagggacaatttgacttcctctttttctaattgaataccctttatttccttctcctgcctgattgccctggccagaacttccaacactatattgaataagaatggtgagagagggcatccctgtcttgtgccagttttcaaagggaatgcttccagtttttgcccattcagtatgatattggctgtgggtttgtcatagatagctcttattattttgagttacgtcccatcaatacctaatttattgagattttttagcatgaagggttgttgaattttgtcaaaggccttttctgcgtctgttgagtcccagtttttcgggaggctgagccaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagtcatgcagaagtcagatatgggcttggatggacttaaaatgcaggccctgaaaaaccgccatttccatatccaaagatttcatggagggcaaaccttaactccattctatttttgagggaagtcttctcgacccatttgcacaaatgaatttccttataggcagccttaacaaagaagggggctcatggaatattcattcatttacttatttgttctctgcccaaatattgttgagctactaatgctctcactactgtatacatgatccttgccctctaggaacctatgtatgtaggtaatatagtttggatattttttcctatccaaatctcatgttgaaatgtaatctccaatgttggaggtgggaccttgtgggaggtgtttggattatgggggtggatccctcatgaatggcttgggccttctccttggtgataagtgagctcttgctctgagttcacatgagatgggttcatttaaaagtgtgtggcacctactcccccgactctactgctttctctttctctcttactcctgctttcaccatgtgaaatgcctgctcctgttataccttttgccatgattgaacactcccttaggcctcatcaaaagctgagcagataccaggaccatgcttcctataaagcctgcagaatcataagccaattaaaccttttttctttataaattgcccagtctcatatatttctttatagcaatgcatgaatggcctaatacagcaggaaagacaaataactttaatataagtatagcaggacaggattcttcattcctttaactcttttcatttcttctccttatttctggggcaggggggtgggggggatcaagaattttgtttgtttgttttttgtttgtttttttgaggcagggtcttctttgttttccaggctggagggcagtggcatgatgatggttcactgcagcctcgatctcctgggctcaagcgatcttcccaccccagcctcccatgtagctgggaccagcgtcatgtgccaccacatccagcaaatttttaaaatttttttgtagagatggggtctcactttgttgcccaggctgggagcaaatttttcacataatgatatcaaagttttactattaatgatgtgtaatataagcaagaagaaaggtcatatggtttctctatgctaaaagagactgtaagaagccattggatggaaagatccatcatcatcacctcccgtctgccagaatgaagaatctctggcctttatcacaatcaatattccagcccatttggaaaacctacaggaaggggctggaacatggtagaagggagaggagggagaccaggggctgtcatcagacatgagttttgattggactgaaaggaaagccaataggtaaagtgaataacccttttgtgctaccctctgaaatctgagtgtgtttatgatggactactagttagaaatgggctattcttgcatatcatttcaaggtgttttgcaaaataatcgtggtgttacctaaatcaaaatgtaccgtgttataagagtgacgaagtgacatgggggttccacattagtatgatcagagaagtatcaagcatgatttccaaccccctaaatatctctccataaagagcttagaacctgaaatgttatcattgatgcctaacacatttgtcttaaacattactttctttctacattgtttatttcagcgagcaagccaccttagtcttaaagagttggtgggatgaggggtgggactggctgtaagatggaagatgtacctcttcattctcatttgcaaaggctctgtttttaatcatttttagggatctcactaatactgctaatctggtcgttgtttctcagaactccctgaatatgaagcagaatgcacatgagaatggagtgcaactgaattgctctgtgctagattctagacaagggagagcttgctgctcaggctttggctctgttggaagtaaatcttattctttgggtgataggccctgcccttttaagtggtgcaagattttcattttgtgtacctaaagaaacagatctcaaaataaaaccagctactcagaaacaatgtggctgtgacatgcacaaaatggatacatggccaggagtagtgttcaatatcagccaagaatagtgggctagatgctatcagtgggggctgcttttggtgcttccagaataagctctattcagatatccccatcagtcttccctagaacgttaatgtttatctagtcccacatatgcggttctcttttcctccttctcttcctggcggcttccctgatatgttcaatgcctgaatgcctctctgtgctatctatgggcagaggaaatatagcaggaagtgtagggagcagctcaaaagttgtaataaaatggccatgtgctcattttgtgcatgttgtggccacactgttcctgggtagctagttttattctgagatctgttcctttaagaacacaaaatgaaaatcttgcaccacttgaaaaagtagggcctatcacccaaagaatcagagagcagcaagtgactctcgggtaccttcccctcaccccctacataccccaagcctcttcctccttccattctcaatctcctgatgtacgcttgtcaatataagggacacagagttgagttacatcattaaaacagaccatcattggccaggcacagtggctcatgcctgtaatcccagcactttgggaggctgaagcaggaggatatttgaggccaggagttcaagaccagcctggcctacagaataagaccctgtatctacaatattttttttaaaattagccaggcatggtggtgctggcctgtagacccaactagttatgaggctgaggtaggaggatcacttgggcccaggaggtcaaggctgcagtgagctatgatcatgccactgcactccaacctgggtgacagaacaaggctttgtctccaaaacaatttaacaaaatatagaggaaagaataagttcctggggtttaggaggcctagttgagccattatttagttgtgtgaccttggacaaatctcttttgattcctgggcctcagtaaatgaggggaaaggtaggctgcattgctaaggatcttgaaagttctgatattcaaaaagtaaaaagagagcatacaccttggctctgtgtttgtatccgaccttagacaaatcacttgccctatatgtatctaagtttctctatctagaatatgggaggctgaactacattgttactaatagccctgccaatcctgacatgctatgcagcatttcctgaaaccagaccaggtgctgactacctatgacaaagaaagtcatgaagcattttgggagaagaaagttgtctcttgcttcctggtgcatgtgctcgagggtctggcataactcatgggatgggtccaatttgccaatagttgcatttttgtttgcttgatttcttgtcaagacaagtgtgcaatccattctgtgaatataattaaagcagctgaggagagcacccttcagttctcaagagttagagattctagttctctccaaaggaggaaatacatttgcattgggagctaggtcccagaggatgcctaccaagagctggtgagtgcctaatgcgaggatcagcattgtgaggaggtgatgacctacatggtgtgcattgaggaataatagggagaccatcactgtaaagcatgcttcttccagtgctcaccattatgcctttaattttcccatttaaaagacattcattgcaatattgcagatttcagtcagaggttgcaaactagtggcccaggggccaaccagtgcctgtccacagagcttacttgggcagcacagttttaaagatttggatttgaatacttttagacagagcagtgtctcctgtgagccatagacatcactattcctttttgtattatagcttccttttttattgtgccccaggatacttgaatgccagtgatttatgtggagtcaggttttggctccctactttgtagctcctcctctgttggaagttagatactctggaagctgatcttcttccagcctcggaagtgggcactaggtggtagcttaatggtttaaagagatttgatgtgttccaatacctgcctgaattccaacgaggattttaaatcctgagataacctggttaccttacccatccagagggttctaatctgtaccctctggggtccaaatgtggagttccccagtgtgggtgactgctagctctggcacagaggctcaaacagtttctcccaaacctagtcattgctggggatgagaacaacagctaacaatggaccctggtcacagaagcacttcctacaactggactttagcttgagagagaagaagatgaaaaagaacactgcggccaggcatggtggccttgtaatcccagcactttgggatgccgaggcagacagatcacttgaggtcaggagttcgagaccagcctggccaacatggtgagaccccatctctaccaaaaatacaaaaactagtcgggcatggtagcacacacctgtaatcccagctactcaggaggctgaggcatgagaatcactttagcctgggaggcagaggctgcagtgagccaagattgcgccactgcactttagcctgggtgacagagcgagactccatccctccccccataaaacagaacactgaataatagttttacgttttatattatttaaaattctctttagttttccagggcttgaaaaaagcctctgggaatggctttcagacccaaaggtaaagctttccctggagtaaggtaaagttttccctggagtgaggagaactctttcaggttatgtgcaaaatgttttccttgagttcaccaagtatttaactgctgacttgtttttccagctctcagcctcaaacttccctctaagtcagcctgaagagacttaataggagataaacagtaagttattcaggcttgtcttgcttcccaagtaacattgtgggctcaccttctgctctgaaaatggaggtccagagggaacagacacatgaaagtgaggctggggcttgttgtagggaagttgttaatggcagaggagttctgagagcaaaacaaaatcctgtcaccatccaaacctcaaccttcacgaccatctgggcaacctccccccaccccattttactgacattttgttatctttttcttcaagaaggataagaaaagcaatactattccccagcagaggaggcctacagctatgcctgaaagtcaagaaatttagtgtccagtggtcagtagccacttctgccttctagccctgctaccttctctccaaattttcatttttagttccttcactcatccagaaaaagttcagtgatgtttagagaagacagacaactgcataattcatctaagaaatcctcattaggttcatttcaattaaaaaagaaaagtttggggtattaagaagcatgcctcaattccccaggtaaccttccaccttaatccttgaatatatgttcaccaagattgtacctctggccaccatttcttctcccgctttgtacttcaagtaccatctttccatgattttaagaaatcacgtattttaagacattgatttaataatagctttacaaaagttcactgcattttattttagaaattgcttaatatcaaggaagtatgctaccatctttctgctaatattcctgaacttttgtctgcacctctgacccttctcctgaagttatgtaactaactgcccactggaagtcttcatttaccagttatttactgaggacttactatgagtccagacactgttcaaatccctgtgggtgcagcaaaaataacacacataaagtcgctactcttgtggattttatattctagttgggaaagacagataataaataagtacatggtacaaccaataatagtaatcataataaattatatgaagagaatgagacctgctactataaaggagagtgactgaaaagggaggttgttatagctagggtgcttactgaagaccttcccaatgaggaaacatttgagcagaggtctgaatcataaaaaggatccagctatatgcaggtctggagaagaacattccagacagagtaaacaacaaatataaaggtcctgaggtgagaacgaaaagaaagtcagtgtgactgaagggcagtgagcaactgtgatcataggagaagaggtaggataattaagcagtaaccaggattgggcctgaagtccagggcataaagtttgtattttattttaagtactattcatatcagcattattaataatagccaaatggtgaaaatgactgaaatgtccatcaacaattgaatggataaaatgtggtatatgcacacaatggaatattatgcagctataaaaaggaacaaagtactgatagatgctacaacatgaataaatcttgaaaacatactaagtgaaagaagccaggcacatactatacaattcgcacatttaaaatatgtaattcagtggtttttagtatattcacagagtttggtaaccatcaccacaatcaattttagaacactttcatcacctcagaaataaactgtgtatatagtatattttatttaacaataaaattgttaaaataaagaactgggtttgggacgtgttaagtttgaggaacaagtaggtccttaaatattgggtaggtcattgtatacatgagtctaagaattcagtggggagatccaggctgaggaaataaatataggagggtgtttttcatctctttaaactctatttcttctccctcattcctagtgaagatggagcttttagtgtaatgatgtgccaatagcttgctattaagaactcagtattggcaagaagaaaggtcttaagagtaattcatgctgaaggctccaaaagacatcaaggaggcctctaaaaagccattgaatggaaggatctaccataactctacaagaatgatgatttctcagccctgacatttactaattgtttcctaggattctattcataagttccattatgagtctgttacacatacctctttgtttttattttagggattgctgtaagatttaccatctgcatctttaacttattagattttcttttcaaataatgccgtatcagttcacataaaagaatcttagagcaatatattttccacttctctgccctttgcaatatcgttgacataaattttacatctacatgtttctgaactacacgatacagattattattatttttgctttaaagttttttttttttttttttgagttggagtttcactctttcccccaggctggagtacagtggcatgatctcagctcactgcaccctctgccttccggtttcaagccattctcctgcctcagcctccagagtaggtgggattacaagtgcccgccaccacgcccggctgatttttgtatttttagtagacacagggtttcaccatgttggccaggctggtctcgaactcctgaccttgtgatctgcctgccttggcctcccaaagtgctgggattataggcatgagccactgaagttaattatcttttagagaaatttaatatgagaacatagtttaaaaatatctgcccacagaagctctttagtttaatccattatccttagcacactaacacaggaacagaaaatactacatgttcttgcttataagtgtgtgctaaatgatgagaacacatggccacatagacgggaacaacacacactagagtctttcggaggatagagggtgggaagagggagaggatcaggaaaaataactaataagtactaagcttcgtatctgggtgatgaaatcatctgtacaacagaaacccatggcacaagtttacctatgtaacaaacctacacttgtacccctgaacttagttaaaaaaaatctgcccacatattttccattctggagctctttattcctttgtttaggtcccaatttctatctggcataacttacctttaggctgaagaacttcctttaatatccctgtattacaggtctattggcatgaagtctgttagcttttgcttgtaaagaaatagtattcatcagggatattggtctaaaattctctttttttgttgtgtctctgccaggctttggtatcaggatgatggtggcctcataaaatgagttagagaggattccctctttttctattgattggaatagtttcagaaagaatggtaccagctcctcctcgtacctctggtagaattctgctgtgaatccatctggtcctggactttttttggttggtaagctattaattattgcctcaatttcagagcctgttattggtctattcagagattcaacttcttcctggtttagtcttgggagggtgtatgtgtcgaggaatttatccatttcttccagtattctagtttatttgcatagaggtgtttatagtattctctgatggtagtttgtatttctgtgggatcgatggtgatatccccttcatcattttttattgtgtctatttgattcttctctcttttcttctttattagtcttgctagcagtctatcaattttgctgatcttttcaaaaaaccagctcctggattcattgattttttgaagggttttttgtgtctctatttccttcagttctgctctgatcttagttatttcttgccttctgctagcttttgaatgtatttgctcttgcttctctagttcttttaattgtgatgttagggtgtcaattttcactttcctgctttctcttgtgggcatttagtgctataaatttccctctacacactgctttgaatgtgtcccagagattctggtatgttgtgtctttgttctggttggtttcaaagaacatctttatttctgccttcatttcactatgtacccagtagtcattgaggagcaggttgttcagtttccatgtagttgagcggttttgagtgagtttcttaatcctgagttctagtttgattgcactgtagtctgagagacagtttgttataatttctcttcttttacatttgctgaggagtgctttacttccaactatgtggtcaattttggaataggtgtggtgtggtgctgaaaagaatgtatattctgttgatttggggtggagaattctgtagatgtctgttaggtccacttggtgcagagcagagttcaattcctggatatccttgttcactttctgtctcattgatctgtctaatgttgacagtggggtgttaaagtctcccgttattattgtgtgggagtctaagtctctttgtaggtctctaaggacttgctttatgaatctaggtgctcctgattgggtgcatataaatttaggatagttagttcttcttgttgaattgatccctttaccattatgtaatggccttttttgtctctcttgatctttgttggttgaaagtctgttttatcagagactaggattgcaacccctgcctttttttgttttccatttgcttggtagatcttcctccatccctttcttttgagcatatgtgtgtctctgcacatgagatgggtttcctggatacagcacactgatgggtcttgactctttatccaatttgccagtctgtgtcttttaattggagcatttagcccatttacatttaaggttaatattattatgtgtgaatttgatcctgtcattatgatgttagctggttattttgctcgttagttgatgcagtttcttcctagccttgatggtctttacacttttgcatgtttttgcagtggctggtaccggttgttcctttccatgtttagtgcttccttcaggagctcttttagggcaggcctcgtagtcacaaaatctctcagcatttgcttgtctgtaaagtattttatttctccttcacttatgaagcttagatgaacgtcgatgcaaaaatcctcaataaaatactggcaaaccaaatccagcagcacatcaaaaagcttatccaccatgatcaagtgggcttcatccctgggatgcaaggctggttcaacatacacaaagcaataaatgtaatccagcatataaacagaaccaacgacaaaaaccacatgattatctcaatagatgcagaaaaggcatttgacaaaattcaacagcctttcatgctaaaaactctcaataaattaggcattgatggggcatatctcaaaataataagagctatttatgagaaacccacagccgatatcatactgaatgggcaaaaactggaagcattccctttgaaaactggcacaagacagggatgccctctctcaccactcctattcaacatagtgttagaagttctggccagggcaatcaggcaggagaaggaaataaagggtattcaattaggaaaagagaaagtcaaattgtccctgtttgcagatgacatgattgtatatctagaaaaccccatcgtctcagctcaaaatctccttaagctgatcagcaacttcagcaaagtctcaggatacaaaatcaatgtgcaaaaatcacaagcattcctatacaccaataacagacaaacagagagccaaatcatgggtgaactcccattcacaattgctacaaagggaataaaatacctaggaatccaacttacaaaggatgtgaaggacctcttcaaggagaactacaaaccactgctcaatgaaataaaagaggatataaacaaatggaagaacattccatgctcctgggtaggaagaatcaatattgtgaaaatggccatactgcccaaggtaatttatagattcaatgccatccccatcaagctaccaatgactttcttcacagaaatggaaaaaagtactttaaagttcatatggaactgaaaaagagcctgcattgccaagccaatcctaagccaaaagaacaaagctggaggcatcatgctacctgacttcaaactacactgcaaggctacagtaaccaaaacagcatggtactggtaccaaaacagagatatagaccaatggaacagaacagagccctcagaaataattccacatatctacaactatctgatctttgacaaacctgacaaaaacaagaagtggggaaagcattccctatttagtaaacggtgctgggaaaactggctagccatatgtagaaagctgaaactggatcccttccttacaccttatactaaaattaattcaagatggattaaaaatttaaatgttagacctaaaaccataaaaaccctaaaagaaaacctaggcaataccattcaggacacaggcatgggcaaggacttcatgtctaaaacaccaaaagcaatggcaacaaaagccaaaattgacaaatgggatctaattaaagtaaagagcttctgcacagcaaaagaaactaccatcagagtgaacaggcagcctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccgaattatacatgaaaaaatactcatcatcactggccatcagagaaatgcaaatcaaaaccacaatgagataccatctcacaccaattagaatggcgatcattaaaaagtcaggacacaacaggtgctggagaggatgtggagaaataggaacacttttatactgctggtgggactgtaaactagttcaaccattgtggaagacagtgtggcgattcctcagggatctggaactagaaataccatttgacccagtaatcccattactgggtatatacccaaaggattataaaccatgctgttataaagacacatgcacatgtatgtttattgtggcactattcacaatagcaaagacttgtaaccaacccaaatgtccaacaatgatagactggattaagaaaatgtggcacatatacaccatggaatactatgcagccataaaaatgatgagctcatgtcctttgtagggacatggatgaagtggaaactatcattctcagcaaactattgcaaggacaaaaaaccaaacaccgcatgttctcactcataggtgggaactgaacaatgagaacacatggacataggaaggggaacatcacacactggggcctgttgtggggttgggggaggggggaggggtagcattaggagatatacctaatgttaaatgatgagttaatgggtgcagcacaccaacatggcacgtgtatatatatgtaacaaacctgcgtgttgtgcacatgtaccctaaaacttaaagtataattaaaaaaagaaatagtattcgttttgcttttattcttgaagaacatattcttgaagtatatttgaaacttaaagattagttcctatctggcttgcattgtttgtgctgagaagtctgcagtcattcttatcatttttctctggtatcttatgtgtctttttttcctctggctactactgaaatattttccttaatcatgactttttggcaattttattatgatgtgtctttgtgttgtttgcttggtgtttatccttcatgagttcactgggattcttggatctgtgggtttatgcttttcatgaaatttcgaaaaaatgtgctgttatttcatcaaatacattttccaccttctcctgttgcttctctttgggacctcagttacacgtagattagattgcttaatattgtgccacaaatctctattctttgttgttactgtttggcactttttttctttctatctttcattgtagttagattctcttgctatgtcatcaaggcactggtattttcttctgaagtgtctaatttgcaattaaagtacaaacctttcaacagcacacttcaatttatgattacttttcatattacatattgtatttttcagatttagaagttgcatttgtttcttttttatatcttccctcattatgtttataagttttcctttattttttgagcattcttaaaatagccattttaatgttattgtctactaatttcatcagctctctcatttttttattttatttctattgactgacttctctcctagtcgtgggtaacattttcctttttcttgtatgtctaataatttttaatttagaatagtatgttgctgagtgtctgcacttggttgtcttccttaagaaaatgttgggctttgcctagtaggcagttctgttactctagccagttcattatgatatttttgagtctcatttggaagttttgttatagcagatctattgcatactttacccactgcttgcttatccctaataaaaaactatgttccttcataagcctctacctgattccctgggtattcaacaagttctcgctcctttatctggctggaacttaaatgtctcctatacttgcgtgaactctaaatttttcagctcacagcatcctggtagttgcctttgtcttgaaacatggcatttcaccatatgtatttatgtggatgattcataagcagaactcaggattatgcctatacagatttctgaaggtcttttcctgcatatcgtcttcctctcctgtgctcttgtcaagaaattccactcacctcagcttccgtaaactctagtctctgtttcctgaattcagtgtctgctgagctctgctcaagtttcctcttcatgcagtatggacaaggaagtagggctcacctcaactgttatattccatgatggatcacattctgtgcctgaaaatagttgtttcacgtattttgtccagttttctaaatgtgtataatagggcaacaagtttggtactaagtactccaccatgatagaatccaaagcctctcaaagtattactttaaaaaaatttttaaagcacatttctgacctggctctttctggtctctgtgcctttgctcatgtccaaatcatattcactcttcaagacccagagtatgctatctccttgatgcaacgtttaatatacctctgccagaaacaatctctctttcctttgctctccagggcacgtttatgaattccttcattcactcatttaggaattaaacaatcatataatgagcactttccatgttccaggcactgtgctaggccctgaggatacagaaatacaaactcccttttctttaaagctcatattttgttgagggtggagactatacattgtgatattaatactattgtggcagaaggatgccgactggaccatgtaagcacacacagtggaaggacaagaagtctgctggagaaatccagatacagaaggtttattagtagaagtgataattgctaggagagacgggagggaagagtgttccagatgaaaggactaacatgtactcttaatgtctgtgtaaatccaagtcacactattactctcagtccccccactgctttgtaagctcctggagtatagagattgtgttttgtttatcatcatccccacgccacccccgcccccgcccactgcagatttccaatataagcaccatttataacacactgcaacacatagtaagtatttagtaagtatttgggagtacaaaattataatagcttatttttctacaatagagttatgatcagaaaattacttggaaatgcctaatcctctcaaactgggtacactcgctagactgagaagtgttcccccgagtttcattgatctctgagacatagcgacatcccctttttgagcattatagaaggaagagtctcctatatatagctaggaaatgatatctatacgtggctactgcagatttttgcaatagcttcagggcttccatgtagacatcataaataatgtctgtagagaagttctcatgctggtatattatcttaggtcaaaatgaatcagtttgactgataatctggctaattcagctcaaatcttgtgtttctgtctttattacctagataactgcctgaatcctttgattgggttttgacatgacttaattgcatgtgtattattcatgtctgtcagcctcacactgaaaaccaacattctgatttctgtgttgcactagaaaggggtctgtatacctggattctgttttcagctctgcaagtctcatcatgtctctgagactctctcatagagatgataataatacttagaatatcattagtattttcatgcctcatatttgaagtgaaagtatttttaaatcatataaagtgcttaaagatgtctgaagaattattctacacatgcattcatgtatcacttaattaactttgtcagacagttttctcactgtgcaaaaaacatagactgtgcttatacaaacctagatggtatagcctactacaaacctaggctgtatggtagagtctcttgctcctaggctacaaacctgtacagcatgatactgcactgaatactgtaggtaactgcaacacaatggtaggtatttctgtatctaaacatataaaaggtacagcaaaagtaccttactagacaaggaagggcattacataatgataaagggatcaatgcagcaagaagagctaactatcctaaatacatatgcacccaatacaggagcacccagattaataaagcaagttcttaaagaactacaaagagacttagactcccacacaataatagtgggagactttaacaccccgctgtcaatattagatcaacgagacagaaaattaacaaggatattcaggacttgaactcaagtctggaccaagcagacctaatagacatctatagaactctccacaccaaatcaacagaatatacattcttctcagcacctcatcacacttattctaaaattgaccacataattggaagtaaaacactcctcagcaaatgaagatgaatggaaatcataacaaacagtctctcagaccacagtgccatcaaatgaaaactcaggattaagaaactcactcaaaacctcacaactacatggaaactgaacaacctgctcttgaatgactattgggtaaataacgaaattaaggcagacataaataagttatttgaaaccaatgagaatgaagacacaatgtaccagaattgctgggacacatttaaaccagtatgtagagggaaatttatagcactaaatacccacaagagaaagcaggaaagatctaaaattgacaccctaacatcaaaattaaaagaactagagaagcaacaacaaacacattcaaaatctagcagaagacaagaaataactaagatcagagcagaactgaaggagctagagacataaaaaacccttcaaaaaattaatgaatccaggagctcattttttgaaaagatcaacaaaatagatagacaactatccacactaataaagaagaaaagagagatgaatcaaatagatgcaataaaaaatgatataggggatatcaccactgatcccacagaaatacaaactaccatcagagaatactataaactcctctatgcaaataaactagaaaatctagaagaaatggataaattcctggacacatacaccctcccaagtctaaaccaggaagaaatcaaatccctaaataaaccaatgacaagttctgaaattgagtcattaattaatagcctaccaaccaagaaaagcccaggaccagacggattcatagccgaattctaccagaggtacaaagaggagctggtaccattccttctgaaactattccaaacaatacaaaaagagggaatcctccctaactcattttatgaggccagcattatcctgataccaaaacctggagagacacaacagaaaaagaaattttcaggccaatatccctgatgaacatcgttgcaaaaattctcaataaaatactggcaaaccgaatccagcagcacatcaaaaagcgtatccaccatgatcaagttggcttcattcctgggatgcaaggctggttcaacatacacaaatcaataaatgcaatccatcgtataaacagaaccaatgacaaaaaccacatgattatctcaatagacgtacaaaaggcctttgacaaaatttgacaccccttcatgctaaaaactcacaataaactaggtatcagtggaatgtatctcaaaataataagagttatttatgacaaacccacagccagtatcatactgaatgggcaaaaactggaagcattccctttgaaaaccagcacaagacaaggataccctctctcaccactcctattcaacatagtattggaagttctggccagggcaatctggcaagagaaaggaagaaaataggaagagaggaagtcaaattgtctctgtttgcagatgacatgattgtatatttagaaaaccccatcatctcagcccaaaatctccttaagctgataagcaacttcagcaaagtctcaggatacaaaatcaatttgcaaaaatcacacacattcctatacaccaataacagacaaacagagagccaaatcatgagtgaactcccattcacaattgctacaaagagaataaaatatctagggatccaacttacaagggatgtgaaggacctcctcaaggagaactacaaaccactgctcagcgaaataaaagaggatacagacaaatggaagaacattccatgctcatgggtaggaagaatcaatatcgtgaaaatggccatactgcccaaggtaatttatagattcaatgccatccccatcaagctaccaatgactttattcacagaattggaaaaaactactttaaagttcatatggaaccaaaaaagagcctgcattgccaagtcaatcctaagccaaaggaacaaaactggaggcatcacactacctgacttcaaactatactacaaggctacagtaagcaaaacagcatggtactggtaccagaacacatatatagaccaatagaacagaacagaggcctcaggaataacactacacatctacagccatctgatctttgacaaacctgacaaaaacaagcaatggggaaaggattccctatttaataaatggtgttgggtaagctggctagccatgtgcagaaaactgaaactggaccccttccttacaccttatacaaaaatcaactcatggtggatcagagacttaaacgtaagacctaggaccataaaaatcctagaagaaaacctgggcaataccattcaggacataggcatgggcaaggacttcatgtctgaaacaccaaaagcaatggcaacaggagccaaaattgacaaatgggatctaattaaagtaaagagcttctgcacagcaaaagaaactatcatcagactgaacaggcaacctacagaatgggggaaaatttttgcaatctatccatctgacaaagggctaatatctagaatctacaaagaacttaaacaaatgtacaagaaaaaaacaaacaatcccatcaaaaagtgggcaaaggatatgaacaaacacttctgaaaagaagacatttatgcagccaacagacatatgaaaaaatgctcatcgtcactggtcattagataaatgaaaatcaaaaccacaatgagataccatgtcacgccagttagaatggtgatcattaaaaagtcaggaaacaacagatgctggagaggatgtggagaactaggaatgcttttacactgttggtaggagtataaattagttcaaccattgtggaagacagtgtggcgattcctcaaggatctagaactagaaataccatttgacccagcaatcccattactggacatataagcaaaggattattaatcattctactatatagacccatgcacacatatgtttattgtgtcactattcacaatggcaaagacttggaaccaatccaaatatccatcagtaatagactgtataaagaaaatgtggcacatatacaccgtggaatactatgcagccataaaaaaggatgagttcatgtcctttgcagggacatgaatgaagctggaaaccatcattctcagcaaactatcaaaagagcagaaaaccaaacaccacatgttctcactcataagtgggagtcgaacaatgagaatacatggacatagggaggggatcatcacacaccaggccctatcagggggtggggtgctaggggagggataacattaggagaaatacctaatgtaggtgacgggttgatgggtgcagcaaaccaccatggcacgtgtatacctgtgtaacaaaactgcacattctgcacatgtacaccagaacttatagtataattttttttaaaaagtaccttactataatcttatgggaccaccatcatataagtgctccatcattgtcgaaaagttcatgacacaaaacatgactttattttgtatatgtattttggcattagtagagtcacagtggtatggtagtaaaattagtggccttcaggtatgtctctgtataaattagcttttgtccttgagcaagtcattttcctctttgtagccttagtttcttcatctctcctttttgagatatcattctgggtatcttaactgaaattcttttcatcctttgaaatacatagtgctattaggatgccatcttaatctgtttgtgctgctataacaaaatacctgagactgagtagtttataaacaatagaaatttatttctcacagttctgaaggctgggaagtccaagaccaactggcgctggccagttcaatatctggtaagggtttgctctctgctttcaaggtgaccccttcccactgcatccgcacatgaaggaagtgagaagggacaaacactatgtcctcatgtgctagaaggggcagaaaagcaaaagtgataaatacgttccattgagctcttattataagagcattattgccacccatgagtgtggagcccttatagcctaatcgccttctaaatgcacctacctctttatagaattgcactgggaattaagtttcaacatgaattatgtaggaacataaatattcaatccacagcattccactcctgcccttccccccaaaaaatttatgttaaaatatacaaatattccttcccaataggcctagaaattttaacttattacagcatcaactttaaagtctaagtccaaaatctcatccaaatattgtctaaatcagatatgggtgagagacccaaagtatgattcatcccgaagcaaattccccttctagctgtaagcctgtgaaatcaaacaagtcacatgcttccaaaatagaatggtgggacaggtgcaggttaaacattttcattccaaaaagaagaaagaagaaagggataataggtcctgagtaagtccaacccccaacagagcaaacaatattcaatcttaaggctggagagtaatcttcctttattccatgtcctgccctctggacaccctggggtagaagttgggttgccaaggctccaggcaaccttgctgccatggctttgcttggcacagccatactgaagctctcccaagtagagtcttgtgcctgtggctctcccagtgtacagttacatgctggtggccctagctctagagttctgggttcttggggtcacccctgctcccatggatccaatggacattaccctagtggggactctctgtagtggcccactaggcaccactgagcattgctttagtggaaactctctggtgcctctgcccctgtggcatttctctgccttggcccttaagctttccagggaatcctttgaaatctaggtgaacgtagccatgcccccacagctcttggactctgtgtgcctgcagagttagcaccacgtggatgctatgaaagtttaccccatgtgcctcctggagaggtagcccaagctgcagctgggctcacttgagccacatctgaagagactgaagagtgctgcattggaatacatggagcagaaacttgacactcccctgggcagtgagacttgagaacccaagttgatgccttctcattgtattctcacttgatggaaaggtagaagagataaactgtgtcttcacatggcagaagagatggaagagatgaatgctgtgtgctcatatggtggaagagacagagaagcaaaagggataaactcactctttcaagccttttcataagggcactaatcccatctatgaaaggtggagccctcatggcctaattacctcctaaaggccccacattttaatactgttgcattggagagtaagtttcaacaggaattttgaagggacacaaacaggcaagtcctaggagattttcaagtgccttagttgaagtccaatatttttaaaggtccaggtccaacatttagatgttgagatcaacattttagcctttagatgataacaaagactccaaaaagaaggaggggaaatgggaggctgatatgcatagaactaaatctattgacctacaacccaaagatccagctgagaatgttaagacaggaatgtctatggagaagaaaggagtgtgattctgaaaatttcgtttggaagctgaatttcatttctctgggaaagtagggcacaatatccaagatggagggcagggatacttatgtccagcattgccccatataaacataagctttacattagggcatcacaaaaataatgggcaaattattgctggaggctttcccacacatacattaataacctagtgccatcattttgaggaacatgaagagggtcagctagagtcagtccatatgacagcatccctggaaatacttctcagagggaatggccatttggaattttgatggtggtagcatcattggaaggctcagtggcagtttgcattagcagtagcaatggaaaatataacagtccataaacattgcacagcaatgggtagactccttaaaaaacagagtttctcaaccttggtactgttaatgtttggagctgaatcattccttgttgtggggagctgtcctgtgcattgtagaatgctgagtgcaaacctgacctctatccactagatgccaatagaattcccctagttgtgacaaccgaaaatgtgttcagacatgaccacatatccccttggaggcaaaattcctgattgagaagcagtgctctagggaatgacagaacactaagggtagattgaatctcaggccatcagggtgaaccatggattccttgcagcacctgttttagcacctctcacctagatatgttaagaacaatccgagattcaatagctgaatgcaaagtggaggagaaagtagtgagtaaggcagtctgggcttctactcaccctgtaagccaggaggaggagagatttccattgttgagtacaaagaaccaggctttagtttcagacagacttgtttctataatactctgtcactttctagttgttgagtcctggtgaagtggcactacctccctgaatctcagtttcctcaactgtatctacacaaatttgatttttattttgttatttataatcacaacctcttttggaggagggtgcatctctccaagtgacattttagaacacatattaaaatggggggaaaatacccgacaaagttgtatgagaatgagagataatagataataatgaaagtaaatagaacacctgaaactaggcctggcacatgtgctgattctataaaggatgactattgttaagttgaatatttctgaaatataattggtggaggcttagtcagatatactattttgccttttttttttttttttggtagttctatttgacatcacccacctattacattaagaatcctcctttctttaatctccatctccacctgccaactatatctagagagggttatcagtctgtgaccttttgctactttcagagtaaccatgggggctcagggcctctcttcttgtaatcccatttcccttgtttaccttggtgtttctttgatgtgaaccttcctgctgactgtacctgtaagagattatccattgtgcttttgcctcttctctaagcccccagacatttggaggtatcattgcttaatctttgtgtttcaccatcagttaaggtcagaagcctttgatccatcctgtttactagaccctacattttaacacataaaactgctgacagctatatttttattaaatttattttcctgggttttagtcatagcactaaacttcaataccaatatatcactacattaaaaaaaactatcatcagtgtgtgtttacagttaccatagcagtaaaatttgtactcaacagcattattacaattttctcctatttacaaggtatatttgattcatgttttaaaaccaacaaaggaaaaacgtaaatagaattattgctgtcaacactactgcaattttttctacccttaacgctcaccaccagtgatagatataacaacggattgcctgtaaacacataaaagcccttctcagaaaaaaatgggctttttgtatccatcatggtgaaatctgggtcctttgataggatgactgatgagagagaagataagaaaaggtgataaggcctacctttctgcactctacaccagcaccctgtggacacattaggatgaacactggcctgactcctcttagtttcccaagatcaagtgacccatactacaatttgctactgatagatggggcagccctgggctctagcaggagcaagtagatgatgaaatcttgcccactcctaattatttttccaccctacaaagtgatcctctgggcaggaagtttaatgggatactgtatagccccaacagttttcatgcctgctacatttacttgctagcctcagttcctgtggctcctgagcagctggctgtctgaaccccacccctttctccttactgtacacctacagaaaaggagagttggtggaggctctcctgtaggtgtacagtaaggaggctcagctctgtggaggtagatactgttgggagttggtttctgggggacccaagttagaatgggggtatcctatctgaagcaatatggggagcatcaaataataagataaagtcaatactgatggaaaaatctaaaaggccagtagcaacatgagggttgtgagtttgtatcagtgtgagatgggattagagtgacagccagtaaaaaataagtcagtgtgtcctgttgggtctttgctcatagccttgcaggtagtacatccatggtgtgtgtatagattgggatggctgcagtccctgagaacctaaatgctttattgcttcaattctgtatatgtactacgtagcaagtatctactcgccaaacttaacaataatattccttcaagaaggaaacaaagaaggtcattgtaaattgagttcctttcattgttttcttccaagagtgaagcctacaaaacaatatattggttctgaaatgtcctgatcctccccttctcctcaacctcgttttagcttcaacatcttaaagcagtaacgttttgtgggcttggcgcaagtggctaatgcctgtaatcccactgctttgggaggataaggtgggaggattgcttgaggccaggaattcaagaccaacctgggcagcatagcaagaccctatctctaccaaatttttttttaacttagccaggtgtggtggcgcatgcctgtagtcccagttacttgggaagctgaggtgagaggatcgtttgagctcaagaggtcgaggctacagtgagttgtgatcatgccaccacactccagcctgggcggcagagcaagacccatctcaaaagaaaaaaaaaacaacttatttgtggaatagccttttgttttgagaggatttattacattgaaactcttaatggcttaacaatttctatttcatattcttctcagagcaaaagtggatccaaaagagctaagtagtcataaagtaaggaagaatgaaaaccccattttccttctatcttgttggaggcccttgagaaatagattttggaagatttgccacagggcttccatagaattgactccagaaaaagttttcattaagcctggcacacaaatactgaaacccaaatgagaaaatggattaaagtgataaaaaatgttcaaatgttgtatgcatagatgtttttgtgtggatgatgtgtgatgtatccttttgtttataaaggtaaataatcgacaaatacagactgcctgtctagattcaggaatagtcaaagactttaagacaaactcagtgatgtttggctctgagcctcacacattttgcttactaaaactacaacctcttctctcaacctaggcatctcatttgcccttataccccaagaggctctttctgtcatgaatcgtcgttctctgtagcttttgctcttgccctcatgctttggtttcattttcagtgttctactttatcactttcaaagttggagaacaattaccatactgaagtgatttcagatttcctggccaaatacagattatctagcattcaagagaccacagttcttaaactcttgctctccacccccatccccaagagaatcttcgattttgagtaatgtaggacaatttcatcatgaattgtttgaagggacattttagtggcacatcttcatgctattctgggaatactatttccaacctttcttccctggaaccacagtacaggatgttttgactttttgactccacaatccgccattccttcctctttccagaggtcttcttgaatatttttttctgtgaattgctctttgatctctaaatccccttccatatttctgccagatggccccttacaaaaataggagtaactttggctgtccctgctatcctctagtttctaatgtaggtttttaattcaggcccctacaaagaccttgctgtagtctctccccataacatttttatcattcctgtaaagttctcacttttacccaagatctcccccttttaaatgatgactttgagagcattccttcaatagttattaacttcagtagctaccctgcatccagcttcatggtatagagtaactactcaaatatttgctgaatgaaccaattaatgaaaaacacgatagaaggaatgattgaatcagatttctaaagtgccagactgaatagggagtagaagtcaaccaagacaaagtttcacttggggctcatccatccctatatttctgtttttgtttgtttgtattttaaaccatggtagaggtagccctgataggactcctagtttagaggtatgctctaccctgctcaaatggcaggagctggatcaaaatggacagtgtttttcatacactaatttttttcctggtccaattcattagcaactccctcagtcttgaattttgactcacagtcgttccctgaattcatgatagccacagactgtggttcccatgatctactcctgctttatagtgctgagcctaagggaccaacatcctgggctaaaatatggcaaaagacaatatcggcaaagtccatttcactgtatgagttgatctcatactgattattttgccatctcttcataaaggccgtcaagtccaagctgaagagaaacaaagggatatttatggtctcagcctacttttttgaggcccagggagatgcggacctcatgcttttctgttgttttgacctcccccagatacatcatagcttccgaaactccaggggtaaattctggtttcagatgcatccagcctatagagaacaaacattatcgtaagaacaatataacagcgggcttgccccagaattacttgccctgtatacttggctcatgacttctctatatccatttccccctttgttcttaacagaattctttattcaggacagtctaccctgtggcttaggggtgaccatgtttcagggttctggctagttaaatgtaagtagaagtctaatagataagactatagggaaaactgtttctaagaaggtggagactcacatatcatatggattttgcctttgctcttcaccccttttccctgccttgaacatggatgcagttcccggagctatgattactctcaaacccataggaaaaaaagccaaatagtaagaaaggcagaaaaggaagactggagtgaggactgaccttgagtaattaaaccaactctgagctgcccacctccaaacttgttgtaagaggagaaggagaagcccctgccagggtatacctctttcatgcaagtttctgctcttctttcaccacaaaggccctttcgagactttctatggctgtctctgctactttggttgtccctcttttcatttctcttcttccttaagtagttttgcttttagttggaagagattgggaggcagacactttcattttgcaggtatatggagcttacgctgagtttgggtgaaacccagtctcaacctaatatgaggggtcttcagaaagttcataataatgcatgttatgaaaaaaactgtgcaaggatttcaatttctttttgtgccaaaataagctcatattaacagttacaacatgtctgaacaggatctagtttgaggtgctaagaagtataagtaatcagtttgaaaagagcccctctcagagcaacatgaatcctgctaaaagtaaagcaagaacaaacatcaaatttatggtgaagcttgggtggaagaatggagaaatcactaatgctttacaaaaatttatggggacaagccccacctcaaaaaaactggcaatttgcaaatggatcactcattttaagaagggagaagacaatgttgaagatgaagcccacagtggcaaaccattccatcaatttgtgtggaaaaaaatgtatttgttcttgccttaattgaaaaggaccaatgattaataccagaaacaatagccaacatcatagacatctcaaatggttcagcttacacaattctgactgaaaaattaaagttgagcaaactttctacttggcgggtgccaaaaccactgcacctatatcagctgcaaacaagagcagaactttcggtataaattttaaaaagtgggttcaggatcctaaagcatttctccaaaccaactgtaacaggagatgaaacatggctttaccatgtcttgtgatcttgaaaacaaagcacaatcaaagtaatggttaccaagaggtggaagtggtccagttgaaacaaaagcagatcgatcaagagcaaaggtcatggcaacaattttgtgggatgctcaaggcattttgcttttgcttgctgactttctggaggaccaaagaacaataatatctgcttattataaatgtgttttgagaaagttagccaaagctttagcaaaaaaatgaccaggaaaggttcactagagagtccttctccaccatgacaatgctcctgttcatacctctcatcaaacaaggacaattttgggaaaatttcagtgggaaatcattaggcatccaccttacagtcctgatttggctccttctgagttctttttgtttcctaatcttaaaaagtctttaaagggcacccatttttcttcatgtaataatgtaaacaagaccacattgacatgattaaattcccaggatcttcagttctttagggatggactaaatgactcagatcttcccttacaaaactgcttgaacttgataaagtttatgttaagaaatacaattaataattttttctatcatttacttctactgtccatgaactttgaagaatgccctcatatacagactcccattatctatggcaaaagtaaaaaaaaaatggtggttcaaagggggaagatatagccttctcagtgttttaaaagatttgaatccattgtcagcatttaaaaataataatatttttcataaactctagattttcagcatctctaacaacactgggccctcattagctcatgacaataattgactaaagtagcaaattcttcatttagaagggagcaggcacgctccagattgccacagttttcagccttcttgcaagtgatacacttcatttctttttaatacctgtcttgccctataggtgtttgagttttcaataacttatttatggattctttgaaggataattagtaatactttttctatttcaaacccctaggcagaaacctctgcctcctctaataactgtcaaggaaaatatgaccagcctgcaactgcatctctccatactcctaaacatcttagccagtgtccccaagaaattcatctgttacaaatgcactggaaatgtatttgtaacaggatgttacctcgagcatgggacccaaaggcaattagattcttcttttctacatctgacacctgccattcttgagacataattttggtgtcttcctcaaaagcatctttccctacaaatgagtaagcactacttaataataacctcagtttggaaggttggcaggtataattattataagaattattagttccagtagctcttctctaaatctacttctttagagcacttggaattggagaacgtttcatatctatgccataactgatttaatttctgtttcttctctaggataaatcacagtaatttgtagcttcaatgtttctattgctgtaaatggatacaaactctttgggaggcgatctgggaaaacttactaaaattttaaatgtggacatcctttgattcagcattgcctcagctaagaaactttccttaaaaaaatactttcataagtataatacacacacatgcacacacacacgtgtgtatgtatgtatgtatgaagaatttttttctagccatacattgggagcaatgaaaatgtccagtaatagggaactcagtaagtaaataacagtaatccagtaatatggcatctagaggctctcagcgaccctattgtttcagaacaactttttagttaatttctggtctaagaagagtagtggggaaaggatgatctttttaagagctgaggaaaaagttgaaactcaatctttacctctcactacatgcaaatacttacttgaaatggatgatggacaaacacataaaagctaaaagaaatttttagaggaaaactttggaatctttgtgaccttggggtaggcaaaaatgtcttagcttattcatttgagttgcttgtagatgctgaatattagccctccatcgaatgagtagtttgcaaatattttttcccattctgtaggtggtcagtttactctgttgattgtttccttgctgtgcacaagctttttaggttaactaagtcccatttctctatttttgtttttgttgagtttgcttttgaggacttgatcataaattatttgcctaggccaatgtccagagagtgttttctaggattttttttattatactttaagttctagggtacatgtgcacaacgtgcaggtttgttacatgtgtatacatgtgccatgttggtgtgctgcacccattaactcgtcatttacattaggtatatctcctaatgctttccctccccctcccccaccccacaacaggccccagtgtgtgatgttccccttcctgtgtccaagtgttctcattgttcaattcccacctgtgagtgagaacatgcggtatttgggtttttgtccttgcgatagtttactgagaatgatggtttccagcttcatccatgtccctgcaaacaacatgaactcatcctttttatggctgcataatattccatggtgtatatgtgccacattttcttaatccagtctatcattgatagacatttgggttggttccaagtcattgctattgtgaatagtgccgcaataaacatacatgtgcatgtgcctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaattggtgtgagatggtatctcattgtggttttgatttgcatttctctgatggccagtgatgatgagcattttttcatgtgtctgttggctgcataaatgtcttcttttgagaagtgtctgttcatatccttcgcccactatagtttcgggtctcacatttaggtctttaattcatcttgaattagttttgtatatggtaagaggtaggggtccagtttcattcttctgcatatgactagcctattttcctagcaccatttattgaatagggtatccttttcccagtgtatattttgttgactttgtcaaagattagttggttataggtattctgagttgtttattctgtcccattgaagtatgtgtctattttgatatcaatatcatgctatagccttgtagtataatttgaagtgaggatatgtgatgcctccagatttttttcttttttgcttaacattgctttggctatttgggctgtttttcgttccatatgaattttggaattgctttttctaattccatgagaaatgacatcagtaatttgataaggattgcactaaatctgcagattgctttgggcagaatggccattttaacaatattaattatttccatccataagcatgggctgtttttccatttgtatcatctacgatttctttcatcagttttatagctctgcttagagagatatttcaccttcttggttaaatatattcctaggtattttatgttttttatgtattttatgatttggtccttggctggatcattattggtgtacagaaatgttactgatctctgtagttaattttgtatcctgaaactttactgaattcatttaccaaaatgaagagttttttggtggagtctctagtgttttcaagatatcagatcctatcattggtgaacaaggataatttgacttcatcttttccaatttagatgtcttttttttttcctcttgttgattgctctggcaaggacttctagtactatgttgaataacagtggtgaaaatgagcattgttatcttgctccagttcttagagggaatgctttcaactgtttctggttaagtatgatgttggctttgggtttgtcaaatattacctatgttattttgaggtatgtttcttttataccagtttgttgaggatttttatcacaaagtggtgctgaattttattgaatgctttttctgcatctattaagatgattatatggtttttgtctttaagtctttttgtgtgattatcacatttattgatttgcatatgctgcactatccttgcatctctgggagaaatcccatctgaccaaaacaaatagccccattaaaaaggggacaaaggatatgaacagatatttttcaaaagaagacattcaagtggccaatgaacatatgaaaaaaatgctcaacatcactaatcatcagagaaatgcaaattaaaatcacaatgagaaatctgatggcagtcagaatgtctattattaaaaagtcaaaaaacgacagatgtttgtgaggatgtggataaggaggaatgcttatacactgttggtgggaatgtaaattagtgcaacctttatggaaaagagtatagaaatttctcaaagaactaaaaacagagtcatcattcaattcagcaatcccactactgggtacctatccaaagggaaagaaatcattatatcagaaagatacctgcactagtatgtttttcacagcactattcacaatagcaaagacattgaatcaacctaagtccatcaatggatgattagataaatattagataaatattatgtatacacacacacacacacacacacacacacactatggaatactactcagccataaaaagaatgaagtcatgtcttttgcagcaacatggatgaaactggtggccattatcctaactgaaataattcagaaagtcaaatactgcatgtcctcgcttataagtgggagctaaacaatgggtacacatggacatgcagagtggaataatagaacactggagcctacaagaggtgggaggatgggaccggggtgagagttgaaaaattacctattggacacagtgttcattattcaggtgatgggtacactgaaatccagacttcaccactacataatacatgcatgtaaaaaatctgtacttgtaccctctaaatatatataaaacttaaaaaacttagaattcaattaaaaaatgtaactggctctacatacacacacacacacacacagagcatgtgtgtatatatatgtacatagtttattataaattttactgatataaaagatacacaatttaccaaaaataaataatatacagtattctttatcataagttccatatagccaattgaattgtacagaatgctttgatttttgctgaactgttgtatccatatgcaacctctaattgcaattcagccattatttgacaaatgaagttgaattacaatttggtaactctttcttcaatatatgtattgtgattgaatctgaatcacaatacactcttgtaaaaaaaattattaggacacaaaaaatgtgaaccatgtaaaaacgtacaatgaattgcctcaaaactaaactttatgctctttaaaaatacactgttaaaaaatgtcaaggaaagttaaagatgaaaatattcacactgcatatatctaatgaaggaattatatccagaatatataaagacttaaaatttgattacaaaaagataaacaatctacttaaaatggataaaaatattcaaacattttgcaaaaaaagttgtataaatggtcaataagcaaatgaaagatattcaaaatcactgggcatcaagtaaatgcaaattaaaacagcagagtcatagcactacacactcattaagataggtaaaactgaaaaatactgacagtacttggtgttggtgaagatgtggagcaactagaatgcaaatacattgcttgtcacattggagaagggtacaacaaccactttgaaaatagtcactaagaccaggagcagtggctcatgcctgtaatcccagaactttgggaggccaaggagggcagatcacatgggtcaggagtttgagaccagcctggccaacatggcaaaaccccttctccactaaaaatacaaaaattagccaggcatggtggtgcacgcctgtaatcccagctacttgggaggctgaggcaggagaatcacatgaatctgggacgcagaggttgcagtgcaccactgcactccagcctgggtgacaaagcaagactctgtctcaaagaagagaaaagaaaagaatagaaaagaaaagaaaagaaaagaatcactattaagtgatttactcaagagaaaggaaagcatatgtccattaaaaatttgaacttaaacatttatagcagttttattgaactatcagcaaactaagtgtccatcaaagggtgagtaaataaaacaagttatagtatatacatacaatggaatattgtttagcactaaaaaagaaattaacttacaacacacatagtgacatgggtgaatctttggaagtttatggtgatcaagatagccagacacaaaattatacatattttatgaatccatttatatgtagctccaggaaatgcaaatttaatctatagtgatagcaattatctagagctggtatgggtagaagggaagggtactaactgggaaggggaatgaaagagttttctgttgtgttggaaattatctatttgttggttatggtactcattacataactgttacatgttaagtttttcagaagaagatgctgaattgggggcataagttgtttattagggatcaaaacctgtgaaggaagagagagaaagccatattagggagtggaagttgttgaactatgacacaggaacagtaaaacctctgtcaatctgaagtattgccaataagagtgtcccacatcaggcagaaatacctgagcctttatattctggctttgctaggtcactgggtatggcctgccttaggaagtttgtgacctggaacatgttgcttctctgtatttgagaaagaacctgaagaagctgacagtggatgtaatctgctgactgcattccccacagttggtggtggggattgatgtgttggtggggggatgtgcacatggctgtgttttcagcaatgtgtgtatatatttatcaaaaataattaaactctgtgcttaatatgtgtgcatttttttgtttcttatgttttgttttcttttgtttttttgagacggagtctcactctgtcacccaggctggaatgcagtggcactatcttggctcactgcaacctccgccacctgggctcaagcgattctcctgcctcagcctccagagtagctgggattagagacatccaccatcatgccctgctaaattttgtattcttagtagagatggggtttcaccatgttggccaggctggtctcaaactcctgacctcagctgatctattgtttctaaattatattttttaaagctgattttgcaaaagaatgttaaacagattagatagtaagcatgtataacagtctcggtacacattttatgtacaaaatcttaattatgtctaatctagcagcttaaaaaaattgacaaaaataaaatattggaccaaaatggcatgtaagttgtcattgttgttggcaaaaatggaaatatggttgataagaattaaaatgtattaagatccgtgtactgtttgggagggagattaaggtactgtttttaactttaggttgtgttatgaaacaacattttaatgataaccacctaaaaatattatttggtgtaaaattccaaactgttacaggaaaaaaggatggaatgtgaaaaaagcaataattgtactataatttaatcaggggagagagacaatgagagagaagtattaaaaatttcaaatagaaataaagcagtgagatgatagagacaattataaacatataacaaatctgataaagtaaacccttcccagaagaattgaaataataagctgtcaaaagatatactaggaaaaaaatatgtatcagacaaaatagtagacaaaacggaagctatgatcgcaatattactaggaaaattttacaatgaattattagagataaacagggtcaccacagaataaaaggctaaaattgctagaaatatgtagcaattctaaacttatttgcatatatacatagcctcaaaaaggcagtaatagaaaaagagaaacaaaatgtcataagtcgtatagaaaacaagtagcaaaatggcagacacaaatcctaccttattagtaattatgttaagtgcaaaaagactactccaaacaacatatagaaattcacagattggataaataaaacatgatctgacaatatgctatctacaagaaatactttaaattcaaagacacaaatatgtcaaaagtagaagcgtagattgatgacttaaatataagagctaaaattataaaactcattgatgaaaacacagaagtaaatcattgtgacctgggttaggcaatagtttcttagatgcagcaccaaaagcacaatgtcaaaagaaagaaatagttaaattggacttcatcaaaattaaaaacttattgcttcaaataataccatcaataaagtaaaggcaaacgcagaatgagagaaaatatttacaaatcatatatctgataagacgtgtgttcagaatatgtaaacatttcttataactaaacattaaaaggaaataaatcagcttaaaaatggaccaaggaactgaacagacatttcttcaaagaaaatattcaaacaaccaataagtacgtgaaaggattctcaacatctctaataattagagaaatacaagtcaaaaccacaatgagagccaacctaatacccaatagatggcaatgttaataataataacaaaagacaataacaagtgttagcaaggatgtggagaaattggaatcctcttaaattgctggggagaatgtaaaatgatgcagctgctttggaaaacactctggaaactcctcaaatggctaaatgtagagttagcgtatgatccagcaatctcacttctaattatatacacaagagaaatgaaatcatctgctcacacaaatatttttacacaaatgtttcatagcagcattattcataatagccataaaatggaaacaaccaaaatatccatgaattgatgagttgataaacataatgttgtatatccacccagtggaatattatataggcatcaaaaggaatggagaactgaactgatacatgctgcaacatggataaacttgaaaaaaaattataacaagttaaagaagccagtcatgaaagactacatattgtatcatgccatttatacgtgatgttgagaataaccaaattcatacagaatgaaactaaattagcatttgctagggactgggaaatggatccaatgggcaatgactgctaatgggcacagagttgctttttggaataacaagaatgttctaaaattaggtagtggcaatagttgcacaactcagtaaatattctataaaccattgaattaatagagggaattatatattttctgatttatatctcaaaaggagttatgttaaaaaggatttgaataagctttccataaatttttttttttaattaagcacccttttgtgacacagaatttcagcaatctaggaatagaagggaacttccaaaagttatttgagatccctagcaaaaatctacagcaaacatttctttttttatgggagagaaagttagaaaaattcagattaaaataagaaacaaggtaaggctgactattatcaccacccctggtcacctttgtattccagtttctagcccatgcagtaagataagaaattataattaaagacagatgaatgaagaaaatggaaacaaaagcactcttgttagcaattgatataattttctacacagaaaacctaaaggaatgcacaaattattacatatataaatagtgtttgcaatatggctaactatatgagcaatgtacataacctaatttcatttgtatctaccagcaataaacattttgaaaatataagttgaacaaaatataccacttaccatatcaagaatatcaagtacctaggtgtaaatatataaaaaatgtgcaaaacacctatggagaaaattgtaaatgtttttctgaagacattaaagaaataatggagaattaatggagagatattttctcttcatgtatatgaaggcttaacattttacatatgtcaattatctccaaaaatgtctatagattctatgcaattctgataaaaactcccaaaaccatattctaataagccaattcaaaatttatatgtaagagcaataggccaaaaacagacaagacacttgtgaaaaaaaaggtcaaaggaatctgccctacttgcttcgaaatttattttaaatctagaccaattaagccagtgtcttttattaaatgaagggacaaataaaataaccaatgtaaagtaatagagaacccagaaacagaaatgtgcatatagaatcttagtatgtaacagaagcattgaaatctctgtgtaaggaaagtttagttgttcaataaatggaactggaacaattggttatgtatatggaaagtgaaataaaaccatcgtttcacaccctacagctaaataaaaccaaatggattaaggactaaagtgtgaagctacccaaattgaatcaagaacacaatctcatttataatagccaccccccccaaaaaaaaaaaacctaggaatacatctaaccaagaggtgaaagatctctacaaggagaaccacaaaacactgatgaaaaaaatcatagaggacaaaaacaaatggaaaaacattccatgctcatggactggaagaatcaatatagttaaaatggccatactgcccaaagcgatatacagactgaacgctattcctatcagactacaaatttttcccagaaatagaaaaaactattctaacatttatagggaaccaaaaaagtgcccaaacagccaaagcaatcctaagcaaaaagaacaaagccaaaggcatcacactacctgacttcaaactatgttacaaggctacaataaccagaacaacatggtactggtacaaaaatagacacagtagaccaatggaacaagatggcgaacccagaaataatgctgaacacctacaaccatctgattttcaaaggtcaaaaaacacaaacaatcaggaaagactctctgttcaatacatggtgctgggataactggctagccatatgcagaagaacgtaactaggccgctaactttcaccatatacaaaaattaactcagatggattaaaggcttaaatggaagacctagaactagaaatattctagaagaaaacataagaaacaccattctgtccattggcattggcaaagaatttgtgactaagtcctcaaaaacaattgcaacaaaaccaaatattgataagtgggacctaattaaactgaagagtttccgcacagcaaaagaaactattaacagagtaaacagacaacctacagaatgggagaaaatattcacaaactatacacctgacaaaggtctaatatgcagaatctataaggaatttaaacaaatcagcaagcaaaaaacaactccattaaaaagaaggcaaaggacatgaaaactcaaagaaaggtatatgtgcaggtaacatacatatgaaaaaaaatgctcaacatcactaatcattagagaactgcaaatcaaaaccataatgggatactatctgtcactagtcagaatgactataattaataagtcaagaaacaaaagatattggtgaagttgtggagaaaacggaacacttatacactgttggtggaaatataaattagttcagccactgtggaaagccgtttggagatttctcaaagaacttaaaacagaactaccatccaacccaacaatcccattactggatacataacaaaggaaaacaaattcttctacccaaaagacttacgcatttgtatgttcatcacagcactattcacaatagcaaagacacagaatcaacctagatgcccatcagtggtggactggataaagaaaatgtggtatctatacaccatgggatactatacagccatataaaagaatgaaatcatgtcctttgcagtaacatggatgcagctggaggtgattttcctaacaaattaatgcaggagcagaaaaccaaatacagcattttctgacttataagtgggagcttaaacattgagtacacaaggatataaagatggcaacaacagacactgaagactactagagggagaaaggaaggatgggatgaccgttgaaaaactagttggtactgtgcttactatctggctgaagggattattcataccccaaacctgagcatcacacaatttattcatgtaacaagcttgcacgtgtaccaccgaccttaaagtaaaagttgaaatttttaaaaaggataaaattaaatggtctttatttgcaagtcatattatttcttacacagaaaacaaaaaagaatctatgtaaaattattacaaattataatatggtttatcaatatggctcacaatatgatccacagaaaaatgtaattgcatttatatattctagcaacacacaaaaagcatagctttttgttaaaagataacatttcttatagctagaaaactattaaggtacttgagaatgaatataataaaacatgtgcaagacatccgtggagaaatttatgaaccttcattaaagacattaaagaaggcctaaataaatgaaaagatattacatgtctatgaatttcatattcatcttctaacacttttagaaggagctataagagaatgtctttgtgaccttgggctagcttagactcaagacaaaaaaagcataaatcataaaaaacaaagtttgataaatttgactacatttaaaattaagaactgtggtttataaaaatgtagcaaaaagaaagtgacaatgcaaaccataaacagagaaaggatatttgaaatacatagagcagacaaagttttagtgtcctaaatatcatatgtatttctacaaatcaatgtgaaaatcaaaatgagctagtgggaaggagagagagaagaaagacaaaacaggcatttcatgcagaaacatgaatgccaatttaaaaatacaaaaattttctcaatctcattaataatccagaagatgaaaattgagaacacaatgaggtaccactttatactcatttgattgacagtgattaaattgtctgacaatactaagtattggagagaatgtggatcaataggaattcttgtacagtaatgttgatcatatcaatcagcacagcacaatttctttgaagatgaatttggctttatcgttagagtgaagattcgcataatctacccagaaattctattcctaggtttataccctagagcagcaaattccaataggaatgtgatatgattcctaaatgcaggcctaatatgtaattttgaacattcttgaagtaatataaagtacaaagaaaaaaggtgatattcatttttatatttaatttaaccaatatatccagtacattatgatttcaacatgtaatcaatatcaaaattatccatgagatattttacattaccttttcatggtaagtctttaaaatccagtgtgtattttacatttatagcacatctcagttcttacctgcccatttcaaatgctcaatagtgacatgtagctactgcctaccatattggacagtgagccccagaaaaattcttgttcatgtgcatcaagaaacatgtgcaaaattgtttatggtagcactgattgtagtaaccaaaataagaaataatctatatgtccatcaatagtggtataaataataaatgcaataggatactatgcagcagtaaaaacacatggactaaggttatacaataacatggataaatattagaaatcatgagtgaaaatacaattctaagaatatatgtagaatgatagcattttaataaagttcaatataagcaattccaggcaatataatctttagggaaacaaacatatgtgacaaaactattttttgaaaggaaggcaggtttaaaaaataaggatggctgccttattttgaatctctcccatacccacctttcaaaaactcttaaaatcaccaagaaatatatatataagcatacatgatgcatgcattcagcatttctaagaaacagcaaacactccaaccttaaagtgaccctcaaggataaaaagagaactaattccaacacacctcttgctgtccacttactgttgcaagcttgtggatgcagaaaatgggactggggaggtttaagaggcaccttcaaaaagtgttgatgtgatcagaggacttagatgaggcacaaataaaagtcacccctagaatgtgagcattcaacattgacaaaatattgaacacaggttgggatttggcagttcaaagcaccgattgcaagaaaagggcttgaatgtgtgtgggaccagaaggggcagcctcacatgctcctgtgggagaactagatatatagagaagtgtcagtaccctttagagatgaggctgtgtagcaaaagatggaaataagaagaaaataagggaaaaaagactcactcccttgcaccaacaccaccattgataaaagaaacttcatagtagagggaagaactgacagaagagcattctttaactaggaatcctgtccataaatttaatagaaatagaaaaaagactgaccatgtccataaaaaactactgtaagaaacaagaatataataatccaaggatttctgatggtaaaaattattcccccaaaaacatgaagtgaaataaaattgaaaatactttgaagtaaattatatgtctatgtttctttctcttcaaaaaagctttcagagatatgaaaaaacgacatcattgagaaatacaaaaccaaagaacataaatggaccaaaaaaacctagcaagaaatgaaatgagttcagctcaggaaaaatgatgaaaaaataataatcctacaataataaagactaaattacagagtccttaatgaaatatcagtccaaatgaaaatggaataaaagtcccataagaacatataacaaagaaatattaagtagaacaggaagtagtagaatgggacaggtaactggcacttactctgatgtgtgaaagttgggaaggagttagacaaaagagtagcaggtatcattaaggatcatcacaagccctattgtaggatggagcacaactttgtgaataaactctgataataagatgaggaatagtaagacatgagcctggagtgtatggtaaaagccaaaccataaaagtttggaaaccacattatagactttggtctttatgttaggagcaatgtaaagtcactgaagtatttttcttttttaaagaaatgggcaatacgatcagatttgtttttgaaaaaaagactctggctgcagttcagagcctgtattacaggggaatcagagaagattcagggcaacagatagggggatttgtctagtactttaagtaagatcagtctagggtgatagcagaagacatgaagacaatttgatagattttagtgatatttaaatagtgaaattaactgaaatttgtaatatattcaatataggggagttgaaagacaaggaagagtcaaggatgatacttaagatttttggcttgaggaattgagtagatggggtaccattcaataacattggacactgaaagaggtttagatgtgtggagatgagaagttaaagggtcttcaagatatcaaattggggcaggcacagtggctcatgcctgtaatcccagcactttgggaagctgaggtgggaggattgcttgaggctaggagttcaagccctggctgggcaatatagcgagacctcatctcttactactactactactactaataataataataataataataataaggaagatatcaaatttgatatatcaagcagatcttacaggtgacgtgtaggctagagatttcattgggaagtcattgacatttagatgtaatggaagctatgaatgtgaattagatcacctagggagtgagtatgggaagtataggaggagttatactagggcagaaccttgaagaactccaagattgaagcccagaaagaagagaatggatctgcaaaaactttgaagcatggaccagagagatagaaggaaaaacagtagaatgtggttttacaaaagtcaagggagaagttttctagatggaggaaagattaacagggtcaagtgctgctgagaggtcaaataggataaggatcataaagtgtccccttcagttggtaacaaggaggtccccttgagttggtaacaaggaggtcattgatgactttcataaagctattttgttggaggagtagaggacagattggagttggttgaggaataacaaaatggatagaaaaaagacaaatttttaaagaagtatatctataaatgggagaagagagacaagagggtaactggaaagggtggtggggtctagggaagggtttttaaataaagaagggacttaatgaggcacaagtattgttgagaaagttcacggtgaaagaaagaggttgatggtaccagagatggaatggatggttgatagtataaggttccctagaaggcaggaaggtggagaatgtaaaggtagaaatagtgattgcctcacatgggagcagtgacataatctctactgttgtaaaaagaggggagaattgcagattaaaaagtaggcttcaaaatagtatgtatggtactatcctgtaattacttaaggaacaaaaggagcatgcataagtacaaggcaaaaaatatggagaaatatatgtcagtatgataacagtttggtgggctgaagtcggatcagatgaaaatagtgatgacttggacattctatattgtgaatcattttatttaatgtttattacatgcttttatttttacatgcatatttggtatatgcctttattataagaagatggtgctcttagcactttcatgcattaccacaattcattcttataaatagcatatgaagtcagtattactgttttgccctatttacaaatgacaaaagtaaggatgagaaaagtgaagtatcttacccgcaattacaaaattaaaatgtctttcaagcccagatttatctgatttccgagacatgcttttcaccaaaatgctagactgcattcctgcaaattttgaattttttacagtgaacgtgtattattttgcaagcagaaaaacatataagggtcaaagtctatagtaaacatgatacctctttgattgcccaatagcaccttgttttaggaactatccctctgtcattaccttatataggtttttttttttttctctaacaaatgatacatttctctcatggacatagggatgggcatcttacccggactagactgatctttgttctgcatcccccgtagtcacagtgatttgtacagagaatagctcatgaaccaagcagagccaatcagagttctttcctgagattttctataaggattctgggggaaaaaatatccatctaccttttgaatttttagttacacaaatatagactgggaactaccagcaaccatctttcctgccaatgtggagaacctaagaaataaacagcacatagagatgaacagagctaagaaatgaaaagagaactcagatgacattgttgagcccctgggtccaactctgccagatctgcccttggactttccagttgtgtgggccaatgtatccctttgccgccaaagctatttcaacatgggttgttgttgcctgcatctgaaagagtcctggctaaagcaaaattagaaacaaaactggtgtctagaaagtggcagacctaggccgggtgcagtggctcacgcctgtaatcccaacactttggaaggccaaggtgggcggatcacctgaggccaggagtttgagaccagcctggccaacatggtgaaaccctctccctactagaaatacagaagttagctgggcgtggtggtgcacgtctgtagtcccagttacttgggaggctggggcaggagaattgcttgaacctgggaggtggaggttgcagtgagccaagattacgccactgcactagagcctgggcgacagagcgagactccatttcaaaaagaaaaaaaaggtggcagacctaaatacaaaatttgcttcactgaaatcggctacaaggcaagaggatcccctcatctccaaccaggaagctggcactccttattataaacttgcataccatctggttaaactgtttctactgaaacttgtacctattggttagattaatattatgtaccttttggtctggagctagaaaatgttcaagattatgatgtgattgctactttttgtagcctctagttagtatctgcatggatacaaactttggtcaaagctggcccatgtgtaagcagaaaggaaagggcacaaaactttcttaaacaaggctatatcttgctgcacttaagaatttaagatggctgagagttactgtaaatattcaatgtctatttctcctgttaaagttagagaaagtaggaaacactggtaaatcagactgggaccaggggaggtgcgaattgggggatgtgattccttagctccatcccaaacacttcttactgacctatattcctttccttaataaatttaataattattagcttattaaattctttattcgctattacaaagggctgtccattagaatacaggccaggaacaaggagtaaattacccctgtatcattacccaagctcatttgtcacagatggagactcttcaaaagagacagaaattcttaaatgagggtctaaattaaagaaccatgactgagcagtctctggccagttgatacaaattacacattctccagcagctgtctaaatagatacatacacatgtacatgcatacataaatgctatgttattaggtacatacatagaactatatcttcttgctgaattgagccttttagaattatgaaatatttcctgtatctttccttaaagtatggtttgtctaatattaatacagtcacacaagctttcttttggttagtgtatacatggtgtatctttttctatatttttactttcaacctatttctgttttaacatttaaagtgtgtttcttgctccttgtagacataattggggtcttttttaaaatcgagtctgtcaattcagttattttcattgtttcattatttttggtgtttagtctatttatatttaatgcaattatcagtatagtttgtcttaagtctacaattttgctatttattttctatttgtcccatctattcttcatttctttatttctctttttctactttctttgttttaataaggcatttattattccatttatctcctctattagtctttatgttatacttttttattgttcttttagaagtcatcctaaaaatttcaaaatacatgtgtagcttaatgaagttcaccttaaagtaatactttttctccattcggaaccatgcaagaaccttacaggaatttaaccctagtcacccttcacaccctttcagttatcacaagatatattttacatttaaccccacaaaactttattattgcttttgttttaaatagtcaataatttttgataatgaccaaattatttagcctttcctgtgctattcattctttcttgaagttccaaggagtaattttctttcagctttcaagaacttcctttagtatttttttctaatactagcaaaaatttatttctgcttttgtctgagtttttttcagtgatttttgaaatgttgggtgtagaattctaggttggacatgtttttgtttttcttttgctctttttggcactttaaagatgtcattttatggtcgtctgctttccatagtttctgtggataagtcagctatcttcttatattgttcttctcaggacaatgtgttttattcctttgggcacttttgggattttcactttaactttgatttgagcagcttgactatgatgtacataaattgtttttcttcatatttattctgcttgacgttcactgagctttttgaatctgtgagttgatgcttttcatcacatttagaaaatttccattcattatttcttccattccattctcctttttctcttcttctgggactctaattacatatatgctagacctttgtctgtatcccacatttctcttatgtgctgttttgatttttacattcatttttctcatgaggttcagtttaaattttctattgacctgtcaataggcctatcttccagttgactgatactatcttctgctattaaatctatccaatgggctgggtgcggtggctcatgcctgtaatcccagcactttggaaggccgaggcgggcagatcaactaatgtcaggagtttgagaccagcctggtgaaaccccaatctctacataaaacacaaaaattaaccaggcatggtggcatatgtctgtaatcccagctactagggaggctgaggcaggagaatcacttgaacccgggaggcagaggttacagtgagccaagatcatgccactgcactccagcctgggcaacagagcaagactccatctcaaaaaaaaaaaactatccaatgaattcttaatttcagatattgcatcttgcagttgtaaaataaccatttaatgtttaaataattatttgttgaaatacttcatcattttactcattcaattatattattggtgccccaaacttcattcccctctacttttggtctgggagtctcattttcatttaccagatccattgattcctttattcctctgtttgggaataaaggcctagcctttttttatgattctaatcttagttttccaggaacctgaccattagtttcaagctctccttcataagttttctaaggaaagctccttcagttactgaagcctgcctgttctaataattcagagctcccaaactgggattagtccctccccttttccacttgattccgtgcaagcttgtgtgtgtgtttgtgtgtgtgtgtctgtgtgtgtgtgtatgtgtgtgtgtgttcataaagcctaggcatatttcgtcagggttcaaatgggcataattttcatgtaatcaaggcagctaatgaacatatgggtatctggtgatatgtgaaaaattatgtctattaatttgtaaattttgatacacacaggtgataattataggcattcctgagcatttattttcccaatcattttctgcaattaaagcttagaatttctacaatacgtaatcttaagtactttaatttcaaatcaaatacattatataacatggtttctaagaaattttatccattaatgagtatttacctacctaagtatttaataaaaggtttaatgtttgtatttccgttttcatagcagcattattcataaaagccaaaaggtagaggcaacccacatgtccatcagtgggtgaatggataaacaaaatgtggatatacatgcagtagaatattattcagccttaaaaagaaggaaattctggcacatgctgcaatgtgaatgaaccctgaggacattaaagttaaataaggcaatcacaaaaagacaaatattgtatgattttatttatatgcattattaagagtagccaaattcgcagaaaaagaaaacagaatggtggttaccagggactggggggagttggtaaatcgggagttgtttaatggggatggttttagttttacaagatgaaaaactgctggagattggttgcacaaaatatgttaatatacttagtgaactctacatttaaaatggccatgatggtaaattttatgtttgtgtgttctattatgtttacaacttaaaaatgagttcagtgtttttagaacttcaacatgactgatttgtgtgatagaactgtgaccatataaaaaatactgatgtgaagccaggcacagtggctcacacctgtaatcccagcactttgggagaccgaggtgggtggattgcttgaggccaggagtttgagaccagcctggccaatatggcaaaaccccatctctactaaaaacacaaaaaattagccagctactcgggaggctgaggcaggagaatcgctggaacccagaaggcagaggttgtagttagccgaggtcatgccaccgcactccagcctgggcgacagagcatgattctgtctcgaaaacaacaacaacaacaacaacaacaacaacaacaaaaacctgatgtgaggggaaataaactacaaaatgaaaatgaagcaatgatgatgaaaatgaatgaagaaaaggtaaaagaaaaggaagacttagatatgagactaagaatttgaaaaataagacaataaaatagaggcattaagtatgaacaatcaataagcaataatcaactcataagggcataatgtggacaatatatgttcaactgtgagccataaaatacaaggtattggggacaaaagttaaatataatgcatacacacacatacacactaaatgatgtccctatggaaagatgtctaatatctactccaagaatacaggatacatgaaaaacaaaaagaaaaataaagaatatatacaggagtacagttcagcaacagcatttacatcagtaggtacaaagataaaaattaattgtatttactcacaaaaatatgttttcctctcaagatgtcattgtactcagtaaatgttgcatctaccaaaaaattaagactaataattgtgtttacaataaaatgagcatatagatccataaacatttcattataattatgaataattattaaggtctaccagattagtgtattctatactgggtaatgttaaaatttcagatgtctgttgcaaatcagatctgtacatagctcttaggctgattcaatcaatttgttgagttactagcaatgtgaggattaacaaagggtaaaacattatctctggcatcaaagtatttacagactgactgggaccacatcgatgcactggaaaagctatgaatgtgttggttatgcttcttcatgttttcaggcaaaactctcttcctaatgttgcacttctgtcacaagatgagaaaaggggactgaaggccaggactagtcagctactctcaaaaccatgtcccatgcattatatttttctaagtaattttgaggaaaattttggatcctgttgatcgctcccaggcatcagtaacagttgatcatctaggtggttggagtgtgtacaagcccaaaaaagacaagagaacctaccacacctctatacatttccctctaacccagggtggcagccttccatcacttttgaaagcttctccctcactaactcagagtggggagagtcagtgttagatgagcatcctaaggatggtggaaaacaaactgaagaaagtgcagaggagtggaatcacatacctccaaaagaggtccgagtatgcatttggtgtccacacatgcctctggatctgtagtataaacttctaacttcacttacctgtctctatctttagcaagcattgcttgtcaagtgttgggtactgaggatgagagaaaatgacacagacatagtcctgccctcatgaagcttagattgtagcagaggaataaaatatgaaagaagtaattgtggattcactgttatgataaaagcaatgtggaagtagatagcaagtgtacctaacctagtttaggaaatcaaagaaggcctcctaagagagtgaaacttacattgagacttgaaggctaagatctagctaagtctgagggggatgaggtagagaaaagtattacagaaagaaagaactgtatgggcaaagacccaaaggcatagtgctttcgatgaattgaaggaaatccagagtgcttagaatgatgttagaatacagaaaaagggaaggtgttgaaactggattgtataataactgcttggactagagtaaggattaacataaatttaagaggtaggattggatgtgggaagtgaagaaaaggggaacaccaagtatgactcccacttttctgccttaagcaaataagtggataatggtatcatttattaagatagagaagattgggatagaagcatggctaaaggtgaagacatagcactaagttctgttttagacatgtggggtttgacatgcttataagacattgaagtgtatcagaaggtctgaaggtcagaagtgtcttggctagagatgtgtatcgtggaaatggatgagattgtctttgagtatagtgtagactttctatcatatatatatgtatggtggccttgggctaaaccctgaagatcttcatatattctctgagtagaggaggataagtgataaaagtaaggaggaaaatgagaaatgtcacaaaagccgaaggaagaagtttttattgacttatttgggtttatgtataatacattttattctttgtggtgtattgttctatgtgttttggcaaatgcatagtcataaaaccacaaacaccagatttaagaaataaaacagatttatcatcctccaaaattccctcgtgttgccccattttagtcgacccctgcacctacccatgacaaccactgatctgacttccgctgcatggttttcgtttttccagaatgatgtataaatggaatcatacttccaaattggaggttttatttagttcatcctgttttccctctaatattggacattggatattttagatggagtcgaatatcatgtacccataaatgtgagaccatggggagctacatcaagacgtgtccaagatgactgtaaatcactaaaagatcttgcacttaaaattggataccctggccaggcgcagtggctcatgcctataatcccagcactttggggggctgagacgggcagatcacctgaggtcaggagtttgacactagcctggccaacatggtgaaaccctgtctctactaaaactacaaaaattagttgggcattgtggcatccgcctgtattcccagctacccaggaggctgaggcaggagaatcgctggaacctggaaggcagaggctgcggtgagccgagattgtgccactgcactctaccctgggtgacagagcaagactctgtcaaaaaaacaaaaaaacaaaaaaaaaaacaaaaaaggatacccttagggtatatgtacttgggttgtctctgtatagagggcacaagtacactttcatctgtatatgatataattatattagtcgaagagcttttgtaaatcggcaggctatcaaatagtggaatatagtgttcatgtgttgtttttgtctatccaacatacattccgattgttcggggaaaacactatggttttccttcaaggaaccagctcttgcattctccctcttctccttccccctctccctctcattttcaatccacaagatttgagcggtgatttcccactgcctggttcaaagagtaggcacataaactcaagcctggccaaggagaatgttctattttctggcttcaggaatgggcatgtgacccaaactgatattagcatctggctagaactgtatgaatcagccctaggacttacactggaacaactgggaacaagtatctattttctggattatttctacatggatgcaagggtggacctttcagtgataaacacagaaattacagctgataaaaagaggcagatttctatcctcacagcttgagtgccagcatacagctatgcctgaaatcaaaccactcaggatctgtcaactctttgacctaatatatgtcttcttttcttaaaccaacattattttgaagtgtttcacttacaaccagaagtaccctgacaagtagaccctcatagtcttacaatgtgccacctcccattctgctcatgctaagaatcatttagtgacagtagggtatattttttcctcagtgctgtaggtattttccccttccatatcatgtgggtaaccaagactttattttccattgtttatgtgcttttgaatcagatatgagaacccaactctcatcctgtttgttgttgctgtttgttggttggctggctggtttttaaagcattgccttatttagggaattattctggatagtcctggaagtgggggcagggatagagatgaaggcatggggatggaaacgacagaaaaggcaaaatgggaaagagatttggaaaacttcctgagcgatgtaaaagaccagataaaaggaagggagttcagttaggaacctatttctattttgttgtgtatcctgtaccttctcagtgctctgggggatatggcagaacctgagaaggaaatgtctgggtagcacaatgagtgagactgatccccaggactgtgtctccctgtcttggaagtggaattcttgtgtccaagcttagcatagaggcagtggagtcatctgcttttatttttgtaattgtggtgaaatatacataacataaaatttaccatcttaactatttttaagtgtacagttaagtggtattaagtacattctcattgtgcaaccatcattaccattcacctccagaactcttttcatcttgtaaggctaaaactctataataccctgtattactccgttctcacactactacaaaggactgcctgtgactgggtaatttatgaagaaaagaggtttaattgatgcacagttccacaggctgtacaggaagcatgattgggaggcctcaggaagcttaccatcatggcggaagctgaaggggaagcaagcacgtcttaccatggcagggcaggagagagagagtgaagggtgaagtgctatgcacttttaaacaaccatatctcatgagaattccatcacgagatagcactagaaggatagtgctaaaccattagaaaccacccccatgatgcaatcccctcctaccagccccctcccccaacacgtggggattacaattcaatatgagatttgtgttgggacacagagccaaaccatatcttaccccattaaacactacctattcctcctccctctagtccctgacaacctctattctcctttctgtttctatgaattctggatacctcatttaagtgtaattatacagtatttgtctttctggaaatggcttatttcacataatgtcctcaaagttcatccatattataacatatgtcagaatgtccttcctttttacggctgaataatattctatgcatatattatatttttcttattcatgtatctgtttttggacacttcggttgcttccacattttggcccttgtggattatgctgctgtgaacatgggtgtacaaatgtctgtttaagatcttgctttcagttcttttgggtatattcctaggactgaaattgttgattcatatggtaattctatgtttaactttttgaggaacaaccaaactgttttccacagtggcgtatcatcttacacacttaccagcaaagcactaagtgttccaatttttacattctcaccacctgttacattctgggttttcaaaaattatagtgatcctagtggttatcaagtggtatctcattgtgatttgatttgcctttacctaatgctgttgaatgtcttttcatgtgcttattggccatttgcatacctttgaagaaatatctgttcaagtctttgctcatcttcaagctgggttttgttgttgctattgagttgtatgatactactttctaatcgctacactagttgctggaaacagagcaacagataagacacataacttctactcaaaaaaattcacaagatagtgggagaagcagaaaaaatattttaatacagtgtggtaaatccagtgacacgtgctcaaggtataatgggagtttcaaaaaggagtacattaatggaggtgtggagcagaagtggaagttttcttgggggatatggtacttaaacagatcctcaaatgatggtagccaggcaaaaagggggagcgtggacattccacgcagaaagaaaatcactggcaaagacttgtaggcatgaaacagcagagtgtgtgctgttgaagtgtgtgcttgttgaagcaagtccaaggcaagtaatggcaagagatgaggctggagagttagacagggactggatcatgccagatgttataggctattgtaaggtgtatttaggctttatcccaagacccatggggtgtctttgaaagtttttaagcagaggaggtgcgtagtcaaagttgtgctttagatccaagcttcccaatctcttttcatatcacatcttagtatatgcagcatgataatttttgtgtggcactctgggtgaggtagacttgcagctgcatgctgctgaagacaacaggcgcaggctccagctgtcccgtgcccaacacaactgtcctgagagctaaggttgagaagctgctttagctagatcactctgaaagtcatgtgaagaacagatttagaaaaaaaatcactggaggtagggtgtaaagttaaactaaccaggcatagtagggatagagaaaataattaggaaatagaattgacaaaagtttatagattggagtaaaggaggaagagtcaaataagtttctgacttgcactactgactggagagcagcatatttgagagggaagattatgattttttttttttttttgagacagagtcttgctctatcacccaggctggagtgcagtggcacgatttcagctcaccacaagctctgcctcccaggttcacgccattctcctgcttcagcctcccgagtagctgggactacacgcgcctgccaccacgcccggctaattttttgtatttttagtagagacagggtttcaacgtgttagccaggatggtctcgatctcctgaccgcatgatccgcctgcctcggcctcccaaggcgctgagattacaggcgtgagccactgcgcccggcccaggaagattatgattttagggctgagcataaagttttgattcaattttagatgactggctggtgatgcccaatagatggttattattttcctatcagctctattggctatggagaattgagccacatgaaccaaggaactaattcagtgtagaaaatctaatgtctttaaaaacagccatggcagtgactgtactagagatctaccttcttgggaaagtttcccaacccacagcctcaaagagacaacatgtcatatgtaccatgtgactccaacctcttggccacaactaagtgcaacagagatagcatctgactcaaattgggccaatcagattctctctcatgagactcaggcattggaacccagtgactgagtcaattctctgtggggagtcaagcttgaagttcatatcaatcaatggttttcaaagtgtagtccacagagcattagaatcaaccatctgagaacatgttagaaatgcaaattctcatacctcatatcatagctgctgaatcagaaattgtggggtgggtccccagcaatctttgtttcataagccttgcaggtgcttctcaggttggctatcactcatgaagactcttggtacaaggctgccattctgggagtagtcctgatcaatcactgataagttattatcagtgcttataagtaagcagagaaagctggtttgcacacagaagcaggagaatggagcagagagacacagacagacagacacagagagatcaaggcagggagaaagacaggggagaaacaagccatctgataacttttcaatttcatgaggcccagttgttcttcctgcaactggaaactgaaatttttctatatcattacatgaatcccttttatttgaatggattttctttcttcattataataaaagtgccctgacttgttagttatttctcccccaagtttttttttttttttttttgagacagagtctcgctctgtcgcccccgctggagtgcagtggcgcagtcccggctcactgcaagctctgcctcccagggtcacactattctcctgcctcagcctcctgagtagctgggaccacaggtgcccgccaccacgcccggctaattttgtgtatttttagtagagatggggttttaccgtgttagccaggaaggtctcgatctcctgacctcgtgatccgcctgccttggcctcccaaagtgctgggaccacaggcatgagccactgcgcccggccttctcccccaagtttttattgcatttgtactgtatggctactgttccaagtatcataaaggatactaaaatcaaagagacatggttcttgctcttgagaagccagatttaatgaaggaggcacagagacaacgttagaagcgctatagaggatgtgggaattgagctttgagatcacctggtaagcactaaaaaaatattagctgcatctcagtgtagcaggtgaggccagagaagacctcaagggagtgctagttgatacatacatatgtactagtccatcctcatgctgctaataaagacatacctgagacagggtaatttataaaagaaagaggtttaaaggactcacagttccccatggctggggaggtctcacaatcatgacagatggtggagaaggagcaaagtacatcttacatggcagcaagcaagagacatgtgcaggggaagtgctctttataaaaccatcagatcgcgtgagatttattcactgtcacaagaacagcacaggaaaaacccacccccagtgattcaattacttcccactgggtccctcccaggacatgtggggattatgggagctacaattcaagatgagatttggatagggacgcagccaaaccatgtcaacataggatgggtttgcagagaagaggaagaagaagaagaaaagatgttccaagttgagacgaaaaggcagacatgggaacctatggtgtgtatctgggaaacagagagtggtgtaaggcagatacaagttaaaaataagaagcttaattttccctgttgaacataagggaagagtcttctttctacactacccccttccgttttcttttaaaatttctttctctgtcctttgcaagtcttttttatgcaaatatttttaatagctaaataagtaagcctttcttccagtcttacaactcctaggagctatctttttgaaatgcaaacatcaagggaggtagcaaccctgtcccctagttcccataggagggtaagagcctaactttcatgggccttgctccagtttgcaaaactacctcctgcttaaaatagatgagaaaatttgtttcttcttcagataaagccaacacaagtgacttctccaattatcaccataaagttaggacaaaattttgtgtgacaaaaggtgctctcaaatcctcttgctcaaggactagtcattacttatattgggaacatacatgtaatgggttgtatctgcttggctatattagggggtgagattcctttctgtctttgcattctcttagcaagttacctgtgatgtacatcacattctggtttaatgtttgttcaataataagagtgttttctttctttactatctttctggagaagatttctggattgggagaagatctcttgttttattacatttccccaacagtgctttaacttgcctggaatgtacagtgatgaagtttttccttgattaaactttagtcagattcctctgagtcctcttcccaacttggcctcaatgtttacacttccatgtttgtctttgcattgctcaattttagcaagaatcttgccaagttggtttagccagaagcccacccttgatatctgatcaggtttctcatcctctaccaactcccagttgatgtcttttcaccctgacctgtcttcagcaagaatcctgttaggtcaggttagccagaatccaccccccaccccaccctgccccttatctctgatgtttcctcttagtaatcttccatccactgtcccctaccctgctccttggctataaattcccagttttccttgttgtatttagaattgaaccctgttcaatactgaaatctcttttcccatatggcaatagtcctgaataaaatctgtttttactgtttgaaccactgttcacctttggcttgcttttataacacattacagaaggcagaggggaaaggtgaagggcacgcccaagggcagagcacgaaagagtgctatgtcagagtgtagactattccatagatattgaggagctgtaaagattttaatcaggaatcgaaataatccaccatctgactttaggaaaatgactctggcagtaatgtggaggatggagcagaaaggagaagggtcaaatggcgcagcactgaatacattcataatcataattttccaattattttttagtctgttattactaaaaaagttattcttggactgacttttccctaagccaccctaacaatatctagagctgtatttttttcccccataggaacatttctccagaatgtggagagtagaggacaacatgttgggatgcctgacactccttggatattgttcctgagtggtttgggtgttcctctggatccagaatttcatcccaatgacactgagattccaggcttctttagtatttctgatggtgtccatcagaagaaaggagttgcttattagagtgttctctaccgctggcttgtagttcagtttatggtaaacacttgcttatcactgaggttttgtatatgaattgtgaaaatggggtgtgattgttagaacaaataccgcttgactttcattggcagccctttctgtgagccccaaattatgaccactgtttgcagggattcttatgggtgcaagttttcctagtataactacccgtaagtggatttaacttgggacttttttcatagaaattgagaaggactgaaacactttgaataaactacacacacatttattaaatagtgaaatggttaacaaaggcacatcaataaccacttactatatatacagaaatatatataattaacatggatccaattatctcataactgccattttttccaacaaagagtcattcaattcttcatgtcatgaaggttaaaggcaaagtcttagtccccatcttatgctttcccaccctcttcttgaaaactacattgaacctctatgggttaatcatcgtcttctgtagccataaggtctctgcaagcatgctgactgcaggctcctcagattctttctccattccctcaagtccagtttttaatgaacaggctgtttgctttagcaggtgctgttgctggtattcatccagttacactatgattttttaaaaataaatctttccttgtacttgtacatgcctgcattgcattgcatcacttatgaagagatagctccctctctcatcaggaaaactggatttgtgtgtctatgtctgttgcactttgcaccggatgccctgcctgccttttcactgtgttctttccatgcacaacagaaaaatgctgggctgcactggccagaactgccattgtatactaatttctgcatccactttagaatgctgtgcttttgctttggacatgtttgtacaaatgggaatcagatagtctgtccctctcacaaagctatttcctggtggctgccctttgtatccaaaatcctctgtttggagctcttggcttttattccccagacacccactgtcctcctgcctaagggagtagtgtaagtcaggcactgaacagaaaagctgggaaggtttagttaaatgcgcatttctagtacaggaaagagccaagtagaaaatcagagaatgtgtgtccatctgttaaagtttaacaaatataggctttaaattactccagaattataatcatacctcaggcctgtcattgtatcatgccctctacagatgatgaccatgggaatggattctggtcagtggaattttaggatgttcactatctattcagtattttaggttcattatcatatcagaactttccagataataacaaaattacgagagtgttcattttttggccttcctgatgtggtgaatgactgcattgcttataggaattccatctctgcacctaaacactgagattcaatgcctagaagtttgcttaagtaaaacatatttcccttatctatgcatgtaggtgtctgatatttgcccattggaaagtcatgcctttttaaatgtgaacacttccaggacaggcagtatactaaatacggccattcttgaacaccatagggtaatttgtctcttagatctcaactatgagcagttctccatagtctgagaagcccaacaggaaagcacttaaggggaaaagtccagatctatcagaggaaacaggcctgataagttgctatcatgaggattttccagggccagaggccaccatgagggatgagaaaaggatgctgtgaaaagaatttgaaaagtacccaagacaaacttggtttacatctggttttgcctgtgggtcaactttcttccagccaatagaaactccaagtctccaatttgatgatggtcgggaatgcttgccctgaattcttacctaacattcagcagcctcaaagagaaagacattaactgaattctgaagaggcctaagacctcttgtaaatgtctatatactgaactgtttttagtgctggtattatcagactcacagaaacacctacaaaacattaaacggctcaaagtgggcttatcaagaaatgccatcatgggaaccaccttagaaatagtaaaacagggcacaaggggcaagagaactatgtatagggcagctgacacttgacaaggacccaacctcctccccgaccctcttcactgttaagagacacatcagtaatactttgctctgccatagcctctgatctaaactctcttcaccgcagttttctatcagcccaactccagaacagtggtcaatgcagagaagttccagattcgcatttttgaagcattttgaaataaggcagaataaagtattactaaattacatttactttcttaaagaacaaaaatgatcatccttttattactgtgccatttgttgaagataaccaattttaagtgagagaaaacattttaatggaaaaattcatgcatctcattgttatgaaatgattgatgcccatctggaaagtatgaaataaacaacactggtttcatatgttacactagggatgcaggatagacatgaataactgggaaagagaaacttctaataatgcatcttagaatatgcctcaggatttctgaggcacaagagaaactagtaagcattctctcaaaattttaagtattcttttattaaaatagaagtgtttttcttgtgtcagtaacttcaatcttataagagtaataggtctaacacaacggatatattatctacataattcaaaatactgatggtatatttggaaataaatttactctatgtatgaaatataacattgagccaaatcagaaatttaaatttcattttagaattactaaatattaggattaatatactagagcatgaatagccttcaagtgaactcctaatgtgtgaatatggattcataaaaaaagacataaccaagaagtttatgcattttattagaagaacaaaaaataaacatagaagtagcatactaaaatgagctgcataatgtgcacttttaaacataaacaagcactacagcactataacttgaaaaaaaatcaaagcgtctgcagttgagggaatgagctattgcattttggaggaaaattactatgggaagagttggtactcatgaaatattctggtcattatttaaatatgttacacatggctaataattttcttatatatatttttaatcgccattttccacccaaattatgtgcctccatttttcacattattccaaattgttgttatatgaatgcacaaagttagtcctttaaaaaagaatatatttaggaaaatccttcaaaagttttttaatttaaatcattgtaatttgggagcatggggacaaatggctcattttctgttaaagcagcaacaataatattaaaatattattaatattataatattaaaataatattaaaatattaataaataagtttattttgaaaagggcattcattcccataatccagtgatatgatggtcatatcattctctcaactgctagacacaaaagacatagcaacaaagtaatttgtttccatcactaacaaatagcatctctacacagaaataaagctctggaaccatgcagttttatgacagataaatctttaggttgtgtgttttcagagaaaaaagcactgcttaatagttaggttacttttaggtcttgttacagaggtattttttaaaaaactaatatgatgtagatgcctagcaaggattttgcaatatctgcaaagagctgcgacttatttcatagtcatacattttttttacatataccataattgtggatggattctatttaaagataaaatttctcttcaataatccagcttttgagtattagtgattctcttacaggcaagaacaagtagaagagctggaaactgcacaaattagtcaaactaaatattttcttgaggttagtaatagagggctttttttgggggggggcctcagttacatccatttgttttacttaattccccaatttgtcttatttattgaaacacagcctctatgttgaaactccagagtatgaccccgtggctgtcagcatgcacaccatgccatctattcatggggtatcttttgtgatgcttctacagttattcctactaatttataggtgatttttcctgacttaaaatgtcgtatctctattgaccttagaaaaatacattcttgaatctggcatattcacaaagaaatgtccatatcagtacataggttaaattgggaaattatgttggagataaggctgaagttggagttcctaactacagaatgaaggaatgcttacattttatatcaatggaaatgctggtcagattgtcaggctgtttgttgtatggctaactctaagtgattatgggctgagggaaaagaaaattctagccaactggccctgaggtattggacaactgtaaggcttggattgctttctggctttggcttatttttctttctctgtaaatgagaactatcaaaacgagtagcaataccaactccaccaaccccaggatgggttccttctctaggtactacaagtacctgtagtgatcaaatgcttaacctttctaaccttgacctcttctaggcctcattgcctgggggcaaaaagaaagttaactggctatctataggtggcgtgggagctaaaattggcagagatggtcagattgaaacattgtcttccagctcctgtgttacgtaagattttggctggttctcttctgtttagttaaaacaaaacagtgggaggctgaagtggcacagttaactactttgtaatctggtaaaggtaggtcaaaaaacagcttccactgaacaggtataatgtaaatgaagccagttataaagttgtgccaggagcattttttttccctttgttgaagggaatgaacggccctatgctggccatccttaactgttaaatatcatctttcaatggttaccgatttggttttggttactggatcttaaaggaggaacaatggtcaacattaacaatttgtcacttaaatacctattaattgataaacattttaactgacacatatatcagctgatcactttctgtgaaagatgaaatcttattctatcataacggtaatatctatcttgtaatacatgaggtatttcactgcttacaaccactgaaaaaggaaaacttgttctagaaactgcccggtgtgtgtgtgtgtgtgtgtgtgtgcacacgtgtgtgtgtgtttataggggggattaatttaaaaagcaaacaatctttgctaatgatcttgttaaaagatgaagttattctactcttgttcagtgctgttagctgaggctgacctgttacctgttactagccttctcttttggtgacctgtagcaaactagaaagcctccgtaacagcaaagcaacattatgctttagttaagtcttagagcaaaaacaccctccttttcaaagccttagaaataactctctcttactaacttttccactattatcacagacttcttacatttaaaaaaagctccaaggattgctttcatggactatgtacataagtgcaaaaaaggtgtgtctcacacatccgcaccctaactgagacagtcaattaactgcagcatatgtttcttaaacactgttaaggggtcattccacagtatctttatgtatagttttaaaaatatgaattaatttcaaaagaggctttagtcatacattaatcctcatatagctatatttgctcatgtaattccagaaaacagaatttttgcagctacagctatgccacttgaatggggtaattttgaattaagttataaaaaaagttaggtaatgtattaaaaatgcaatgattgcgttttgaagtctaaatactgtggaataaccctatccacacaacaaattctataaactataaagcctgattctagaatccatgtgttataaactttttcacaaaaagtcacacaaggacacaaattcagcttttatatatgggcctttgggattaaaaaagaactcaaccatgtctgttttcatagttttgagctgtattttctacaggctcatactgtcacaaatcacctatagtttacaagtaaaatgttcacatacacaaatgtctaaaggtagccatgttgtaattttgttgccaaagcaacaactaaatataattagataacaattattatttgtatataaagttaaatttgttcttaaattgtgaactgtaaaggatagttttggactataatctgtatcttgtcatacttcagtgtcagttcagaacctagctaggcgggcagaatccatgcagtaaaagcttaaactttctttaactttcctttgaaattaaattgattagttacttagagctacaaaaaagcaataaaatgaaaccttaaagatgaacaataagaaaaatgaaaatatggtaccaattagtgagttatatttacagtttgattaggctagtaactaaatttacaaaaaaagttgttatactcttggacatgctatttattctagtgccttctacaggcactggttaaacaaggctactgtcttagtatatctattcatcagaattgggaaatcagatttccctcataaattttgcctatttctgtttcaatgtatgtgaaatgtatttgagagaaaaataatgaggatttcagtttctaatcattctgtacctcatagcctaccctacagactaaaggaactcggaaaacttgtggctgcattttacctaagagcatccttatctatactctgcaatgagggggacaaagaaccaaataacatttcaagtagcacattaactttctctcttatttaataaaatgtaatgtaaatgtcattccttattcagataccactatgcttattggtaatgctacttaaaacagattcaagttgcaaagattaatttcattcagtttctgctgatggtagggaggaggtacttgctttttcccaaattggagagccggtgagctgaggccctcccattagtgaacaccacctagtggtataggacaacacttatggcaagatcaaagtgcttcagcatgttcaaaaacggatgaaaaaaattgatggagtagagagaagatgactttccacatcatgattaactacaaattaaagcctctgatctagaaaagtgaaataaaatgccacagctggttgtggaatcatgcttcaattacaaaagtaaatactgtatttaaatagcaattttatgaatccatttattttaatttaatcttaatccctctttaaaatatacgtatgttatggtcacatagtacttttttaaaaagttgacactactaaaaccctcttaaagataacttttagattattttctctgtatacatgacccgttttatccaagtttcagcactcttgcatattttttgcaaaaggctgagaaaaatggacaaaaacaataaatttggataaatagaggcccctgtaaaatacaaagcttataaaatgttaactaagaatcataagtgattagaattttatatatacaattcatccagtaaatttttgtttagagtcactgattagttttgtgacttgtctttttaaatggaaatttatagtctaatgacttatctttcttcttttctcttttcttgaataaagataatttgaataagtcattgcacatctagtttaaagagtgctatcttaaaattgtatttttttctgaaaactctattgaatttgatcaaaactttagggctttgagctttctttctttaagttcatttagaaaacaacttttaaaatgccaacaatgtagaaaattgtggcaccaaaaatacagtggccctaaatacccctcacggaaccttttactttaaggtaagtcattgttaatgtcttccagtgcttaacgcaacatgaaaacagctgtactgtaggtctattatctatggtttatgtatatctttgcccaaagttgaaaaagttaagtgagacagttcactgcatgcagatgtcaaactacacaaaagttcattttgcacaaaaaagttcttgtctcctttaaggaatatatccagactagctcaggtgcatccctcctggattcatgtaatcagatctgcccttctggagaggcactggcacggatcatacaaaactcagttccatacatgatgaatttcaaaaaggcatacactactttcttctatagcaatgttaagatttcagaaatagaaattaactggttcaaagagtccataggtaaaggtcaggacaactcttgatctctaattccacgcaacattgtcaacagctgacaatgactcaatacaagcaaggctgtttagaaagcactgttgatcaggatttggatggataattaagatcaacagagtatcaattcccagaaagctaattttgctctcttatattctgagccaaatgggtctgctttggaagagagcatcaaatgttctgaagcaaaaacaatgtgaaaaggaggaacaatgggaagcaggagatatttctgggtcccacaatggctaaggtagccttgggcaagtcatatgcccctggattcagttccatcaactataaaaaggattttgctaattccattgttctgtgattcaaacacttctagccagcttaaggtatcctcaatcagatttgctttttacttgtcattttcatgaaggagaaaaaccattatatatatatatatatatgtatatgatggttttatactttctggtggaagagcgcctatttactagaaaatattaaatctattacttgatgtaaaatgtcatgtgtttccaccactgtataataacattaataaatgagtagagtggatgagatatgtcacacaccacaggaattatttggttgtaaaattctttcataaatattagtaatgtgaactcagctgagctctgtggagtatagccactctgtctcattcaaagggtgataaaaccctttctattgtcattttcaaacatatataaaggcaaacgaatccaaacaagcataaaagaggcttggttatgatgtgagagggtctgatgttaaagtttgggcagggggacacttgccatatatcacaggtgctttctccttcactgaactgtttaacaaaacgaaactcagttgaaccgaagctaaagacaactacaaccatctttcccagttcttttgaataaatcaaggaataattgtaagtgcttccctgttccctgtcctagccatttctccaagcctgtactcaggctccctctgtgatcaacagagaagactgtccatttggggagggaagtcctcatttgcaaccaattctctttcaccctgactgacttttgctagattgcatcttacttgttattcaaagagtagtctaaagagcatgagccatttgcatttggaaaatggcatttgtgtaaaaggtgacattgccatggttttacacactttcctccagtacgtaaaaactatctccatgcccccatctctccgtttgatttataacttgtaattagcatatttttaagctcccaagtaccagtttctcagctgaagatgacaaatggctcagttttagacactcaatttaggagatgggattctcaagccacacacacaaaaaatctaatgagcactttacataatttttagtataaatgctgagaaattcatttaaaggtaaagtcttatttgccaagctatttaagaagagtgaattaggggttaatgttttatgaagttctctgctttgtgcaggtaattatttctctctttaaaaaatctagtaatttgattgtattatgcaacatcagatctgcaggtacaaattatacacatgcatgttaatgagcaggttttgtgcacattcaaaagtgaggcgttttaaatgtcagtcccaagaaacctacagaaatattctaaagaaagagagcatatttgcatgaacctgtcatgttcttaagcacatatacttctgttccccactaataacactttagttgaaatcaaacaccacacatatacagcaaaacactacagtatgtaaaaacctaacacagcacaacacaatacaacacaagaaatggtactgaatatatttgttacatcctgaatcaacccaatagactatcttgtaaacaaaatagtaaggtaacacttcaaaaacagatgaacaatttatccaccaagaatgtatatagtaagccaaaagctcactgtggaaatacacttagcatggttattagaaaatcacaaagagtaatgtaacaagttaccaaattttatggtcatgttctgcttgataattcaaataggatggatggtagttactagttttctatttgtgttgttttaacatctccattgatttttaatgctttattttttatttgaatttgctggctggcaggtttgctttgcttaatacattgactgcaacacgcttattgttgtgttggtagaataagacatacgagaatatatatagaaaggccatatggaggtttccatggaaagattctgatactccataactctgctgttcagaatttcagctgaaatggaaaaaaaaagaaagaaagaaagagtgagaaatattgaaaggttattgaaggaagagtcaggagagtgtggtgggtcttgttccagttctgtctgttaacagtgccaaaatatccccaatctgaatttcagattgaaatggggcttttgagaatgatcatgaaagaaccatatatctatgatagtctatgataccctttgagtgctaatgtggagaactgtcctaacagagatgcaatccaatgtttaaggcattatctatctactttttgttgaacatacacccatgtgtccacctttcaacaggcatgtactgagaaaacatgtttgataccgaacattttgaaatatgcaaatattaaatacactttcaactttttctctgaatgttttagagccatgcagaagtagcctacctgtgaaatctgggtattgtattgtacaaaattacatttttgaactttagaggaatttttagcacctattacatattgaagtgattatgttctgccaaatatctctacatttctaacaaaatcaagcaagaaggaatcactcttccctaacatgctctgttggaaagttaatttgacaacttgtggttaccttgacgtaaagcagcccatgaaagttgggcaagtgttggcaaaacctacattatcatgtttagtgctatttccaagttgccactatcccaaatgacacctctggaaacaatgacaatttatagctccttcagttatcccatgtgctcaaaggtgccttttaaaatccttccttatgattgaggagacctatttatttaatgtccagtcggctatctgctctgtccagaacacttagtgttctaagcccgtgtgtcctcagcaggaaagaagggctagctggggtctggggaactagttcacgagggaacagaactgctgcctccttcaaccaaatgacacactccaggtgtgagaacttcaaactttcgatgatgaaggtatgcaattcagagttggtacactattttagtaagtccctagaattaattaaaatacctaggagtcttaagtggcttcagaaatcacatgttcttaagtgaatgattgcttaaaaaagtgtgtgccatgatgggcaccaggcaaagaggagattgagggtgaaggagaaaaaaaaaatcccacaacaacaaaaattttaaaaaagagacatgattggaatgaaaataatgactcagttactaaattatgtcactcaaaattcaatacaatgtcacatgacaggcatagtgcttactgtgtttaacataatcatatcagtcaaatcctgaaaattcttgtttgatcttcaaaaaaaaaatgaagctataaaatggttaaagaattacaactcaaaagtaatctgtgcctctggctaacaaattatatattcctttaataataggaaaacatttaagaatgtgttagctcattgagaaaatacagtaccagctgtcattgccatataaaaaatattgcatatttgcactcacatttcaatttggaaaatttataatgtgtaaatcaagctctacatcacaagcaatgtctatgaatgaaaatatttacgaaagccttttagaagtgcaattgtgtaaataaaatatgtagcctataaatattatttatattaatactgaaagaaacttactgttctactgagaacttctacatctgtgaaacaaacatgctgctattcagttcatctattgataattggggtatctatagtagtaaaaaagattttagattaaaatagtttcttgggagaattctgtttatgttgttatatatgtggatcttttagtctataagcatggttcccactttaataaggcaaaatggccctaatactatacaataattattgtatgtatctccttataatttcaagactccccccaaacttataatctgccttgtgaactctgcctagaaatacctaaagcaaataaaaatcaaaacaacaagcacatctaatgtccatatgagaaggaacttctgatgtaatcactgcgaaatgataaggatatccatgtcttggaaagaaatgtgatattttgttttctctccagtggatctgaaggtaaaggtgatgactgtactaagccaaagtttaaacacaataatcaaaaatggcagtgaaataaattctcttgaccaatgaggaagcatttaagtaacattaagtatatacatttgaggattggtgtgttaccagtaattaaatatagaatatcaagagcaacatctggtaaccaattaaaaatgagcaaaactcctctgattcatcttgggatgaatagcaaagcacatatagcattctagaatatacacaaaaataaaaattctaaatgtgacaatggcttaagaaacacataagaatctcaccaatccaaaaagcatatactgtgcattaccaaaacattgtagttatcttgatctgaacagcttaaataaatggccaaacctgattgcctgtagttggtgcagcgaacggaacgctggtggcaggtgttgttgctgcagacacagtggtaggtgtagcaccgtgcatcatgggcactttcagttgaaaaccatagaagcaacacacgggagggtagaggatttatgcaaccataacatttacgatggaatgaggtgtggtaggtatcacagcaacaagccatgtgacatcataacgatgaatacatcagggtgttcatgcaatcacagtcagtgcaaagcaacacagcatggaaggggggaaaattaaaaagagaaaaggggaaagccaattatagttaccaatatggaaaatggaaccattctcaacatttagtaagtttttgagcagaatcccattgtagtttactcaaaaggctaaattttcagaaggggctataatgaatgcatatgaaaacaaaaatccaatgttacaagggctatctatctgaagctagttaagcagacaagtaactggactgcacattcaaaatggaattaaggaatcataaattggaatttaggttcactgacttatggacatgaatgccgtcactagatttgcaggtgcaaacaggcagttatatgtatacttacctgatctgcatgcaaagacatggtaggtagactggttggtatgtggtaggggggcagatatgaagaatacagtggactatgcatgcaggtttttaagtacacctctggcaaactcctgggaaactttggccatttatcaaacaaatacatggagtacttcacagtaaatcttgtcttcacagcaactattatagctacaatggttagcagctgtgaaatctcttgcaggatgttttatctttgccttttctagtttctatctcatttagaaagcgttttgggtgctttctgatgtctagctcatttcagaaagcaaaccagggaattaatgtgtgaatggcaatgtgtgaatggcaagcatgcatatgtaataatttatcatgtctacatcaattaaattcagattttctgaaagtctaaagagaaaatgaatggccagagaaaaattaacatgtgcaatgtcatagaaactgaaaatgtaccccaaatggtgattaacagaaactccatagttatcccttccatttatctctagttacccattacccagagccatccctgttgtctcatatgccaattctaaaaacactcttgttttccctttgggagtgcagcaattgtacaggaagcagatccactaaagaatgcagtttgcattcctaagcaaagctctgaaggtgaaaggacaagagagcatcttcaagaaaactgtcacaaaacatgaaggcaaagacacatttctcaaacttgcagaagtctgttctaattgtacacattatgattcaaaggtatacatattgtgctcctgttggtattaatggaaatgtttattaattcctacagaagacagtcaaaccctcagtaacaggggcctcacttccattcccagggttcagatctcgctatgttagtgagtgctgctactatgtggttgtcattttgaactttattctcaagaagcctgttagtagtgcttttggggctctgcatctattctggtccaccaaggtgacaaaggtcaatttgttgcaaactctcaaaagggaggggatggcctggattgatgtgagacggtagagtgggacgggttgggatcatttctccttgcatagaacagagctattttctcctggtctgttccttgtgcccatgaggactgtaggagctgtgaactccccattcctttctcatgctcttcagtattagtgctgtataaaatggtttagagatggctatcatattgtgttagtggctaacaaaaggatctgtgtgcaactgcttgttaaaaatcacgtaacactcaaagagtcattttgaaatgattctgttgtgcctagcttctgtgccaatggtgcttcaggctagaacactacaggattcattacagaacactgcagaatcctctggctttgctgaactcatcctctcgcaacataggaacattgaatgctttaagtcctatagataactttttcaggtgggaattgtttcattgtactttacaagttatacattttaagtattttacaatttttaaataatacatgttaagcaaagaacaaaactgcccagtctggctagtttcaaatattgtaaaagaaacgattttttaatatttcagttgctgttgttagggtagaaatagagaaatgacagggccagtatttggccacagtggcaaccaactaggacttgagaaagtaggactattttgatgctacaaagacataaaacagaaagcaccatgttaaaccttaacatactcagaaaatttccagccacatctttcagtcattcatctttcatagtcacaacagaaaaacacattttttcagattagaaaatgttgataatttttgtagaaaacctaccaatatttgaagcgggtgccatgcacagtattggccctgtacaccacgcagaaaagcgtggaaagtaaaagagatatttgattattaaggatttactgatagaaatacattttaacagaaagattatttctttgcaatatcaattactcagcacatgcaagtccaacaatctcccatgtttacaattacagattagttttaaggtcacaaacccaggtaatcaaaataattcttggattcttaggtacaaaatcagctataatttttctttaaaagaattaactcacttaaattacatatttattgtggacaaatacatcctaaataatttttataataagagaattttaatttattacacatatcattttctaaatatgctccagaatctcgtatctggtgtccgtgtttctatttagagtattaatctgttaacactgtctcctccactgtctcatagtcaataggacttgactatgaatatatggcaaagaggttccattaagagagacctcttagctggacaggcttttatgttgctactaattaagggaaagggaatttttctgacatttttgcttatgaaactagattttatgttggccaaatctggcaaaaaattcaaacttggaaacaaagtaactgtagtattaagaaaaactatgatgaacagcatacattttattatattcaaccaccttgactagacttccagggctactgaattcattccacagctataatacaaattggaagtagccaaggtagagtgatctaatgtgtaggtaaattaccacaatttttgaagaaaaaaaatgctaggaataaagtcatgtcaactcatactggttttctcttttactctgtagacattatgtgtgtttttcttaggttgggagaaaatatctaaattattagatatcagtagttacttattataagggatgtaagaaagtgctgaagaattccatatttcctctcagaaactatcatataaatgtatacaaattgtataatttaaatgatggcatgaaggactgctgtggctagtaactaaagactggtgttttatggtacctttcaaaattaattaactgattaatttactagttaaccaataagttttctcaagtctgggtattaacaaggatttctaaattattttttaaaacatatgttattttcatttaaaaatagtttccaatcttgggcatttaccattgtgtcaaaaaaaaaaaaaaatggaaaaaaaaaactgctgtactctcaatggttagaattttcaatttattcctaagagactatatgctcattcttaaactactaaaccactggaagaaaattagtttccccccaatatatgatatctaattgaacaaatttctggcttaacattttctgttcaatttcatgtaaaacaggctattaaatatagctgaatgtaggagataacaaaatatgctgcaaaatgtcagaaaatataaactgctatgtattttatattaactgattcaggagttacaggctaaaactatctgtttaatctatattatactatattatgcacttagggtagttttattttaactacctttggcatatcaaagacatattgacaacgcatttccataatatcgaagctgggagtttttgcctttttatttgacagcactctactgtctgtgacagtgatacctaagagtcaaggaattagtttgagactgaaccaagtgaattaatcataagcaaaaaccaacaaatgctaaaaagaaaaatgttgatactttttcctagtttgatttcaaaccatgaattttcatgaattatagaaaaacaagtagttctagatactagcagataagcataacttccttgttttatttttaatcaaaatacatgtcgacagtcctcctatacaagctctttgaaagctgttttgcattgtatacattcacaacatcaccaaactcgctgcagtgcctagagctgtgttctcacctgcagggataaatgccggctgtgggagctgcaggttagtcagagcctgttggcagtggaaaacagtgggattaaagaccggggtggcaccattgggcttttccagtgctgatctctttggtatcagttgcagtgtaccaggctgcagggcctgtggggggagagatggtactagtactagagaaagtaacaaatgtactcaaaccaagcaagcaccagtcatataaggtatttcctgggaatcctccgtaagggtatgcattgggcaagacactggataagcagtggccccacagcaaggtaaccaaatgtagagataagggggttcacagccgtgtacagtggctcacgcctgtaatcccagcactttgggaggctgagaccagcagattgtttgagcttaggagtttgagaccagcccgggcaatatggcaaaaccccatctctgaaaaaatagaaaaagtagccaggcatggtggtgcatgcctgtggtcccagctacttgggaggctgagacaggaggattgcttgagcccaggacgtcaagactgcagtgagctgagaccacaccactgcactccagcctgagtgacagagcaagagcctgtctcaagaaaaaaaaaaaaaaaaaaagaggtagtccaactacatgagcagtagtgcaaaacaaaaaaaaatgcaaaaaaaaaaaaaggttttcaacttcactaatttagacctcatttgggcaggatatgacagaaagctactacagtaaacaatcatttataattaatatctcagggatactcatctatgaatctataaaaatgagattagcagaagcaacagatatagcaggaaagagatttctgcctgttaaaactccaatacagatctaggacataaatggcatataggtgataaaacagatgttggtagatcagagtctgacactgtcaccccataaaataaaatccagtttatacaaagacttcaggttcaagtcctataattatatatttcctaactaacatgtaaggaaaaagcaaatgaatatttcctcccccacgacctacctcacgcaggtactatgtagatagttagcaaaatatatgcagttcttatttatagaggcttgctgtccatttcggtatgtaccatttgctttgttaagttcttgtaaggtttaattctaaaacctattagcatttttaaaccatcctttcatgtctacagttctttcaaaatcccactgtgcttataatactccgtgaaacttgcccctggatcagattctttggagaagtttaacattactttacattttttttttctcagcaaattgcacgttacttaaaaaacatgtcccagcaacaacaattaggtatgctccaaattcttaaggaaacaggaatgcttgtgttgagtaactatcctaccatgtgtccaaaagggtaatgccatgacctcgttcctgtggataacaaaggtctcaaggtatctctattttcttttgggaactctactgtcagtgcacacactgtgacagatctgcttttcatttcacctaaataaagaaaagcatgctagaagagtgagataaaataaactgagtagctttagagatataaaatttccaaatttatcccagcagaccagatggcaaaggtcagtactaaaatcataaaccataaaacaaaatctatcatttcgaatgccttttattaccattgggagaaaatggttttgctgaacattttaactaagacagaagacctacttatctggttgttaaaaagatttccctttggtataaacggggagtgtccccttctctctcttgaaagttggcagcatggtatgatcatcagaaccagttatgttccctagtaaactacaaattggggtgaaacctagatgaacattcaacaggtagacgctggtaaggtagtactgcttgtttatttatggctggggtttatcctgatgggtcagtgcccagttccaattgggtggtgattgtactattaaactcataaacctgccgaagaggtgtgagactgtggatgaactaagtatcaaccctttatgtctctctctttttttttttaaatacaagctgctttctgtgaactcaacctgagctatatacatgaacaaggtaaaaatgtctcttttataaagcatgtccactatgaatccttaaaaatataaaaagcttgaatttcttcatgaagccctcctttatttaatcttacctctatcaaattcttatgagccaacttgatctcactgctaagaccctgctgtgatcagttacttaaaagggaattttatattgatattcacaagtaacaattgaaggcctatgatataatatttagctctctacgtggaaatttgaggctgacttgtaacctatgcattctatcaaacacactcaaataatcagaaatggacagatgcatatgaagctattttcatagcttataattaccccttcaaaagcatttaagacaaaaagaatttggtaaagtcttttttaacattcattaacagattatgttgttcagatcaagggagaaagtaagtttgttctactttggtgctcagatccttcacgatgtaatgagttcagttctgacaaaaagtggagccagtccaaaaatggtactgtgtccttgaaaccataaactaccaggaaaagggagcaatttgcagtatttggcttagacaggagacatgagagtcactctcacttggaatagggactgacttcttttgtgaagttccagttgcagcaagataaatttcaactcggtatgaggaaaaccttcttaatagggatgtttgaaaataagtgtctctctgttgtgaataggcaaagtctctgtcatgggagtccaaactatgaatgtttgtgaggagatttagctcacagtgcatctcctgggcttcagggtcatgtcagtgctttttccacacccagggaacatgaggtttcctgtgggttttgtcctttactggggctgttatgccttattacacaaggaaaggtccagggagaaaaagaaagacatagcaagcagcacatcaaaacaacggacagctgtggcaaacttaagtcacgagaattcctggttctcagtgatcacactgcagtgttacacaaatatttttcctgcttcctacctttcagtattactaagcagcactaactgttcccccaaaactggctttctacagcaacttaaaagtcaggactctgggctgcgcacggtagctcatgcctgtaatcccagcactttgggaggttgaggcaggaggatcacctgagatcagaagttcaagaccagcctggccaacatggtgaaacccggcctctataaaaactacaaaaattagccagaagcagtggtgcacgcctctagtcccagctactcaggaggctaaggctagagaattgcttgaacctgggaggcggaggttacagtgagctgagatcacgccactgcaccctagcctgggcaacagagtgagactccatctcaaaacaaacaacaacaacaaaaaacacacaaccacccccacaaaacaaaacaaaacaaaacaacaacaacaacaaaaaaaaaaaaaaaaaaaaaaaaaaccaaagtcaggcctctgctcccaaccacgtagaaatttccccccagactaagcaggctgctgtccttgatactatgcctctagagaggaaaagtggccttaacctttaggaaattacaacctacttaataccctatcttttaagtgctgtgtttttgaaaggcattaaggatgttagtagcaaagggcccatgaaagtggctcacagagcagaggcaactttctgcctctctaggatattgagggtagtgaaactataaaagcactcaaaaataacttactgtttaaattatataatttacccttactctgaaaatgggagaaagagcacagtaggttaaaagcattagtaaggcttttaaataattatctttagaaaatcttagtaaataaagtagaataaataggttctttcttttccagcttataaccttgactgttcatattaaggtcctctcatgaccatccatgagtatggttacaggatattagacaaattgaggaatatacaaagcatttactctgaaacaggccacaagtgcaggccttttcttaccatggcagaggcagctgaatggttcatctgatgatgagctgccttgagtctggcttgcaagtgtgcaggaggatgaaagtacttgcatttctcccgcgagcatcgacctttgatgtaatccatgcagattgtcacagtattatcactcgcttcaatcatggaagcatcagtagggtgagcatagcggcaatcattctccccacgggtacaatttccacgctgaaattctcggcaaaccttagaacacacacatgcacatacacacgcatcacactgatgactggaagctgactggcttttatttattttgctagtgaatgtaacagtaattatatatacattgaatatattatgtgtgaacaaatctaaaaagataaagaataatgtaaagccatattcactatgagatataaacagacagaatttctattcccagaaaaaaattctattctccccaaaaggaggttgtccttacattgaaataaaaatgtttaaaaaagtattactgaaaaccagttttaattctccagttaatacacagccttaagcataattagtgtttttttaagtccaagatgagtctttatcacaccataatgcactggttttccaaagtcaacttgtgaaccataactgagttatatgtacaatcagattatattacaatacattactaggcatttaagcggctgcaaatggagctgactttgtaaggaaagactagttatttcaatgtacaaagaataacaatagaagaatgaaggacttcaataaatcaaaaagctgtttgaaatttctttcagattttcttttcttaggcatcggggttatttactgcctagcacatcactctcaaaatggagaaaaaagttgaggcactatgagactaatttaccttctgtgttcatatagctttacattctgcaatcgtagagagttatattgtctacttttttcccactttgattattctagcaagtagagactcattaacaaatatagtaatctgtttctgaaagctggagcctaggtaaaaggaacattcccacagaggcttcctgtgccatcgcacagtctatggctgggtacacttaacatattgtttgacctaccatacaggtgaatcaatgcactttataacaaggtatgattgcagtactaaaatgtttaacaaccctataagctaagaaatttgggttctcttatttaaaacaacacactgggctctgagaatactgctttatgtgtaaggttaatatctattctacaggtatttatatatatgttcacaaatacctccagtttatctgaacgcatcagttttgggccaacagctcctggcattgcaagaggtgggtttccaggaatcagaacaggtgtatttggtacaagttctgcaggaacgaggcccatcccaggatgtggtatgtaaggattgaaagccatgggaggattagctggaattgatggagtcataggaaaagaaccctgtatgtttaaaagagaaaaaaagatgttagaggtaaagattcttcctgtcattacacaaagaggtattctttcagaaacatcaaaattacttatgccacatcaaaatttactattgttttcttctgatttatttttagcctcatactaattcccatagaggagttgcttttaaaccaacaaatctctttacgtactaactttattggtaagctcataaaataagccacatgattttaacagtcatgaattatccaaattaaatctcactgctagtctgttccaaatgtgtttcctccaactctttctttattccctaaaaaccatgtcaccaatgacattacacatatggacaatcttctttgtttccttacacaggcatggcctttgcattcagtccctttccttcctctttcctcttcaccatcaatactgcttggctgtaaggctgcctgtcctaccacaggccccacctgtactaccaaatactggctgtgcttctgtcttcctggcccactgacaattatggaacacagcaaggagttgaggaagaaagtgataaattagaaaaagtgagtgctttaatatctacctaaaatgagtttagtatggtccattatattttgttatttttttaaatcagaggtcctgttttttaaatttttatgtgtacatagtaggtatctatatttatagggtacatgagatattttgatacaggcatactgtgtgtaataatcacatcagggtaaatggagtatctatcacctcaagcatttatcattccttggtgtcacaaacactctaattatactcttttagttatttttaagtgtacaagaaattattgtttactgtagtcatcctagaggtcctgtttcacaagctaatctgacttgcctagccttgtctttatccagggggccagatgatattcatagttcaaaagaaggcactagaaatgctacaagaatccctgttaggcaggaagagataagataacaggattatatggtacacaaactagagtaacttgtaaaaaaaaaaaaaacctcagaaatgcaaaaagctattactgctttttctattttcaaagatcctggattcaaaaagtttaatatgtgtatttcctttattatctgttgccatattatttatcactttgctgttttccagtttgttccacatgtgggtatcttttcttgtcaatgtggttttattcctttgatagttctcatctcccctatagtacccaacacttagtgaatgactggttgacagatatactcaatgatacattttaaaagcttaatgaatgaataataaatcatgactaaatgtagtatatttctaataatgactctacaagttagttattgtgaaactggtggtgtctcattgtgtattactaattgcatgtgttccttcttgctttataaaattttttcacttgaaaaaacccccgaatctgttgcatttgccaaactgtgcccatacctgctaagtcacattaatagaaacaagtctaaatacaaattgtggaatataaagtgaagggcaatgtatactcattgcctcacccccacacagacttgaaattgtcacccacacagcattccaagaagactctgttataaaccatattcagcttagaaggaagcactcccccattagcattctaccttagatgagtttatcaaattagctgattgggacattaggaagggcagaaagaatctggcaccaaaaaactggcaagactcacgagggtgagtaggaaagacatggttgccaagagccttaagtggaaagggaacgccaggtgccaggaaagatgatggtgtagtcaggagaaggactctaaagtctgggggcaaatagccaagggctgacccagtctaactagctcttatgatgtaatagactacaggaatacgggatacttgtcatggaatgagatgtgaagctcaggaactagctgatgtgacatgattttatataatgagaaggaaatcttctggaaacagccacccaggcatgcttccgcaataaggcagactttatcaatgtaatgattcatagttgtctcaagatcaccaagaatctctgatgagaaagagtccatttttgaagcacacgatagtgctcttcacttgacttttcgttgtctctgactttcctggtaaatttctcactgaagccaccagcccattctcctgcatactttttgctcttgccttttacaaaaatgagcaggaccattattgtatctattaatttttgaactgaaagaaagacctggaggtgggtgaattttccagattaaaaagttattaatcactaataaatgctgatcaatcaacaatattgaagcctaatgtatttgaaagcaatgctttctgtttatggtagctttttacttctgtaatttttttcttttcttttttgaggtgactcaccagggaaattctcctagctaagttctgctttctttggaatacttttaaactttcttaggtttgttatatgctccaagtgtatggaaaaaaaggctataaattaatgattggtctacatataaaatgtaaagggcttactgaaagtatttagatttttctaaggtttcaccacaaactatgctatctttagatcttaaaattagtatcctagctcttataactatttcctccttgagtatgaaatgcattctataacactgtttattgagaagaagcaagctatcccattctcaatactggggcagaggcaggaactcctgagtggcttatttattttcagttggacatttctgttttctcaccaccacctctgccccagggtaactactccatttcatgaatttgaacattcaagggcttagcgttgactaacagccatgggttaagtcaagcagcctgcaagctcagaagctcagctttaataagcaactttaatcctgtctctatatatatctcagcccttgatgtcagttgagctaacatgaacctatctgtgggttaatttttattgtaaaggaaaaggttttaactatactgactctgatttatctttacagcctgaaatggtctgaacacttaaatgtttcagatatttaaattccaacctaaattatttactaaatacttgaaaagagacggctgtccctcccataaccaggtgtaaattttcatctttctgagtgttgtcaaccagcaagaatggtggtggcaacagactttatgaataagatcacctgacaactatttatccccatgtctctagcagtattagctcctacagtagaaattcccatgagttcccagtgacttgcagattgcttaggaactatcagacactcaggaaatgtgtcctaaaaattaacgaaatatctagacaacactggctcctaatcttttttgagtccaggacttctccaagagtcagataaaggctgcagactctgtccacagaaaaattcatgtatgcaaaaaatgttgcttgtgatctcagcaagttcaaggaccccacgacactcacccctggtgtggggttatgaactacttactggttaagaatctctgttctagagtaaggctctgcaaactagggcccataagccaaattcagcctgcctgtgtttttgtatggccagcaatctaagaatgttttttacagttttaaatgattgaaaaaaataagagaataatatttagtgaaacatgaaaattataggaaactcttattccagtgtccatccacaaatttcattgtgctcattagtagagctgtattacaaaaaattgtagatatttgtttcctctcttgttatataagtacctatataataccctcaactttgcatcttgaacctcacagcctaaaatatttatatttagccattcacaagaaagttcaccgaccttggttctaaatgatttcaaaaaatgaaattctccaacgctttcaggagtaaagcaccaaatatatattcatatatattcatatatattcatatatatatattcctatatatattcatatatattcatatatatattcctatatatattcatatatattcctatatatatattcctatatatattcatatatattcctatatatatattcctatatatattcatatatattcctatatatattcctatatatattcatatatattcatatatatattcatatatatattcctatatattcctatatatattcctatatatattcctatatatattcctatatatattcctatatatattcatatatatattcatatatattcacatatatatattcacatatatattcacatatatatattcatatatatatattcatatatatattcatatatatattcatatatattcatatatatattcatatatatatatattcatatatatattcatatatacatatatatattcatatatatattcatatatattcatatatacatatatatattcatatatatattcatatatacatatatattcatatatatattcatatatacatatatattcatatatatattcatatatacatatatacatatatattcatatatacattcatatatatattcatatatattcatatatatatgaatatatatgaatatatatgtatatgaatttagtatttgtagcaagattccacaaattgaaaatgtttggctttgtaaaccaatactaaggtattcactaaaatgttcttttacatagttactaatattaggattaggatttttaactatttgtttatagaacaatcactactccgtgactaagaatggggaaatagtagttggaatcctgtaaaggtaaaaattttaaaagccaccacagattgctcttaaaggattctgaggcaatgcaattcaatgcaaaactatgcctcaaataaatgtctagtttacacacactttaggaacagtgacttaacaggttatttctcaagctagtataaataaatgaaaattaaatgttatgccaaatcaatctttgtgtctcctcaatagcctagatctatttgtagttacctcaaaaatatccaagatcaattacaattattgttggatgaatgtaaaatatttcaaaatcctggcctaaggtcaacagaataatcggggccttccatctctgagttcctgtctagagttgaatgactagatattttcttttacagaagggtaaacatttggtaacaatttgttgacccaattttaatacaagaaaaatagcactcataaattttactagcgtcataatatcttcattttattgctcatttgcaagcatttatataatataaaaggaaggctctttttacggtcatcatgcatatttctatctttagataatcccaaaatgcactgaaatccataattttagtttccatcagacttcactttcacacagagtacaattgaataatctctctttcacagtatttgcttggtcatttccacactccttgagtaatgttccgtggggactgaagtggccaaaatgcaggctgcaggagacccacataacctccagactagttaattagtttctcaataattgagagttaactttaaaaacagatgcaagctgatagtggtgtttaagtactaatcgtacttgttaatgaataagtccccatggctctagagagagctaagaaaaaaaaagttcatgggtcaaaagtgaaccattgtcctcacctagacctggattttctgatcttattaatcagagaattctccaagtaagaggaaccattgaaggcaggcaggttagttgaaagatcaataggtgattgtgagtataagaggtataaagaataacacaaatgagaacacaagtcatggttcagagctacccatatttgctgggaggagaaatacaacagcaggccaggaatcataaaggagtacctaaacacagatcagcacatcacctaggaagagagcaaatgattgacacttataagcagggtaactttgacattgttcctgaggaggtgaacaggaattgacctaaaaatttgttggtgaccaccgtgtaataataatggcaattcaattaactttagtattctagtaggaaacaaagattattttttaaaaaatcaagtttgtggcatggattgtagtaatagtatcatgagcatctgtttgtctccaaagtcatcaatttgtatacattgaacatgtgcagcttttgtgtgtcaatcatacctcattgaagtagttcaaagaattaagtggttatctagttttaacaaagggtataaacaaaatgtgggtttttgggagataaataggaagaactgagcaaagcaaggaacccacaggaaacctggagactatttatgaacatgtcagtgaaagttagataaataggtaggctaagagtttaaaattatcaagggtttgaccaaccacaaccaccaccaccaccaccatcaaaacaacacaaaccaaaacagaaccttgcatggctaatagaaagataattctatgttgaaaaaagaaaggcccaaagctacaaaaatatgaagaatcaggtacaaatcagaaattaaggggaccagaaaatattcatccaacatcttacttttgttacataacgaattcctagagggtagagtttgtttcttgatcatctttttatccaccctttactcatttaaatacctgtcacagagtatatgctcaatacttactgaattcaataaaaagggattcctaaaccattaattaatttttgatttactaaatagatcaacccaatttaaaaatcagagtgcaaaaagaagtaaaagtagtttcaaaaatggtggcaaagaaattgaataaatccttcagtcttgttctccactgaggaagactttaggcagatggctagtcctaagctgtcttttgataaagatatgaattgctagatcaaacagtatgaaaagcacagggtattttatacatacatatgtacatatgtacatacatgaatcccatatgtgtatgtatttttaaaattggagtggctaaatccatactagaaggtacctaattaagagttctaaaaaaaagtgatttagtgatactatagataaaaatatgtaactttattacaaagtgtataaaaagtaattttttatacactttgtaatacacaaagtaattcacacctttttatacacaaagtaattcacaatgtgtataatccaggtgattaatgaattgctaatgtgactggtatccagagtggttcaagagagaagaccacggaaagaagggtgtaaatgaatatttaacagatgattacaggatattaaggcaaattagaaatgcttgggggtaccactttaattatcaggtggtagggcagccacaggtttttatataaggtctcctctcattgacaaattactgagccataccaacctgcaggtaaaaaaaaaaaaaaaaattcacagagcccaccaaactcccagccttcacctcatttgtgatcaacagcaagcaatctcaaggtagctggctgtagcttacactgtgaccacgaacagtgaagctcacaggccaccatggtctcattagcaccaggctccaactaactgagctaaccagccccagaggagaaggacacaaaatagaggaggttacatgtaatttatctcacgggaatatataaaggatgataaagggagaatgttgagatttgtgactatcaaagaaactggacactatagaagatatacctaatgctaaatgatgagttaatgggtgcagcacaccagcatggcacatgtatacatatgtaactaacctgcacattgtgcacatgtaccctaaaacttaaagtataataataataaaataaaataaagaagatatcatgtacaagtgtcctctgtttggctgcaaaagtgtagcattttcattcaacttttgaaaaaagcagatttcacagtgtctattaacagagatggggcaaagcagcaaagggactgctaggggatttattttgttttaacgtaaaagaagctttaagctatgtgacatacacagtcttattagcaaaaggcccgaataactactctactttggaccagtaattgcaatgaggagcaaatctaggatatgtggggtctgaagcttagaccactgggtggggaagtggagccttaagaatgaaacacacgaatatattttgcaaattttacaaacacattttaaacacgttgctaggacccctctcagggttttggaaggaaaccatgcaaatgagcatccctaaacccctcatgttagtctcagggtaagtacaccttaaaaacaatgttagttgaacaaacagattacagtaggcttcagttgatatacctaaaagtaaaattttgtctaatctttcagaaaatgtagtaaaatccagatgatcatggcatggtagcactccaggcacttctgtgatatgatttggtcaacctcaatgcggaagttcacatgatcatgactgttgtaattatattaagagcatattaaccttataattacataatgcttgtctttcctaacttgaaaattttgcaaaaatcatttacaaaacatgtaatgtcaccacatcaagatgaaagaactaaatgccatcattcatcattacatgagtaggtgaactgaaaaacctgctgcagaaccttcattaaaatgttataatttctgtactgaccatgagactggtaatttagaatatggacataattttcttttctattaaacctacataatgtctgggtcaccttttaaaataataattgttaataaaagagccatgacaaaactactcttttttatagcataaatatttcagtcaataaactaaatttatgtgaactaaaaaactgtaagtctaatatgaatatttgtcctcttgttttcaagtactatatcatttaatgactgacttacaaaaattaaaaagtaggccaggcatgccagcactttgggaggtcaaggcaggaggattgcttgaggctgggaaatcagtaccagactgggcaacatagtgagatcacatttctatttctattcaaaaaatttttaaaaaacattactgtgcatggtgatgtgcacctgtagtcccagctactcaggaggatggggcaggatgatgacttgaccccacaagtctgcagctacattgagctatgatcatgccactgcactccagcctggtccacagagtgataccgtgtctcaaaaaaaaaaaaaaattaaaaagtaaataaatattttccaattttatctccagtcacttaaaattgttctagtcctaagtttataagtaatataaacccaagtaatataatacattgtagccctttagtaaaagagaaaaaaacaacattaaaaacatgagtctaaaaataatattcattaattagtatatctcccttcctcgtacctatttgaactttctattattttttttctcttggttctgaagcattacatcaccttcgttccttactatattaatgttagataaacatataagcctgtttatgagaaatatatttggtaaacagaattatgaaaatgatgtaaaaaggtggagagggatccaggcagctatcagatgattcaatttgagataaaggaaaacctagagaggaagacttgtttatggccttcatggtttggaactcggtaacttagccacaggaatgccagccatgaatagcatacaacagaacctgaggacttggcacatcccaatgcaacctcaaatgtgctgaatcaacaatctctatataaataatcaaatgaatacactctactgagtcaagttcacctgtgtgtcaggatctgtttccatgtgaatcaccacattcaaagagagaaactaggggaatttcccaggttttcctttagtttggatatggacaggtgtagatatgcaaaatgtccaaataaaacattttaacagcctgtaatatcatattcactttataaatacatacaccacattcagtagggagaatctttcctcataactaaaatttctaattgtaaaaccaaaattttaaaacattagctttgcttcagggtaatccactgtgcctactctttctaatattcttctacagtggttgtatttgcctcatgattatggcaaggggatacttcaacttatacttttttgctgggaacatcaggaacaatctctcttaaactgcattgaaaaatactagggagtcacaccttttgtttcacctgctgaacttccttaataaagccaaaaaaaagctttcagagatggacttttatactggcaaatgtcaattcagacctgtttaatagagtgaacaaacttgcctgctccagcaagcattccacccaaattgactaggtgtggcttttattcattgttcagtcacactcaacagaatctgttctctaggtaccatcgcatttaggttgacattccctttatctaggggcttataataagcaaaccatattcaattctgcaaaggcagatgtgctcttctggtatcctagaaacagatcaaagtattctttgtggaaagacatgaagttcaagccagtcatacaaatgggtcttaatatgcaaccttacaaatatcaggactggaaatttcttaaacaaaagtatgactatcttagagacaagaatcagattattgggtaggggtgattaaaagggatagagagttgtttgagggagagtaggtaccagagaaattaagtaaaatcatatattacttctgtaataatatcaggatccacaataaagaaattttttttccaaatcagactggtaaatgttacttaaaattgctcacactagctcaattacaccatgtctacaaagtggcttccttagaccatagaagaggaacatatcaaccatctcggagttagatttttgtacacataataactgcaggaattaatcatttatcggctcatcgcatcataacagctatcattaaataatctacaaggtagagaagcaatttccaattgttcccttgggtcttctaagtaatgccttgtatcttgtaacattctataaaataaattgtactcctgtgaatcatagcagtcatcttccgtcatctgaaatctgaaattaccctcattgaagaaaagatagggaaacatattctaacatagaaagcatagagaatcaaattagaaagcacaagtgaagaggctggaaagcacaatggatttcttactggattctcaaaaaagctactccctattctccagtgtgagccagcacgatcaataacacttgaagggttgagacttggaatggagagactctagcagaggctgaatagaacggcttccctctgtacccctactttaccccacttcttgctctctgattccctgaaacaaggcatttcactagtaccctgaagctatccctcgacctttgaaaagataaatgctccagctctgtaggaaccactgggctcaggtgtctgataatgaaatctgcttcctattctttgctcagtttgaaattgagacatcccatgagaagctgagagtaataattgtgagttaaaatctcccttgctatacctttgaccaacatcttcccccatcccctcccacccacatcccctggcaactacccttctactctctgtttctatgcattcagttttttcaaggttccacatatgagtgagatcatatagtatttgttttttctctgtctggcttatttcacttgacataatgcctgccaggttcatccatgtcatctcatttcacaatgtatacgtctaacaaatcatcacacgctgtacactttaaaatatacacaattttatttattaattatacctcaataaagctgggggaaaaaatagaagctgccttgctttattccccacccactcacattttctggacttaccaagcacgatcacttctctgtggttttgttcataacaattttcagtatccaaaagactttatcttccctctgcccttagaagtagggagggactgagatacgtcagtatgtgaaagcccagaaaaagcgtttgcgcaaggagttcaacgatgtaaagaattactgagggtcaaagaggagctttgaggagttcaccttctaggaactaatttaccaacataattaatctgagttccaaggcaaaactttttggtaaactaatagtacagaacatgacatctatttattttacttaaatctgtctagacattctggaaaaagagtatggtgcaaacctttagtgattcatcattgcctctcccatctgtttttgcatttatccataaagatgtactcattaaagggttccatatcaacacagatatccttgaattctgagaattaactttataatgagataggctttactgacagctgattgtcctcccccattttcattgcatctaaatactatatacatatttcaactttcaatatgttcattgtatcactgattaaatgggtaacaaataaaggtaaaacaggattttcaaatttatcctgttaatagtttaaaggaagtaggccagctggaattagaatgaggcaccactgagctaaatgtgaggcctgaagaactacagcagaaaagggacagttttcaattctccctaagaggtgtaaaagcaaaatgaaagtttatattttaaggcatagggcaagatgaattttcaatagaacaatatgaacagatatagcttaattactttataaaggatccatttaaacttgcaagtccagaaaatagtagatattagtctagaatgacataatcttactaatttctgcatagggaaaccctgtagctaagttaagggaaagccactatcaagatcatgggaaattgggaaaaactgagaaatggtcacagagcagagaagagaggggaggcaaaattcaaatgaatgcactgtggtaccctgaatcagacactggaatagaaagattacattaatagaaaacctggggaaatctgaataaagtctggagtttagttaataataatgatgtgtgattccagtttcttgcttttgacaaatctaccagggtaatataagatgttaacagtggggagaactgggtgaaaggtaatacaggaactctttgtactattaatacctttgtaacttttctgtaaatctaaaattatttcaaaataaaacgtttatttaaaagcaacaacaggccgggctcacgcctgtaattccagcactttgggaggccgagacaggtggatcacctgaagtcaggcgtttgagaccagcctggacatggtgaaactccatgtctactaaaaatacacaaaaaaattagctgggcgtgatggcgggcacctgtaataccagctacttgggaggctgaggcaggagaattgcttgaactcgggaggcagaagttgcaatgagcctagatcgcaccattgcactccagcctgggcaacaagagtgaaactctgtctcaccaaaaaaaaaaaaaaaaaaaaaaagcaacaaaacccccatcaaagaacaagaaaatttgtttgaattaatgtcctagaattcaaaggtttccatgtaataataatcaactctccttatcttaaaatgcccctgctcctttatccatattcttttataaagtgaactcatgcagccaggttttcagtgcaacacacctgactgctctcttcaagtgcacagctctgtagtgtcaatgaacatattagtttgtgtcctaaatcctgttgcaactaatttccccaagtccctgccaggttattccactgttgatctttatcggcaattttcaaaatatagctgcgacttacaagtgatgacatttgagcgttttggagcataagctgcatctgctgggcgaacatggctgcggcagtcttctgttgaatcagattgttccgcccattaatctccagctgcgtttttaagtgtggaggagggtgaaggtacttgcagttctctcgggtacaccgaccctgacaatgaagaatagggaaaatattaaattaaaactatacacaaatagataaattttggactccattatctggggacaatctaagctccaaaactcttcatcttgaatccatataaggcgagaaacaccctgaaattcactgacagtctgttaatgaaataataaatccctatgcccggcagccattttgttctttaggttccggagacaatggccctagatcacttgcatgatggaaaccaaagtgtattttggatcctcagctaattgaatgttttttattgatgttaagcactttcaagacaggacagtatgtcagttccgtggaatcaaacatgcttttggtgtcacctaaatgttggcatggctgctgattatggtttactatgtagcagcaaaggatgtcactggactagttgttggtcacattgtcacaatgtgacctattactgtgttgaactcatgagcagtatataaagaagctaacgattctctcttatttggattactaggtccaccataaaccttttaagaaagcacaactgcaaacaattctattttccacagatgctaagattctttacagtaggtgaggttattggggaaggggaaggtggggagcaaaagggcaactttgtttttggaccaaagagtgcaagctgctaggccacctgaattcccgagagaaaaatgagtttgttcaccaagtgttttcattcaacacatgctatctgcattttccttatttatgatgcctacacagtttatgcaatggcttctccattgtttagttatgttgttattaaaatattcctataatttcactgagaatcaagatgtgtccttcaaaacttttctagagctacatataatgcaaacccagatgcattgcaacggctctttttaaatattagatcactagggcaaggtggctctattgttttacctcctctggcaagaagctgagtataactttaaagtcagtgtgagaaattaaaagacacatcattgttttctgtcgagtttgtctttttgtttttcccattgctcaatttacatttaattaaattaaagtgatttacaaaatcaaatactatcttagttttatgtacttttatatttctatgcaaaccttggagaaagaataatttattggtagtatgagttaagaatcacgttaacctaatcctcctaaattcttaaaagtagcctaggaatagctacgcaatttcaacatatataatgagtgtaagcagacccctgtgtgtgctaaatcacaataattggggtcttttccccataaatgtacccctaagagagaccataagcttctttttacacccaccaatgtgaagcaaggcagaaagtcacaaggatcttcagttcctagattctccactctccatctacataactgaggtgatctggctcagaattaacagctgatggagggagtggcacttggtgacttccacagccaagcatgctagtttatacttctacttcagggtttctcttcctcctcccacaccctaacattaaagatttccccaaggccctgttctaaatcctcttgctctcctctctaatctcttttccctggagagactaagttgtttcaaagttccatctatttgtacaattgctcggatcttaaatctctatctctacccctgacctctcttctgaatttcagtctttttttttttttttttttttttttttttttttttttttttttttttttttttaccaattgcagctgcatttggagaccctgctgcctaaccaggtctaaataacttattactgaccttccttctcatttgactatttttcatcttactgcatactcccagttagggccaccactctaattcctatgctttggggtagttagacagcagtagtggggaaaataaattatgcagctcagcagcattgcttaaggattgcagagccacctagatagcttgtttagacaattagcatacacaagcgtggaacacaatttttaactccaaaacaactatataatgaagactgtctttcatattcaggaattccagacattagataagttaaaaaaagaaaaaagaataattggaatttcaccatttgttacaattgagttttaatatcatctacattgaatgtaatcagagagagaagaagaaagggagggagagaacacactgtatttggcacatttcctgccaatatacagataaagaagtgaacatgcctttgtgcttttatatcactatcctttacataaagtaacttatcttaagctttttcttgggaaataatgacagtttagcagagcaaaaacagtacacagaaatagaaaaaaagagaattacactttaaaaaattatatcaagttgggctataaaactaaagtatggaatatgaggcagcatgagacttaaagaaacttattcatcttagttatgagattttacttgatttataaagcttctattttgaatgaccgaatccataatttaattctataacaatgcaaatgcatagcaacaccatcttaccagagactgctgcttatgttccagaaagcttataaaataaaataaaaatctgtattctctatccaaacaatagatgaggagaccaagtaatttaacatctatattatccgtgcaatacaacatttcaaaagaaaactatgcccctgttttttcaaaacgactttagaactcaggataatatatttgtacacacaacacttggtgataataaatctcctctacatagcgttcattcttcaagaggcccaaacgtaattataggccaaaatactttaattggtgtttgggagagaacaaacttgttttttttacatctgttaacacttgttttttaatccttgtatagaattaaggctttggtaaagcatgtaaggttgggatagagtggggattagggagggactgtcccagtggagtaggtaatcatctattgtttttgtcctttggaaaatcaatgactctgtactaggaaggttccaatgatttctgtaggccacctaagcactctgagtgggccacaaggtaccctatcacattgggtctataacagtttggtgtgatagcccagcagccatcttggctctgaaaaatcacccttcatgtttccctagccaagtcaatggtgtcccaagccctccttcttccaatctagacccacaggttcagagttggctcacactagtgcaaagtatcagagcatgccttaaacgactctgtaaacgtacctacaacagtcgccatcctctggcagagcaggctacgtactaaaatcagcagctaaggggagtcaagacatgaaaatcaactctctctctctccccctcccatatacactcaaaattaaagaaacgttgaagcgattagagtgcaagctcatttatgcttgcctcaatttccctccttttccatttccttttggacttaaaaaacatgtcattctcatctggtctttcactgtgttactgagttaagaaaatagcaaagtgattcaataggaaagcgattctctgctgaaataagtgctactacacctatgaatcatatgaatcttccagctcccctttcccatcgactgtctttgaaaaatgcactcaaaaagcagcaagcagggggagaaaatagccgatgacatttctgaagtacatctgcatcaagaagttgatgacagacaaagggatacattgcagaacatttataaagcctcccaaattcaatctattgccttcttcctaccttcaggcttctcccaaatgaatacaaagcctttaactaagagagaaaagtctcattgtagagattcaaatcccacctatgtctagagagttatgagagtcagagtctgtcacaagacttcccatgcactgggtggtagaaaaaccctgtgaaatgtacttcatgttcatgagaaaaagccctaccatacatcagaataagaaaaggaacctgggaggctgcaaattaccctttgtcagccacagtatcttaagagaaacagctgtttgcagaatgacttgcttcttcaaatacatacagagttagagagaaaaaaaaaatcctaaatatgttctctcaaatacaattataactggattacttttcaaatacataatctcactgatctgctagactgccaacagttaaaagttaaatgttaaatcaaggcacccaagagatgatttgttctatgaagaaaaatgttgttattccattttaatcataatggattaaatgaaataattctgatgatagtgccccactgtaacatacttacatgcacagacatggcttctcagaggaagtaacagtgatttcagaattacaaatcatatgtaccagtttggctagttcctgcaagcatcacagatttattaaagctaggaaaaacctgagtcaagatcaacatacaacgagttattagccagatatcggcattctactggcaaatttcccactttcttcctcttagaattctgtctttacaaaaatggataatctgcatcattttctcctccaaatattgtatcatctataaatattgatatagatgcacaaagagcagccttaaaattctgcatacaacttttaagttaaatgtgagatgcaggcaagaaatttagagggaaaagtctttaataaaccatttcttaaatataatgaaggcaaaattaatgaggctgaacgttgacccccatggagagggccagccaagtaccccccaccattgcagccagcactgtacccaccttcttcatgctgtcccaactctgttttcttgacacatcccatacacacatacacagggcaatgactttggcgcaaaccagataacaagtttgaataggcgagaagctggggtgagagcagaagaattttcttgcctatctgtctccagagaacttttacattttgatctcccaatgacaaagggagtactgggctcaacaatcacacttttgttctgaaatagcccactaagataacttgattcccaggatggaaacagtttagggctgaatcggattgtagggaacatcttgtgcacctttatcttacagagaatgtgaaggccaaaggggtggggtgacttgtcctaattcataagcagctcagtaagcacacaagccaagtttccagactttcactacccaatatggattctcagttcaaatcacttttcctctgtaaagattttcctggaaccgtctccccattcctgtccccatttatctctccctcctttgtgcttccaactgcaccttgtactcagttttatcgtagctcttatcgctgtgtacatcgataaattgtttgcatgcttgtctcctctattagactttgagcctgtataacggcagaactacatcttcctccactttcaatctccagggatgtgtgtgtgcctgatgaatagccgccctgccatacacgtttgttgaagtttgtgagaataattttatagggcataacactaagtctaccttagaaacctaagtgcttctcttgctattttctttcataagttctttcttctccctccaagaagagaacaatagtcaacacatgactgaggctgcccctggttgtctgttccaaatgaaccgttattctattcaggtccagaaaatagctagttcctaacttttttttttcctatgaatatagaccctgaggaatatgtgaccattacggctgaaacatcctggtaatttagtataacttaaccagaagtgacatgaatccatgagacccagagacagaaactctggtctgattccaaggggtctctggccacaaaggccctcaggatatagggccccaccggacgaataaaggagccagcagcagatccatatctaatcagcacctgggcctgcccaggagggccctgcatttccagggtcagtttagaaaaaaactgcgttctccaactgccccaccccccatcctgaatttctctgaacaagccgcaagtcaaattccctgaagctactaagacaaaggtggctttaggaaaatcacagcaggtggggccttcttgtggctctctaatgcatatgccttcttacaagaaaaatgtttgcggctttccttcatgacccacgcttagctttgtttacgttaaacatttattttcaaatgatcatgagcttgatctttttcttagaaattttttgaacagcaaataacactaaaaatcccagaagttgttcacagtgaaagcaagcctgcctcactaataacccaaatctacttcctgccctattccaccccacttacacactttttacctcggttctcatcgaataccgtacatcactgtagaaaaatattaactgaatgactggtcaattataagctcttcaaaaatgcatcatctatttacaaaccagccaaccagaataaaattaaaacccaaacacaacgaagcacattggtaccaagttatcaaaagtcagaaggcattcctcatgcaaagtattactagacgctgtctttagagcagctgatagctgccaacataaaatgtcatcaagaatggaaaaaaagggagagaaaaagtaatggtactgaatttgttactctaagaaataaaacacacagaaaatcatataacttcaaaaagctccttctacatggacttcattaagaaagaacataaggaggtgtttctctctgacccattagtcaaatctcctgctcctaggcttctttacctcctttttctggacaccccatccactcacttgccacaacgatttagaagccaggacaaagagggtaccagctgcttgccccctttattccccagctagggcttctgcttaggatcctctctagagatgccaggtttatcaaataaatatgcaggactcccaggtaaatttgaatttcagataaacagtgaaaaaaaattttttagtataagtatgccccatacaatatgttatctggcagccctctcccgctctgttcttctgccttgataagttgagctcaataaaggcaaatccttgaaaacccattttacctctttaccttaagattcttagaagccctctccatggaatcagcccaggctctcccaggccttcatttgcccagagtaaagtagaagacactctcagccccagcttacctgatcagctgcaaggaaatttaaggaagttgactgttggagacagcaatttttgatccatagctcctcccaccaaaagcttcacacggctcgctaccctggcagccactccaccttcccacccaccggtggcgcaacagtatatttaaataccctcgatgtctgctggagctccccctttaggctaggatgaagagggggatggtgtgtgaccaatacctgcctaaacccgtaactccgaatttacagaacagatttttgagtatatgaggtgttacataaagatgaggcttttaagttttttaaggtttttatttatgtgtgcagaggtgaggggtggttaatcttttctttttttccttcagccctgtctttggaatactcaaattcgagtaaaagtcaatcattaaagtgcagggaaataactacttagcacatgtttctatatgcacacataagcgctataaaggtacagattcacagcatgcagatgaatagccattatttgcatagatatctttttcagtcaatccctgattactcacattaaaagagagcacaaagtagagaggtatggctaattctaatgaaccaaataatatattcgagaaaaatggcaatccacaatagcctcacattacaattgtgaacatttaagcaattgctagacacagtcctaaatttattttttcattaagaatgcagactctttcattggaatgatcaaagattaagaattagtaaggtcagaaatagtaaaattgtactgctctggggaagtttatatgtttatgggcatatcatagaaagatcaaatagtaaagctggaaaggctcttagagatcatttagtccagcatttgccagagtgtgtaccacagacaactaatcccaagagaggaacctcaaaagctgggttcactggtcaatcgggtataagaaatgtcactttatattcctctcttgtaggctgacaatacacaagagtatgataaaggctctcacatgtcctaaagtaaagaaacctggttacctttgttaacccagcatttcccaacattgtttaactcacaaaccatccccccttttttcatcatattcccgttaacatctctctttagtacacccttaggaaaatactgatctaatccaacttcctcattctataggtaaagaaactaaagcttcaaccaagttgtatggtgttttacaggtcaagttttccttagtattttcattttgatttctcttaaatagaaaaatagagtgaactccccaaaaatggctcttctgttgaaatgccatttttgcccatccctgatctcccaaaagctaacaagatggatattttcctatgattgcaaagtaacatcccacaatcaccttcccaacaccccttttcaaagctgtaagtttcgtcagatctttccaaatggttgccgtggctttcttctttcatttgaaggctttagtcaaggaacttctgaaataagaacgtcaagccttctctgcctaactggctttcctacattgtgacttctgccccttgaaaccatgctaattattttaggctttccatgacttaagggtctcaagtgagttttcgctgtactgaaacctgggaagtcagaaggtattgggcaatctcctcaattccaaatggttttagttttgcactaaccttaaaccttggggtttccacttggtaaaattaaatttcctgtctctaagtaaaatgaaaagtttcaaagaagaatttaatttgcaaaaatatcttacaaatgtatatgaagagtataaggtgagaaaggcactgattattgttcagatttaaacaatttatctttgcagggctcagtgtgctgctcagaataaattaaataattatgtctttataaccagccacatatctctccactcaaactttatataaagggtagatatggctattgatttacctctgcattttgaaattagcggtacaaagatgaaaatcagttcctcttttgttaaacatgaatcttctttcagataaagaaatgtaaaacattgtaccaaaatgattgtttacagggtgaattaatcagtgtgaaattatgtttcaatcccccaatgaggtcaaatgtctccacttcagaataagcattttcctcacactcctaccctactaccaacctaacaccaaaaatggaatttccatgcagaaagtttttacttggtgacatggactgccattaaaatacttttgaggcatggactaagtttatattttgttagggaaaatatacatttcatcaccaaaagttctattgaaacctttgtgctaacttgttattaaaattgtaggaaagtaggcaactgttggtaagaatgtaaattagcacagccactatatatataaaaaaaaaacagtatggaggttctccaaaaaactaaaaatagaactatgatatgatccagcaatcccactgctgggtatctatcctaaaggaaaacagtatttcaaagagatgcacccctgtgtttattacagcattattcacaatggccgagatatggaatcaatttaagtttccatcaatggaagaatggataaagaacatgtggtacatatacacaattgaatattattcaaccataaagaagaacaaaattctgtcatttgcaacagcatgattggaagtggagaacattatgttaagtgaaatacgccaggcacagaaagatcaatactgcacgtttctcactaatatgcgagagctaaaacaaaacaaaacaaaacaaaacaaaacaaaaaacccactcaactcatggagatagagagtggaatgatcattgccagaggctagaaagggtagtgagaaggggtttataaagaggggatggttaatgggtacaaaatacaattacgtagaaggaataaggtctagtattcagtagcacaatagggtgactatagttaataacaatttattgtatattttaaaataactaaaagagtaggattggaatgttcctaacacgaagaaatgataaaggtttgaggtgatagatatcccaattaccctgatttgatcattacacattgtatgcctgtatcaaaatatcacatgtatcccacaaatatgcacaactgttatgttcccataataattatcaattacaaataaaatataattgtatgtaatttagagtatcaggcatatgcccagggaaaattccaaactctaaatgtatcgtgtatttaagtggcatttttagccaagtgattcttttaaaaagcatctgaaaattaggccaacttactgtttgtttttgttctacagacatgaaaacaaggtattgatacaaatgctttctcttctaaaaataaagatctattctgcctggcctgaatatctaccaagtatgttaagtttcatccaaaatgtaactttcattttgggatgaaatgtttcagatatgcgaacacaattgacaaagctctaatgaaactgctgagattactgtaaaatatttatttttctttctctctctctctctttcatatatgtgtgtgtcttaaaatgttcctctcccagtctaatttagtaaatactgcaaccttaattaagctcagcttctgcttccagtgagcagttaatatttaatgatgatgaaactgttcccaatatttaaagaactaaacaaggccctccacaaacaatgtaactagaaatggggttaaagaaaatagtgataaagggaggctttttgctttaaaataaatcaatgcctcaaccataaatgtctcatggccttacagagaagaagttgaaatatgaccactgccaaaggatgcatatctccacacccaaaacaagaaaaaaataaagcaaagaacagagagttaattagttagcttcaaaatctatgaactgtactcccttagtcaatttaaacagctggaacaagacttattagaagagcagtacatgtctaaggatgtagtgttcattaaaaatgtgcatcctttctattaagcacgaaaagatttctggggtcattcaggccatggtgatattctagtcagtgccttttaattagcggaatccttattttggtgaagaaaaataaataaaataaatctactctagctccattgtgctttccctcaaaatcaagataaaattagaaaacttcagaaaacatctttctgaaaaaaaaataagtcagtttatgtctgttatataaggtaaatcaaattccattctcaaagattttgacaaagtggatagagcgaaagaaactaggtagtgtaaaacatcagtgtgctaatcttttacactcatttttctactaaagataactagactattaatttggttttacattgtttcatgtattgcattgacttggtatactagactcttgcatataaggtcaaatgatccttttcatgttaactaattcagatcacttatgaataagctgcagatattgtatatacagctttagctcatgttacttggcatgagacaattgttgatacacatttagacaccaggttgaggcccctgtaaaattatattttctattaatatcatgaaagtagtcataaaacataaactaattttaaaaacaaaactagtcatagaaacaaaactaatttgagagattttttagaatactgtaaactggtttccattttttcacaccatgtccaccttaatattaatggctaactttgttgtggatttaccacgtgccaggcattgttcaaagtgctttatatgcattaactcatttaatcttcacaattgaggaaacgggggcactgagaagtgaagacgcatgcccaagctgacataactaataagtagcagagctgggatttgaacctacgtgctctgtgtccagagctcatactcaatcaagatactgtgcttcataatactgtgatagttctaaatagaggaatgagctggttcaaatatttatactgtctgggccacactttccctctaagattataacaaagactgcatatcaactggctgttaggtatgtccagacactagttactagcacaattttatggcaaatttattttgttcaaaacccagggattttggatggcttgagaatgaataagacaaggcaattgaatgtgtcaaggcaattgaatgtgtttgtttttgtttgtttgtttggttttgttttgttttttaagatagagtctcactctgttgcccaggctggagtgcagtggcaccatcacagctcattgtaacctcaacttccccaggctgaggtaatcctcccacctcagcgtcccgagtagctgggactacaggtgcacaccaccatgcccagctaatttttgtattttttgtaacgatggggtttccccgtgttgcacaggatggtctagaactcctgggctcaagcgatccacctgcctcagcctcccaaagtgctagggattataggtgagggccactgtacctggccctaggtaaccaaatgttagaaatagccttccataattcctgaagcagaacaattagcataaacatgttatctgttaacacagctttttagtaaatgtttgcacagtagcatttcgctagttggtttgggagaagcaatgtccaattatcaggagttgggtcatgagggcttaagcataaacggccatgacttgacaaaagtaacagtccagcagtatcccatggagattgagaaccgatagaagtaggactcaacaaaagaggtggtctgtgaacttcatgactatcatcacctccctaagagaagaatcttttaaaaacaccatagtgccattcagaagcaagtttactcagatgacaagttgagtgctgtaggttcgacactatcacaaagcagagaaagtctccaaatgatgagaaaagatcaaccttaacacaaaatggtacaaagtgttcttctgaagcatttcattcccctaaggacaaaggcaaatgagaacgcacatgaactgcacacaccatttcacaaaagactaccccaccgaaagctcagtttcagaggaggttttagttaaatgaccgtaaagtagatatattttgagatactgcaaagtggaggtgaagatctgcggccctaggcactagggtttgactttttcagtgcttcaaatgtacaagtcatgtttctttcttttcttttctttattggcaatttatttttggttaagcaaacattattcacaaaataaaactaaagggtttcaaatacaaattaatatgtggctgcatcatgtaaacatgccaataaaataaacacaacaattctattctgtgatttatcattaggtttctccccagctttttaaaatgagaagatcacctgagcccgggaggctgaggctgcagtgagccattgttactgggggtccttgttcttagagctcctaagatggtggccggccacttccaagatggtggcaagcctcttgttctctgacctggggttcttggcctcatggattccaaggaatggaatcttgggccatgcagtgagtcttacagttctaacagaagccatgggtcacagaagagaaccgtggaacccagcaactagtgttcagctcgattaggacgaatccgggcactagccatgcaggaacaatggcaagcctttagcccgatcgggagcggcaatgggtgcctcgctggatcaggagcgcagcagacaccctgccggatctggaggggtggaagtcagcggcgggtctgcgacggcggcaaacagcagtggtggatggcgagtgaaagctcagctcaggccgtaacaaacatggaccagaagagtgtgcagtagcaagatttaatagagtgaaaacagagctcccataaaatgggaggggacccaaagggggttgccattgccagctggaatgcctgggtttatatccccatcattgtccctccctctgtgctctcaggcgatagatgattggctattttttttaacctcctgtttttgcctaattagcattttagtgagctctctttactacctgattgatcgggtgtgagctaagttgcaagccccgtgtttaaaggtggatgcggtcactttcccagctaggcttagggattactcgtcggcctaggaaatccagctagtcctgtctctcaccatgatcttgccagtgcactccagcctggacaacagagtgagaccctgtctcagaaaaaataaaaagtgactagacaactgaagatgcagaatccaaaagtatactaatagttctaaagacaatataatagggaaaataataacaacaacactgttatatgaatcaactgtttcggaagcaggtcacaggctgttcatactctgtcctctaatgtatttgttcccaagaagaaatgaatttaagtttcaataggaacacagtattttattagaaagagtgctaagctgagattcaagtgcccttaattctatttagttttagatcatcggtaaattattctccaatcgtgttaacttctctagaaataattcctgcccctacatactttctaggtgctttgaaagaaaaaaggaacaaagtaaaatttagtctgttttgcaagtaaaatcagtacaaaatgtaaaaaatatatttttctttattagttctttacaacagaactaaaatatttcccgagaattaagtataataactttgacagattataactactttaaatcattctacttccctaaaagaggtaatatattatcatagagtaattaccaattatatgagtaatataaattactatgtgcctagggagagaatttatatacgtataatgttaggaaactgaggacacttctcttattagaactggatattattgtcaaacagtcgctgttcccacaacttagtagtattctaggcgaaaaggcagaggataaaggaagcatatccaagctttaatctcatcctcgtaaataactaaaaggagaaaataattattgcttcttttcaagtggtaataagccagtgcccacttaggagactagtttacctagtcaagagacactcttttaccatcacaagcttctttaagatttagcataacgaacatccactttaaaatcataatgaatgaaacattcaaagtcatttgtattatataaaaaagcatggagcatcacactctagttggtactatttttattctaattttgccatgggtactgttatattttacttataacatatattaaaatgataacaagaaagcaggcaagtcattttttcctggtaagttagaaagacaaagccaaataagagactataaaagatgttaatggtgcttaaaatattaaaaaaaaattgtagcgaagtgattttaaatatcatttaaataaattggtaaaataataaaattgaatctcattagaaaactgtttataaatgtttgagctaatttttcatttttcttatttttcattttaataggctaaccttatggaagtgaagattgactcatataaatgtgaaatgtctgaatatactatgtgtgtgtgtgtgtgtgtgtgtgtgtgtacatatacacacccttttgttctcacagttgctacatatgaaaatttgaaggtccatgtgtggcagctagcaacacctacaatacgcctttcagggtacaaaaaagtcactaatcctttcaaagggttataatagtcaaataattaaaataacttcatttcttttgggttccacacatttagacaccagcatgattcttgcccagtcacctgttatgtagcattccataagtttctctatgctccacaaagatagggttctgtgatcaaaggatttacagaaattcttgggttcaacagaactaaactacactaacacgcagttaacagaactaaactgtctttcatgcaatacctctcagagccttttctcagctaaaaagcattgtgatgctccttggagggaaaatataataggtctcccaaagaaacattaagtcttccagaatagacatcatttcccttccaacagatctgaatatatatcaagaaagggccgtttgaacaagtggtgaggaaggaggaggcattagaggaacaacacagaatcctgagaattatgaagctttgaaacatcatccttaattgacaccctgctaaaccaattatggttttctctaaactaatggttcccaaacttcagtgtttgccagaattaccgggagagtttcttgaaacacaaagtgccaggcctccccacagagtttctgattcagtaggtgtgggtgaggtgataatttacatttctaaatgtgtccaggtgaagttgatgttgctagtctgccacatttttgagaacccctgctctaagggaatattgtcctatccgacaatggatttagttatttgctatgcattttattatggtactgataattcagtttccaaaaggtcatactaaagaaatttggacaccttaattctacatctctgacatcagtaatgatgttagcagccacgtaaaagaaggccggtctaggtcatgaagaaggattggccttctcaaaatctattctactactcctaggaaacacattcattttctgtttacaaagtagggctattagttatgatggtaagtatgtatatgagagctctgtattgtatgttgcttacatttgctgtataaacatttccagagtgttttctaaatgttttctgtgtacccaaatttgaacgaataaaggattctttaaaaactgcccctcagctctccaataaactcacacctttactcactacagaaatcccaatcatttgagaacattaccccttctcctcacccctaaaaaaaacatacctagaaaaagacaagctaaaaggaggaaaatactttccagatcgattaggcaaacaatttaatgctgaccacagcatttcagcacagatgatcaaaagccgaagtatcaatagattactaaacctcaaaataagcactgaatacaagttcatcagttgcaccctgcagcgaggaagtaaggaaaaaacacatctcatacaaccctttctccttttttcctaatgaaaaaaagtaaacgtctaaggagtttcaagtatttgttatttattcctttctgttttacgagtagccccagctgcatctggtttacttctgagtatcactggaagcccattttaaactgaggcccccagttaaccatactggaatgcctggaatacattaacatgtccaaatgaaaatcactcagatagccttataagctgcaaataataaatgcagaaatggaattagccccttctcttgttgacttgctctcttactacttagacaattacattcttcccaaaaggcttcaaaatgaccttcaagaaagatatttttgaagtaagattattacagtaactgtaaagactgatataatgggaaaggtggaacaatggagataattgtatcaaaaacttcaaaattctagactaaggttaattgctgcagctgggcccaaaaggtagctgtgagttttctggcaacactaaataggaaaatgtactgaattgcatttgctcctgtagcctgataaaagaaggcatactgtttaatacctctcctgcataaaagtaaaaactgtgctagatactatggaagaaatgaagattatgccatggaaactgcccacaaggagtttacaaatcttctctctcccataactagaggcatgagtagttgtgctggtgggggacctaggacttgacgcctgcttggaggttgtgaacagtggggagatcaaaggtaactagtggtgcatgtttagtggtgctgttgaaaatgaggaagagcaagttccatggggagaatgagacttctctgggccataattaatcacagctattcatttttgcttcaacgaaagcagaggagtttataatgaaaaatatgcgataaaaatggcacaaacaattctctcttgggggtggaggaatcccactcttctatattaccctcttttcatgagtatgttactctattcattacactttccttatgtttttgttacaaatacattattattggagctgaagtatttcagaatgaaaagcctttctcaatgggtgtctcttaacttctttctttcttcacccactccctctctccctcctttcctccttccttctttccttctgtttttttttttttaaatctctgacttggaagcaatgtcactttttaaaggtatttctttagtgggacaataggaaaatttggggagaaataagtgaaacatatttaaatgttttatcatttcaaagatgaagtaaatgtcacatgccactaaagtgaggcctcaagaattgggaaaaagggggagacagtcttggttctgttttatctgtcagttgcctattaaaatatgctagtcacaattatggaaatcattgccaaatgttgacaccagctgaatgctgctaaatatttaaaaatcattttaaggttttgttgttgttgttgttgaaacacttttctcaaatgttccagacaccttccctgtttttgaaagcagagtcaattgtccaaacctgaatcatatcttggttattgaggattgcaccaagacctcaggatcgcctgtacagaaaaccagcaatcattatccaggaatggagatgaacatggagaaagtctaagagactgggctgactgtacaaactccaagatatagtacataagcctagagatcctttcttaaacttcgatattgaaattactttcctattatttttcctatttcttttaaaagcatattgcttggactaaattacagttattgtgggttttttaaaaagtgtcaattcatggaccctctctattattatatttctttgtctttctatgttcaaactttttggactttcaaaatgtcattgtgtatttagaacaagagttctttattaaactttaaatatatatatttttgaactaggcagtcacctttttccacaaaatccctttttgaagattatgagcttgtacttgattagaatcaccttattagcactcattatgcttccaagaataccttgatttgcaagctacccatctgctgtaaaattcaacttcaaacattttaagacaaaaaatgctagaccattactacataatcacactaattatcttaaaaataacacttaacaatggccactaagtaattttttaaaaaaatccgtatataacgtaaaagcactgaaaatgtaacagttggagaatatccaacagcatttagccaaatatcatttctataatgctaagggatggaattaaatttgcaaatatcagcaatttgcaggccatcaaatctaggttaaaatgtggttgagtgaggaaagttggcacatgggtgtatacaattttcatctatatttgagtaaaaactgaactgggagtgaaagtacagctgcagatgaagagatctctgtgtacctctcagttgagcccatatttattctccctctttcaaagtgtttcaacaatctcatgtttcattcaacaaatatttttccaagccctaacgtgtactaggcacaaaagatatgttggtggacaagatagcatctaatgcaaaacaaaacaaaaagtatggcagactttcactgcaacttcaaagaaatctgatgttaagatgagcacaaggtcagtaggctggagggaaatatccactgctttctacttaaccatgttggcttcatctgcatctcaattccatcgctagttttcccttcccaccaccaccatctaaatcaaaaccttaatatttcataccttcaatacttcaacaactttctaagaggtacttcctcttgccagtctctttttttctgtcattttttttgcacaagctgatggtgtcatttctcatgcttcagccattctgacttaacattcaactccccaaacatatcacagttttccccctctatctttgctcaggttatcccctctgcctggaataccttcctattccttcttcaaagaacacctcaaacagtgtctctgccatgactccatcttcaaccaccactgctgaatataatcccagtccctacctgtgcccttggactgttgtagctgttagtttgtatctggcttatggcatataacacaagtaacctcttactaaaaggtcaggcaagaaccacatctttcctaactttgtattctccacattactgagcccagtgcctaacaagtaagaggttgcaataaatgtttgttgaatgaatcatttctttggggaattgaatgtacatacaattcttaatggatttaacaggactttcagcattaaataacccctgacatttatacaaatccttctaggaaaccacaaccaaatagtcttacaaattcagtgctgctgcttgctctcatatgaagagaaacagaggtagtaggattcccatgacataaggagcccttgttagaactgttatgtgtgacaaggcagcattttcgatgtttatgccacttgctgatagaatgtttcatttcagatattttcagtggttacatctagagttcacccaagaaaaaggtattttccaaaactacttctcaggctcctttgaaaaatgagacaatattccaaagtcaaattcttcctacagtggggtactgggagattaaagatggctatggttttaaaatttgttagtaatactgaagttaagactgaatttggttctatatagaacactttttttggttagtaaaaaaagtaaaataaccaggaaattgcagaaacactagagattacatttttataaaagctggaaaaaattaagtttgttaagtggaacaactcctaggataggtatttgtgaaatatttaaaacaagaacacagagtacatgaagctattaaaaatcctcaaattgttacttcggttttactatctttcacaaatgggaagatgaacaaagatattaagacaatgtgacaatgtggtcttaaaacaatgtggtttttaaaaatgagatctctaaaaagtatttggagctaagagattattgatactacaatgtaatctactcactgtatttagatgcatataaaagatggttaaagagtttaaagtcacagaaaaaggttttctgtttgcatttttgcacgctaagacagaaattagaacattactaccgttccgttagctaacaaatcatggctgatacataggacatgtcttgttttttgtcatatttaatggaattaaagggaatttgtcatatgtaatacatttatattactgtggactttacattttcaaatttttgtacagttttcaacgtggaaactgccttcattgtccactatctactcataagaatataggtagaagcaaagcctaatttattttctaccaatttccagtgggttaaaaaaaatttgagcttcaacagaaaaaaagcttatttatgatatacaaaaatccaatttaaggcatacatttaaatgcctatgaccgagttatagctgcaaaactgtttctaacagatagattctatagccatatctacttaactaaataacatattagacatgacattaagcaattttacataatctcatcataaacaagataccgaaaaatgatttactctatctctagatacaacatggttcaatccaaatactggagatcatttagaaaataaaaggatgaaaaacaaatggaattgtttactgactttaaagaaaacaatatcaagaaagatggcaaaaaatgtgagataaacttgtaatgacatctagcaataaaacttgaccctggggtgagaattgaaggcacagaaacaaaaacattgaaaacccaagcaggactgcaaatctggattagacatcaaaaattaaaaaaaaaaaaccataaatttaagaaactgaagaccgattatgtagcagaataaacactgaagaaaaaaaagagtatttacagaaaatagcagacagctaagattcctctggaatatataaccccataagtcagggaccaagtgacacactgagaggaaaacaagggtcacctcaaggatggtacatgcagaaaggtcatctgcaagggcaaacagaacagtaagtaaacaatgttctatgaataatgtcatgttcctagaagaactaattgctatttccggatgcacagaagtaccttgtatccacatttcgaaaaaatctgatatagagaaaaagacttcatttcagctatgctacatgaagagattatttactaaccaagtaggatcagatgtatattaccctaacatctaagagtttcttctagacaaaagagttgaaatataatagttttcaaatttccaatttccaaatctctcctacttaatggagttcctgtagcaaagggtcagtattaatggtaacatcaaacagtagttggggaatacatgcctggccctagcccaagtcttttctcaccagatgcccaattacaacttggccaggaagagatgattttgagctatgatcccataaaacaacactttaaataagttggattagattccaaattattgtataaaatacttgacccataataaggctgaattgctactgcaatatttcagctgatctatgacaggtttcttcctagctggccagggcattgtactaatgagtatataacagaatcagacatcaatgagtttcatgcagtgaagatgtgatacacagccacagttacaatccccagttctggtcagcaaactcaacaatgcggtgtttggggagaaggatggacaagggagcagagacagctcagtgttctgacactcagcaattaagcaaagtttagtatcacaaagttaggtaactttgtctaaaaattcttctcttctgccttattttcaaaacaagttatccaaataattgtccatgaactaaatatgaaggttaataaagtcttaatctaaattatcatgaatcagaaacaataaaagagggagggattagcaaaggaaaagttggcttatccacgccttactttatagtgcaaaaagtaaaggagaaccagaaaacttcacagacagtcccaatgtcatgtggagcagcatgactgtgataagagctggatgcttttggtttactaaagcaatagcctaattgatgttctctccatttccttcttctccacaggaaagaagactgaataatgattggaagaacgccggagtcatcaagctcttttgataactgcatatgtgaactaggtcaagtcactctccctcaacggatcaccagtttacccaactgtaaatggcaacaattttgaactgaacgttcttccttctacagccaaaattcttcgtttgctaggtttgtgaagtgcttttatatgtatgagcgctttcttaactatgaagatatctgagtcatcgaacttttggtgggggcaatctcatgatcagtcatgactagattttagagttttctcatccccatactcaaagttttttttttaagaataaaaatgaaaagaaacaataccccacaatatttctgagcctcaaaggacagactaaaaaagctaacttttaaaatacttcattttgaaataattttgaacttacaaaaaaatcgcaaaaataatacctggagtccctgtatacccttcacccagattcccctactgttaaatacttacataaccataacacaattaccaaaaccaggaaattaacactggtacgagactcttaacaagagatcttatttgaatgtcaccaattttcttcctaatgttcttctgttctaggatccaatccaggttcccacatggcatttattcctcacttctccttagtctcctccaatctgtgacactttctaagtctttccttgtctttcatgaccatgacactttggatgagtactggtcatttattctgtaaaatgcctctcactttgtgtttgttgaatgttttctcatgattagaccgagaccatgtctttttggcaggaacatcacagaaatggtgtgtatcctatctgagggtatgtgatattgatatatcttatcactcattatgttaaccttaaacacctggttaaagtggcatctgctgggtttctccactgtaaagtgactattttccctttatttatttattttagaaacagggtcttgctgtgttgcccaggctggagtgcagtggcacaatcactgctcactgcagcctcaatctcccaggctcaagcgatcctctgcctcctgagtagctgggactacaggcatgcaccattatgcccagttaatttttttaaaaatgttttgtatagacagggtctcgctatattgcccaggctggtctcaaactcctggcctcaaaagatcctcccacctcggcctcccaaagtgctgggattaaaggcatgagccagccaccatgcctggtctattttttattgataaatgaaatagaccatgcctgttctatttttaattgataaatatcctgggagaaatactttgggacaatgcaaatatcctgtttctcctccaacttttacccactgatttcagcatatatcagtggatcttgcctgcaaccattattaccatggcatttgcctactagtgattttgtgtttccttcatttgttctccatttattaattggaattcttctgtaaggaggagttgtcccttctccccaacttatccatttattcaattttttttgtaaactatggactcatgggcatctattttattctatgagctataattcaatactgtcatcatttagtttcttgctcaagttattctaacttcagccattgggagctccttcagactggctactatgctgtcttgtcatgcccccaccctttctctagcactttcttacattcttacaccaaaagacattacagcctcatcttgtattttccctgcttctgtccagaattagccattattccaaagatcccgagttcctttattggagaatgatattagacacaaagatgtgggtactaagtatactcgttgctgttggggtgttaattgcttctagggcttcccaagacagagctaggaaatgaaagcatacataataacccatgcatacacacagatcaatatctattcctgtatctatctgtatacatactcatgtgtcctttctaatccacaccacggtattcatcctaaccttccctttttatttttaacttttttcctctgatagtgagaaaataggctctcattatctactctatatacatttatttgttcaacctcagtatctacatacttacatatgcctgtgaggaacagatttactaactagaatcctgtatttgtgtgcaattctttttatctttattataaatatagcacctccaggcttctttttattagtgtcagcatgacatagcttttcccatctttttactgttaatattttaaactcaaaaaaagcaaggaggaaaacagtatgctactatctgtgtgaaaatggaaaataagtatggatatatttgctcatatgtatatatataatatctatgggagagggaaaaccaaaatatcagtttggaggtcaactgattaactggggaaaagagatgaggggaaaacttcgctgcatactctactatcgttgaaatttcttaaactttttcattgagtataattcacaaatcataaaactcacccttttaaagtctacacatcagtagtttttaacacatttatatacaaagttgtgtaactatcatcactaattccaggacattttcatcacccttaaaaaaaaagccatgtacccattagtagttaattcccatacccctcacccctcactcacccatctactgcccttcacaagaccctggcaaccactaatctgctttctgtctctatggatttgccaactcttgatgtttcatataaatggaatcacacaatatgtgaccttttatgtctggcttctttcacttaacatcatgtttttaaggttcatccatgttgtagcatggatcagtactttgttcctttttgtagctgagtaatattacattgtatgtatataccatattttgttgatgtactcattagttgactgtttttctaaatttttgaattatgaaaatatccattcaaaaattaaactttaaaaaatagaaacaaaatgaaaaagcccttctcataaaaaacagaaaaatgtaaaaaaaaaaaa

SEQ ID NO: 3723 - DNA, 61541 bp, human; identical to SEQ ID NO: 3715

SEQ ID NO: 3724 - DNA, 67676 bp, human; identical to SEQ ID NO: 3716

SEQ ID NO: 3725 - DNA, 60486 bp, human; identical to SEQ ID NO: 3717

SEQ ID NO: 3726 - DNA, 110764 bp, human; identical to SEQ ID NO: 3718

SEQ ID NO: 3727 - DNA, 104352 bp, human; identical to SEQ ID NO: 3719

SEQ ID NO: 3728 - DNA, 213015 bp, human; identical to SEQ ID NO: 3720

SEQ ID NO: 3729 - DNA, 107650 bp, human; identical to SEQ ID NO: 3721

SEQ ID NO: 3730 - DNA, 214355 bp, human; identical to SEQ ID NO: 3722

SEQ ID NO: 3731 - DNA, 9160 bp, human
agccgccgcggtacccgcttcaccgggcatgctcagtcctccggccaggctttgactgcgggacgccagcgtccggccccctgcgcgcgtccggagtccgggtccctttaaatcgggcaggctcgttgctaggcaaccgcgcggcccgcgctggcgctgcactgcggtggctcagcccggagccggcccggcggggtcgcggtggccagagccgaacggggggctgccgcgcgcgggtggtggttgtctttgaggaagagaggttcgggctctccagacggcatccacgcttccaggtatgtctgcggacgggaaagcccgggctcccccgggctcgcccctcttcttcccggacacagggggcgaaggggcggggagccaggggcaggcgcccaggtccgcaccccaacccccactgcaagttatttctgtccttagagccccaggccggggctggagagcgtttgggagggaaaggaccaggacgtgggagtggcagtgcggaaagaggagtggggtcaggcctctcccgccgcccgccagcgactaggtcgggactggggaggtggaaagtgtcacctgcaatggggaccgaagcagcgccccgaccccgagccaccttctctcctcgggaggcaacgatggcaggagtttcagttaacaatttacagagaaaactcccaaactatgcatacaaagatacagctttgtagcaagaatgtgactctcatactaataaagtctcagccttcggaattaaggtgactccccgtatcttttcttctagaaggaataacttcacactaataacaaagaactggggagtaataagcattcacggggcccagttttcaatggtacttttcttccccctcaatagctgccaagcaatagagaagacaatttgtcccgggaagtggacactttggcccatatattaggaccctgacagatgaaggcaaaaatcaggatgacttcccttttcgatgtttttttgtttgtttgtttcaaattaactacactctgagggagggaggcaaggcctgggctccagccttttgctaatgcggttcctggcgtgctcattaacaacaagccagggtggctcctttgctcaataggtgctaaaagtgaggaggtactgtgttgaataaaatttcctcatgattcttgtcccatttgatatctgtatggcttggggaaggaagacttagtggcataatagttggggaaatgggttgacaaaaagagaaattacctcttagtgtctggtatcacatttcagatagaccaaatgacattctaaatatatcacttgtctttttttttttttttttttttttgaggcggagtcttgctctgttgcccaggctggagtgcagtggcgcaatttcggctcactgcaaccttcccctccctggttcaagcgattctcctgcctcagccgcctgagtagctgggattacaggcgcgtgccaccacgcccggctaatttttgtatttttagtagagacggggttttgccatgttggtcaggctggtctcaaactcctgaccttgtgatccgcccgcctcagcctcccaaagtgctgggattacaggcgtgagccaccgcgcctggccatcacttgtcattttaatctacatctcagatataaacacgggtttgggcattctggttaaatgtatttcctgattacagggagggaggcggaattttcttttttccagttcaaactggagaaggagggcagagatatccagtagacagaagatcttggaccccaggaagtgtaagtacagtcgtgttagctgttatctttttggggtgtttagaagcacagagccttacgcaacataactcttcagccttgtaattgatcgtctgcattgtcagtaagctctcaggaaggcctcataaaaatacaaaggaaaagtgtcctgaagacttcagctaagccaaataaacttcaagggaaaaataaaagtgctttctctaaaataccatcccccaaaactttttaagccagaggagaaattatgtcaaaaaaaattttttttaaactaaattagaatcaaagcattgtagagatttcaggaagaatattaaggatcattcattaaacaaatatttattcagggctactatgtgtcaggtaacaatgccaggccatcatagcatatttgtataataaaggtctgtgtgaaatgccacagaagcacaggaacaattcagagtgcaaaatcatccttgctaatcttcaaacgaatactcctgtatttctgagaagttattggtgcctctgaaatacagtgggacatttggaaaactcttggtaaagcaattggtgattttaaattgccaatatattagggtgtagaaaagactaccacttttttgcttagataaaatcaattcagcttcagaaatttggggacatcaacaactaacttacagaagttagggataatttttccctgaagatgcagattaaattaatctgagattggagtttaggcttccttatatttattttaatagtgcctactttttttttcaaactaactttttctgaggtctgatgacttccggctggccactttggagtacatatctctggagaaagtttaggttgtttaactggctggtttatgttcaaagggagggtaaggaaaacctgaaaatgaacaaaacccattgtttacagtacactttaaaagttgctttcatttccattttcattcatttttcttaatcacctgtgaaacaggtatattgtccctattttacacctgaagaatctgaggcttgcagttctaaaatgtgggggccaagatatctgactccttcagtcttttttccaccatagtccacactcagttcctttctcaggaacttccttttccttcttccccacaatgttgcatggtaaaacatattgatccatcttaacttcagacagttcatttgggtccttcttttggtatttaatggttttctgcaagtcagtgaaaaagggtggagaatggggaatctcccctatagggggcaggtcagaatcttctaaggaaagagggtaatgatgggagtgtttttgtgtctggaaacagtggaagcaggaaaaagagagaaaaaaaaggttgagaaccactgctctgaagtgagaataaattggacagttgagaaggaagcaaacctagtgatttcctttgtaacagatttttttcctattttggtggagcagtttttctaagagtccagagaacagaccatccaagaataaggggagaaagttctttatgttaagaggagccctttgtcttcaccttactgcccctaggcagtgactaaaagccatgccccttgttgagagctactaagcgactgaggataatgacaggttactcaacacgggttggagatgaccttttccaaccatcattcccagtttacaaagtttgagaggaaggacccttgtgagatgggaaagagcctttggcattcttccagaactgttttccagtccctacctactctgcctggaagaataatggaattttgcaggcagatctaaatttgtgaagagagatggtcctgaaaatttgaaaccaaattctttttttttttttttttttttttttttttttttttaggagacagagtgtcgctctgtttcccaggctggagtgcagtggcatgatcatagctcacttcagcctcaaccccctgagctcaagcaatcctcccacctgagtagttaggactacaggcatatgccaccacacctatctaattttgtttttaatttttgtagacacgcatctcactatgttgcccaggctggttttgaactcctgacatcaagttatccttccgcctctgcctcccaaagcactgggattacagatgtgagccactgtgcccgtgtaaatgggataaggcaacagaaaaaaaaaattgatttatgtcatcaaatttccctaaagcctgtgatttaaaatatgaatattttagaaaacaaataattaaatttcacatccgctttaatatgattatactctctggggccccagctgaaaaatgaaactgagatggtttgtggatttctcctttcagagtaaacagtagtgtattattttatggagctatttgagaatagatgtgcattcctctaagatttttatggaacagtgcacctataggtccattgtaaatgactgttctttgcttagctctcaacatttatgttacatcatgttatatataaattcatattcaatttattttatcagtggttctcaaattctttaggtgaatacaaaccactttcatgagacaagagatctctcactccacaaaaatgtcctattactttgccactgcaaaaaaaaaagtcacctgaggataaatgatgatgttttcagtgagacactaactagaaccatcaggaatccattattaattcatgtcagacacaaatgaatagatgtagtcatattgtagacacatacgccttaacagtgcagtcctaagggcttctgggggattgctatcttagaggactacttgtcctatgactttgtattgttttcctgtctgtgttctagattatttgcttctaaagaaaccagtttttcatccccattgggcctccttcccctacccttctgaccttcagtatccagtgtagtgttgggtaggcacttatattaataaatgtccacaactgacccactaacaggcatgcctacactttcaataatggcttctggtttggtttgccttatgctggaacaaattacctagtcaagtttattgagaacaaaatggctaccaggccagggtagaggagtgtcattgccttaaagcatattccttgttcttgccagagaatactaatgccatactcgttctgcataaaaaaacaaacagtacaatttgtgaagagaaaatgagactggcagcttttaccccgagtctgggatttgccacattctgtgactagatttgggaacaagcccttaaaggatatcttgccaatgaaagagagaagaaaaaaaaaagagcagctcagagactgcttgaccctgccctgtgtaagccatgggagggaaattccaaaaggcttttcaaacctttctctttctgttctttgaaatgtgacatgcagttctccttaccctccccccttcacttttcctctcttcttttgtggccttttaaaagatacctaagctctgaaaatagtgagttgttttctttcaatatggggaatgaaacctagcagatgaataaagaagaattttagaacaagcactgacctgagagacagggtcctcagttttactactatgggctgtgtggccttggtcaagtcacttaacttctctgggccttagtcataaatgggctcttcccatttcagtagctatataggcttcactgaaaggcatttcctttcagacaccaggaaattatacagaggctcagggaagagagacagtgaaaattaaaaagtgtgtgtgtgtgtgtgtgtgtgcatgtgtgcatatgtgtatgtgttttgccagagatttatgggatggttggatgtagaagtaactttttcaaggagcaaaattattaatgaaaagagttttttattttaacctttatccatacccagacctctatctcagatagagatattcttgctatctccagatataaagtgtccacactttacttgcccctgtgctcacctccttcctaatcaatcccaccaatgcccttcatccagaattaagtaagaggaatagtaatctctctgccattgctacctgattagaagcatttttatcatctatataattgttgggtaaaaatttgactgctaaaaaatgtgactggcaattaacatcaccctcttttctcctctctctgttcctttcctctatgattgctgtaataattcctactgatttgcattcatatttctagagatgagggaaaccaagataatgatatttccctttaagaacagatcaatcaatgatgcttctggatggtgactcgtggaataatgaaagtcagaaagaactgtttcaaaagaaagaagatgatgctccaatggcaaatatatattgtgaatttaaagtctgagtttatcattgtggtctgattgacctcaagaaagcttggcttctggcttttggaccaatcattttagtaccttcactgaactctccaaatagttcatcttaagaatatatgtaccttctcctttcctcaaagccaagtagttgccagtagggatgtactcttggggatggtgagtcccttccatcttttgtggggaaaaggggagaggagaggtatgttcagtacctgtaggtatcaagtttattccttcattgctcatagtaaggaaaacctgtgttatttaaaaataaactactgtttgtaaaaagaaaagagaagataatacaccaaaaagtagttatctcagggccatgagattatgaaggagattccttctgttttctgtgcttttctctgttctccaaaattgttataataatcaaagaaaatattaattaagaaataaatgcaacatttgccatttctcattaccagcagaaaattacatttgagtgcatagataaaagagatgcaggcatactttgatttttctacatggtgatactacaaatatgttttggtgaattaatatataaaatgaataaagtgaccctctccttcttctcctcaccctttagggctaacttcagctaccagttggtggcttcaggtgccagtggccctccacatactgctctggttcttctttctcccttccctcagaagtagtcacttatcaaatatttcagtgctgtgggaaagctgtacattaaggatgtacagctttgggtagggaagactctttttggaacaaaataatcatcctcatatttttataaacttggaaagttggttgtgatttagtatgctgaattttcacctaaaaactacactcagagtcagtatcttgagaaaaacacatttggtggcattaatattttcaattgttgacattagattctcctcatgaaattgctgtcaaaatggatagaattctgtacacttggcagtcttgcctaaaagcaaagcccaagactggaatagcaggaatttataggtcaagacagaagggcatttggcagagttagtcataaggaagtctgcatggtatactttaccaaaagcagctcacatttcattaagccctgatgttttagtcactttaaagaatgaattaacaatagtccaatccaaaagaactagaaaggcatcagacacattgaaagcacaggtattaccaacattaacctattaatttcaaatcacttttttttattttaaagcagtctgtttttatgtgtacagttgttttcttatagaatcactttctctgtgtacagtaagtagctaaatgtgtcagtttactagttctatttcataggatgagagacttttaaagctggaagcatctgtagaacttagctctttcagccctttccatttataaatgaggggactgaggcccaagccattcagtgagttagagagagagccagccctcaaatgtttagattcttcacccgtgagccagcatttttatttctttctactatattagctactagtgtaaataatgtgcctgccttggttttaaattttgtttttcagatattggaagaggtgcctggagaaatggatgctagaagaaaacactggaaggagaatatgtttactcctttttttagtgcacaagatgttctagaagagacttctgagcctgaatcttcttctgaacaaacgactgcagatagcagcaagggaatggaagaaatttataatttgtccagtagaaagtttcaggaagaaagtaaatttaagaggaaaaaatatattttccaactaaatgaaatagaacaagaacaaaatttaagagagaacaagagaaacatttcaaagaatgaaacagacacaaattctgcatcctatgaatcatctaatgtggatgttacaacagaagaaagctttaacagcacagaagataactctacctgcagtacagataacttaccagctctactaagacaagacataagaaagaaatttatggaaagaatgtctccaaaactttgcctgaatcttttgaatgaagaactggaagaacttaatatgaaatacagaaaaatagaagaggaatttgaaaatgctgaaaaagaacttttgcactacaaaaaagaaatattcacaaaacccctaaattttcaagaaacagagacggatgcttcaaaaagtgactatgaacttcaagctttaagaaatgacctgtctgaaaaagcaacaaatgtaaaaaacttaagtgaacagctccagcaagccaaagaagtcatccacaaattgaacctagagaacagaaatctaaaagaagctgttaggaagttaaagcatcaaaccgaggttggaaatgtgctcctaaaagaagaaatgaaatcatattatgaattagaaatggcaaagatccgcggagagctcagtgtcatcaagaatgaactgagaactgagaagaccctacaagcaagaaataacagagccttggagttgcttagaaaatactatgcttcttcaatggtaacatcatcaagtatccttgaccactttactggggattttttttaaaacttaaaaaaatccttccagtaggcaagtcattgagccaaatcagtgtttattgtattttctttgcgtattacttaaaatatatgtaataggatgttattttcattttcagtaaatcacagtatctataaaacatatacatgtttccaagcttctgctttctctttctgatgaagttattgcaggaatacaaatggaaacgaagctttggaaatctcatatcagagtgtgtgtgtgtgtgtgtgtgtgtgtgtgtacacacacacatatattcactcaaaaacacataatgattcaccaaatcatttatgaatacaaatcagcaattttgtgatctcgtaagcaaatatgtctttggcacgtgaatatttttccatctgtgttcattgatgttaacaataaaaatcttgtttatgtgtataagcctaa

SEQ ID NO: 3732 - DNA, 8731 bp, human
agccgccgcggtacccgcttcaccgggcatgctcagtcctccggccaggctttgactgcgggacgccagcgtccggccccctgcgcgcgtccggagtccgggtccctttaaatcgggcaggctcgttgctaggcaaccgcgcggcccgcgctggcgctgcactgcggtggctcagcccggagccggcccggcggggtcgcggtggccagagccgaacggggggctgccgcgcgcgggtggtggttgtctttgaggaagagaggttcgggctctccagacggcatccacgcttccaggtatgtctgcggacgggaaagcccgggctcccccgggctcgcccctcttcttcccggacacagggggcgaaggggcggggagccaggggcaggcgcccaggtccgcaccccaacccccactgcaagttatttctgtccttagagccccaggccggggctggagagcgtttgggagggaaaggaccaggacgtgggagtggcagtgcggaaagaggagtggggtcaggcctctcccgccgcccgccagcgactaggtcgggactggggaggtggaaagtgtcacctgcaatggggaccgaagcagcgccccgaccccgagccaccttctctcctcgggaggcaacgatggcaggagtttcagttaacaatttacagagaaaactcccaaactatgcatacaaagatacagctttgtagcaagaatgtgactctcatactaataaagtctcagccttcggaattaaggtgactccccgtatcttttcttctagaaggaataacttcacactaataacaaagaactggggagtaataagcattcacggggcccagttttcaatggtacttttcttccccctcaatagctgccaagcaatagagaagacaatttgtcccgggaagtggacactttggcccatatattaggaccctgacagatgaaggcaaaaatcaggatgacttcccttttcgatgtttttttgtttgtttgtttcaaattaactacactctgagggagggaggcaaggcctgggctccagccttttgctaatgcggttcctggcgtgctcattaacaacaagccagggtggctcctttgctcaataggtgctaaaagtgaggaggtactgtgttgaataaaatttcctcatgattcttgtcccatttgatatctgtatggcttggggaaggaagacttagtggcataatagttggggaaatgggttgacaaaaagagaaattacctcttagtgtctggtatcacatttcagatagaccaaatgacattctaaatatatcacttgtctttttttttttttttttttttttgaggcggagtcttgctctgttgcccaggctggagtgcagtggcgcaatttcggctcactgcaaccttcccctccctggttcaagcgattctcctgcctcagccgcctgagtagctgggattacaggcgcgtgccaccacgcccggctaatttttgtatttttagtagagacggggttttgccatgttggtcaggctggtctcaaactcctgaccttgtgatccgcccgcctcagcctcccaaagtgctgggattacaggcgtgagccaccgcgcctggccatcacttgtcattttaatctacatctcagatataaacacgggtttgggcattctggttaaatgtatttcctgattacagggagggaggcggaattttcttttttccagttcaaactggagaaggagggcagagatatccagtagacagaagatcttggaccccaggaagtgtaagtacagtcgtgttagctgttatctttttggggtgtttagaagcacagagccttacgcaacataactcttcagccttgtaattgatcgtctgcattgtcagtaagctctcaggaaggcctcataaaaatacaaaggaaaagtgtcctgaagacttcagctaagccaaataaacttcaagggaaaaataaaagtgctttctctaaaataccatcccccaaaactttttaagccagaggagaaattatgtcaaaaaaaattttttttaaactaaattagaatcaaagcattgtagagatttcaggaagaatattaaggatcattcattaaacaaatatttattcagggctactatgtgtcaggtaacaatgccaggccatcatagcatatttgtataataaaggtctgtgtgaaatgccacagaagcacaggaacaattcagagtgcaaaatcatccttgctaatcttcaaacgaatactcctgtatttctgagaagttattggtgcctctgaaatacagtgggacatttggaaaactcttggtaaagcaattggtgattttaaattgccaatatattagggtgtagaaaagactaccacttttttgcttagataaaatcaattcagcttcagaaatttggggacatcaacaactaacttacagaagttagggataatttttccctgaagatgcagattaaattaatctgagattggagtttaggcttccttatatttattttaatagtgcctactttttttttcaaactaactttttctgaggtctgatgacttccggctggccactttggagtacatatctctggagaaagtttaggttgtttaactggctggtttatgttcaaagggagggtaaggaaaacctgaaaatgaacaaaacccattgtttacagtacactttaaaagttgctttcatttccattttcattcatttttcttaatcacctgtgaaacaggtatattgtccctattttacacctgaagaatctgaggcttgcagttctaaaatgtgggggccaagatatctgactccttcagtcttttttccaccatagtccacactcagttcctttctcaggaacttccttttccttcttccccacaatgttgcatggtaaaacatattgatccatcttaacttcagacagttcatttgggtccttcttttggtatttaatggttttctgcaagtcagtgaaaaagggtggagaatggggaatctcccctatagggggcaggtcagaatcttctaaggaaagagggtaatgatgggagtgtttttgtgtctggaaacagtggaagcaggaaaaagagagaaaaaaaaggttgagaaccactgctctgaagtgagaataaattggacagttgagaaggaagcaaacctagtgatttcctttgtaacagatttttttcctattttggtggagcagtttttctaagagtccagagaacagaccatccaagaataaggggagaaagttctttatgttaagaggagccctttgtcttcaccttactgcccctaggcagtgactaaaagccatgccccttgttgagagctactaagcgactgaggataatgacaggttactcaacacgggttggagatgaccttttccaaccatcattcccagtttacaaagtttgagaggaaggacccttgtgagatgggaaagagcctttggcattcttccagaactgttttccagtccctacctactctgcctggaagaataatggaattttgcaggcagatctaaatttgtgaagagagatggtcctgaaaatttgaaaccaaattctttttttttttttttttttttttttttttttttttaggagacagagtgtcgctctgtttcccaggctggagtgcagtggcatgatcatagctcacttcagcctcaaccccctgagctcaagcaatcctcccacctgagtagttaggactacaggcatatgccaccacacctatctaattttgtttttaatttttgtagacacgcatctcactatgttgcccaggctggttttgaactcctgacatcaagttatccttccgcctctgcctcccaaagcactgggattacagatgtgagccactgtgcccgtgtaaatgggataaggcaacagaaaaaaaaaattgatttatgtcatcaaatttccctaaagcctgtgatttaaaatatgaatattttagaaaacaaataattaaatttcacatccgctttaatatgattatactctctggggccccagctgaaaaatgaaactgagatggtttgtggatttctcctttcagagtaaacagtagtgtattattttatggagctatttgagaatagatgtgcattcctctaagatttttatggaacagtgcacctataggtccattgtaaatgactgttctttgcttagctctcaacatttatgttacatcatgttatatataaattcatattcaatttattttatcagtggttctcaaattctttaggtgaatacaaaccactttcatgagacaagagatctctcactccacaaaaatgtcctattactttgccactgcaaaaaaaaaagtcacctgaggataaatgatgatgttttcagtgagacactaactagaaccatcaggaatccattattaattcatgtcagacacaaatgaatagatgtagtcatattgtagacacatacgccttaacagtgcagtcctaagggcttctgggggattgctatcttagaggactacttgtcctatgactttgtattgttttcctgtctgtgttctagattatttgcttctaaagaaaccagtttttcatccccattgggcctccttcccctacccttctgaccttcagtatccagtgtagtgttgggtaggcacttatattaataaatgtccacaactgacccactaacaggcatgcctacactttcaataatggcttctggtttggtttgccttatgctggaacaaattacctagtcaagtttattgagaacaaaatggctaccaggccagggtagaggagtgtcattgccttaaagcatattccttgttcttgccagagaatactaatgccatactcgttctgcataaaaaaacaaacagtacaatttgtgaagagaaaatgagactggcagcttttaccccgagtctgggatttgccacattctgtgactagatttgggaacaagcccttaaaggatatcttgccaatgaaagagagaagaaaaaaaaaagagcagctcagagactgcttgaccctgccctgtgtaagccatgggagggaaattccaaaaggcttttcaaacctttctctttctgttctttgaaatgtgacatgcagttctccttaccctccccccttcacttttcctctcttcttttgtggccttttaaaagatacctaagctctgaaaatagtgagttgttttctttcaatatggggaatgaaacctagcagatgaataaagaagaattttagaacaagcactgacctgagagacagggtcctcagttttactactatgggctgtgtggccttggtcaagtcacttaacttctctgggccttagtcataaatgggctcttcccatttcagtagctatataggcttcactgaaaggcatttcctttcagacaccaggaaattatacagaggctcagggaagagagacagtgaaaattaaaaagtgtgtgtgtgtgtgtgtgtgtgcatgtgtgcatatgtgtatgtgttttgccagagatttatgggatggttggatgtagaagtaactttttcaaggagcaaaattattaatgaaaagagttttttattttaacctttatccatacccagacctctatctcagatagagatattcttgctatctccagatataaagtgtccacactttacttgcccctgtgctcacctccttcctaatcaatcccaccaatgcccttcatccagaattaagtaagaggaatagtaatctctctgccattgctacctgattagaagcatttttatcatctatataattgttgggtaaaaatttgactgctaaaaaatgtgactggcaattaacatcaccctcttttctcctctctctgttcctttcctctatgattgctgtaataattcctactgatttgcattcatatttctagagatgagggaaaccaagataatgatatttccctttaagaacagatcaatcaatgatgcttctggatggtgactcgtggaataatgaaagtcagaaagaactgtttcaaaagaaagaagatgatgctccaatggcaaatatatattgtgaatttaaagtctgagtttatcattgtggtctgattgacctcaagaaagcttggcttctggcttttggaccaatcattttagtaccttcactgaactctccaaatagttcatcttaagaatatatgtaccttctcctttcctcaaagccaagtagttgccagtagggatgtactcttggggatggtgagtcccttccatcttttgtggggaaaaggggagaggagaggtatgttcagtacctgtaggtatcaagtttattccttcattgctcatagtaaggaaaacctgtgttatttaaaaataaactactgtttgtaaaaagaaaagagaagataatacaccaaaaagtagttatctcagggccatgagattatgaaggagattccttctgttttctgtgcttttctctgttctccaaaattgttataataatcaaagaaaatattaattaagaaataaatgcaacatttgccatttctcattaccagcagaaaattacatttgagtgcatagataaaagagatgcaggcatactttgatttttctacatggtgatactacaaatatgttttggtgaattaatatataaaatgaataaagtgaccctctccttcttctcctcaccctttagggctaacttcagctaccagttggtggcttcaggtgccagtggccctccacatactgctctggttcttctttctcccttccctcagaagtagtcacttatcaaatatttcagtgctgtgggaaagctgtacattaaggatgtacagctttgggtagggaagactctttttggaacaaaataatcatcctcatatttttataaacttggaaagttggttgtgatttagtatgctgaattttcacctaaaaactacactcagagtcagtatcttgagaaaaacacatttggtggcattaatattttcaattgttgacattagattctcctcatgaaattgctgtcaaaatggatagaattctgtacacttggcagtcttgcctaaaagcaaagcccaagactggaatagcaggaatttataggtcaagacagaagggcatttggcagagttagtcataaggaagtctgcatggtatactttaccaaaagcagctcacatttcattaagccctgatgttttagtcactttaaagaatgaattaacaatagtccaatccaaaagaactagaaaggcatcagacacattgaaagcacaggtattaccaacattaacctattaatttcaaatcacttttttttattttaaagcagtctgtttttatgtgtacagttgttttcttatagaatcactttctctgtgtacagtaagtagctaaatgtgtcagtttactagttctatttcataggatgagagacttttaaagctggaagcatctgtagaacttagctctttcagccctttccatttataaatgaggggactgaggcccaagccattcagtgagttagagagagagccagccctcaaatgtttagattcttcacccgtgagccagcatttttatttctttctactatattagctactagtgtaaataatgtgcctgccttggttttaaattttgtttttcagatattggaagaggtgcctggagaaatggatgctagaagaaaacactggaaggagaatatgtttactcctttttttagtgcacaagatgttctagaagagacttctgagcctgaatcttcttctgaacaaacgactgcagatagcagcaagggaatggaagaaatttataatttgtccagtagaaagtttcaggaagaaagtaaatttaagaggaaaaaatatattttccaactaaatgaaatagaacaagaacaaaatttaagagagaacaagagaaacatttcaaagaatgaaacagacacaaattctgcatcctatgaatcatctaatgtggatgttacaacagaagaaagctttaacagcacagaagataactctacctgcagtacagataacttaccagctctactaagacaagacataagaaagaaatttatggaaagaatgtctccaaaactttgcctgaatcttttgaatgaagaactggaagaacttaatatgaaatacagaaaaatagaagaggaatttgaaaatgctgaaaaagaacttttgcactacaaaaaagaaatattcacaaaacccctaaattttcaagaaacagagacggatgcttcaaaaagtgactatgaacttcaagctttaagaaatgacctgtctgaaaaagcaacaaatgtaaaaaacttaagtgaacagctccagcaagccaaagaagtcatccacaaattgaacctagagaacagaaatctaaaagaagctgttaggaagttaaagcatcaaaccgaggttggaaatgtgctcctaaaagaagaaatgaaatcatattatgaattagaaatggcaaagatccgcggagagctcagtgtcatcaagaatgaactgagaactgagaagaccctacaagcaagaaataacagagccttggagttgcttagaaaatactatgcttcttcaatggtaacatcatcaagtatccttgaccactttactggggattttttttaa

SEQ ID NO: 3733 - DNA, 92645 bp, human
atatatcagaccatcagaaggatttgtataaagagtgactctcctatgaaggtaaaggccacccctcttcagttccagtgactgagatacatttttccaatcctgggggcaaatacagacacagcaagttccttcttccctttggaaatttggcaggtaagtcaagtctgtctctgttgccacattctctcgagattttatgactgtgcacatggcctgtgtgaaagcttcgcttaggtcaccttatgccttggcagccagcatggtgtatgacgattcaggaagaccctggtgtttcccagatggggccagatctggccatgcaattattgccctccagctgggaaatgtgacatgggggtgatgaagtggctgctgagaaggaggcagttagactctgaatttggtctgttctttatttaaatctaaagattgaacacacacacacatagatctaaaatcaatatcatacattcacacacacacacactcacacatgcaccactccccaactgcacagggtattttttagggattcatgtgggattcccctacacatatttcccagtctaactgcctattctttcccctgtttacttgccatctcatcattctctcttcctttactctcctacttatctttatcattgcttttagctgtgtgttcctattaacccagatgatcagtttcagactctttgagaaagagacagggaccctaaatccattgtgagctgctttgtctcattctctcccatgaccacagagaggcatgtctctggaccttgattctgagaggaaacagattcacagaaactacaccaccactggtagcacaatgttactctcagggtggacattctcatttataaaaagagtagtagaataaattgcattctaatcccagcagctctaataacttgtccttctttctatcaatatactgatcactgttactacagaggcagcagggaacaaatatgggctctgtatttaaacaaacttgggttcaagttccagcttcagcagttaatagctgagtgacactgggcaagttgcttatcctctctgatcttctgtttctttatctgcttaattggcatcaaatagaatatacagacagtccccaacttgcaatggtttggcttgcaattttttgacattatgacgggcttattagggtactgaatgcatttttgatttatgatatttttgatttgtgatggttttatcgggacatagccccatcataagtcaaggagcatccgtatgttcaaggtgctggatacataattggtgctctataaataggtggaattactatgattatttggatgatggtcgcaacccttggtccttcctgtctcactggagttagagacaatcagagttaaaggaggactctaaagatgaacaaagcatcttctcacggtcaagtgacagctcggagctgctggatgctcagcatagcactagctctctaacaggctctaggagaaacaatgggtagatctactcctgctctcaaggggccctggccatccaaatgagcagataagatgaaaatgtctacaaatgttaaaaaagaaaaaaaaaaggctgggcatggtggttcatttctgtaatcccaacacttcgggaagctgaggcaggaggattacttaagcccaggagttcaagaccagcctgagcaatgtagggagacaccgtctctacaaaaactaaaaataaaatatccaggcttggtggggcacacctgtggtcctagctactcaggaggctgagatgggaggatcacttgagcccaggagatcgaagctgcagtgagccatcatcactccactgcactccagcctgggggacagagcacaaccgcatctcaaaaaagaaaagaaaaaaagaggaaaatgtaaatatgagtgggcaataagactagtatctgctaaattcttccctatagaccacaagtgctatggaaattcagagagggggtgctgctgtgaataagaagtcctcctggaggaggcaaggcttcagctgagacttaaagaaaggatgaggcttggagtgacccctagaaaaggtgggagctctgtgggcaaatgctggtcaaacttgagaggtaggcacaactgttatttccaatttacagataagaaaatggaaggccagataagcctagtgacttctctaaggccactcagcaagtaatggcagcactaggatttaggtagagatcggtctctgtctggtgttgaaggctacattcaaagctggctctgactgaagaaagatgagaaataggaaatagccattgatggttttccagataggagtgacgtagaaaaggcagtgtgttttctatattcacagtgcagcaggtgttcaggggacgattctggcactagaggggtcaattaggaggcagttgcaatactttagggctgaggtattgaaggcctgatccagggtaggggcatggtgggactagagaaggcattaagccattaggcatgtcaaagggcaaattcacagacttgggaactggctgaataaggagaaagaaggacagcgggatgattaaagaatctgatatgggaaccagaagactgggcaatgctgctactaggcatattgggatagcatactcattttaaggttgctgtttatataaaacagagcctggtttcttttattattattgctattaaatctttttatttttttaaaaacacacataccataagaaaacagacaaattcagaatatgagatattctacaagacaactagcctgaactcttcaaaaattcagtgtcacacacaaaaattaggagcatgcactgttctagattaaacgacactaaagggacataagtagatgcaatacacaaaccttggttttggattctggattttacaaagctatgaaagacatttggggaatattggggcaatttgaatatggattggaaattagattatattaggaattattgtttattttcttagctgtgataatatattgtggttaggagggagaatcttcttattctttaaagagtcattctgaagaatttagtgggaatgtgttatgatgcctgtgaccttcaaatatatgtgtgtgtgtgtgtgtgtgtgtgtgtgtgtgtaaatagattgactgatagaaacagaactacacagcaactatgttgaaatgttaattgtggaatcttggtggttatatgtatgttcattgttctacttctttgatctatttgtacgtttgaattttttcaaaataaaattcaggaaaaaataatgcatgaacattgtaaaaaacaacaacaacaacagtaaaaaagggtatggggggaacctttctgccccagacacccaatactccttcccagaagtaaccactggtcacatttcttgaaatgttatctgcattttacaagcctatgtatgtgtttgtaaattctgttaataaatagataggttcatgctatgcatctttttgttagctacaagtagactctcttatctattcaactgggagagtagttagttaattaaaaatcagtaaaagtggaagtgcttggacccactagggagtggtgaccaagtgcatccagaatactgtgggtatcaatcagtgcattttacacaggaaatggagagcatcctttaattgtgagagttggccccacagacgtcagctaagcgagcttccactgtaatggcagcagcctgcttttttgtttcacttcaggagccttcttggaggtgttaagaaggcctaggtctgccaacatggcctctgagccactggtagaaccttcaggaatgagagaggtgagccattgggcttggggagaggtgaagtcagcaagtgcatgaggggcctgggctaggactcttctcatctgaaccccacaggcacaccctgactgttccatataaccacgtgtagatctgtctcattctttcagtacagttatgtctcattctttcagtacagtttttaggatgaattgcttttaggatgagtatggttttaatcatattgtgctttgggagatggtggaacatctgggtagaaaaaacattgcctaggcttcctgaacttgcctgatcgtaagaatcatttgggtatttgtctaacaagctttccagctagggcagtgctgccatacgcagttggagaaccaggtctagggctccagcgacaggactgcactgacagatggaagctccactaatggtgctagttaaaggcctgagaatagacagagcaggcaagatgcctgagaaatgctgaagtccaaggatggagcccactaattcccatacaagcttcctcccccaacccctcccctccagagatgattgcctcctcttgcaatcgttggggtcacatttccaaagcatgtgcagctttgaatatgaaaaccctccctaactggcagcacctgggcaaattcaaatcacatacttggacataagactcctccttgcaaatgggaaggatgattggaaaaatgtgattccagaaaccagatctggactgaactgaaattgcctgaaaaatgaaagcactggcacaattaacaaaaagggactggattcctttatttattttatttatttgcagctaaatcctacacagcttgcagaccttgggagacagccatccttttatcattcctgatatggacttgaatttctaagaaatgacttttttaatggtctgtggaattgaactcctactagaagcggccctaggactcccagtcacaatgttttaagaacaatcctgagacaagagcaggagctctgaggggccttgtgtgcccacagacccatgaagccatatgctgacctcatattggtctcttcaggtgtcctagaaaacccagctctgcatctaactcaccctctgcattgggacaaggtagagcaaggcccaatgtcattttagggacccacaatggcagaggactgcattggcttgtcacactgcctgaaatgttcacatttcagtgtgaagcactgacgtcccctgtcttctctaaatcaaagtgtctcagaggtaaagacaggatctctaatttttttaagacaagcagcttttcacttaaggttaaaaaccaaatggagaagggtgggtagtgatgtgtctggtttttgttgtaagcctggagggtgagcaggtggttaggagagggaagggtgtcaagaagacccaggcctgccaacatggcccctgagccactggtagaaccttcaggaatgagagagatgagccatcaggcctgaggagagggcctggggagagtgtatgaggggcctgggccaggactcttctcatatatggccccacaggcacacctggactgtaatgattgtggaatcgggaagccatcaccacagtttccaattccttaccactattattaccatgactgtgctgagtgcatgtgctttgaattttcagtgagcctgctagcccagggacacttccacctgcgctgttatgcagtgacacagactgatggaccacagtagcagagagcagccgcggacctcacatctgggggatcaggcctcaaggattttgcatgacagtttattccagctctgccatgtctcttaagaaatccacagttttgattttctgtaactgcccccacccccgcccatgcttttaaaaacacatattatgtgccagatgctagagtaagcatattggatatatcatttatttaatcctcaccacagcactgtgaggtagatgttattgttaaccaattttacagatgtggaaactgaggcacagagagattaagtaacttggccagcactgctctgctccagcagaatttctggaagtcagctggccagctagactctttcagattacttttcctcacccaagcccacttctgaattttctctccctattgattcaacccctgtggtgacaggtttatcttcaaatgaggtttcctaggatagccctgctatggagtcaacctgaccaagggccagctgcaccactcacctgggagcagttgcctgtagaaccagagaacagaaataacaaacttcactagggttggccgcaaaccacaagatcctctagaaggaccccaaaatgtccgtgaagaccaatagtcagattactgaccatgccgccagagaagaaaagggcagcctaccaactatccatcctatttgagccacgtgacttgccaacgtgggtgttttctgaggaaaaccttcagttcacccagcaattccagcctaagctcttttccgagtctgcctgaactaactagatatttgcctctgggtcactgtaacccaaaaaggcttaattaaaatcaggaaataggctcaagttcctctgctgcaatactataaactttagataggccaaagtaggctgcaaggacacacagggataaaaggtactttggatacagcacagtcgtctgggatactcatacacacacccacatgataccctcctccccccgtagaaattaagaaatgagaaaaggaaagtatttggctctaggtgagcttcctttgtaaaggctggagacaatgcatttgtctactgaacacattttgtctgggtatgggggaagcaatctctccagcctgagggtctcaggcaggacttggcctggtgggtgactggggccaagtgggggatgactggcaggccgagggcatgaggaggacagaggaagaaaggggggaaaaaggtgagggggtgagagactagaaagtgaagggaacaggcacagaagggagagaagagggacgccagagatgtttggagtagggacagttgggagaacccatggcgctgacagctccgcatcttgataaagtcatttcctgtttatcagacatcattagggcattagagttctcataccaaagatttatccaagagtagacatttggcccctttgggtatcaatccttttggaactcagtttcatttttttgttgtttttatttgtttatttgtttgtttttactgtgaatataccttatttagtcatttttgtttacaagtgaaactctgggaattcaaaattaacttcgttacctatgagcttcttaaagacaccagaaaagtttcaaccttgtgtgccacattgttctgctgtgctttgtccaaatgaacttttgcgaggcagctgccatccagtttcaagtggattctcttgcccacaatttcacttggaaagaccaagtcctcaagatcgcatggtacgcagctatcagagtacagctcctgtgatgcttttgcttattttttgtatggctttttcaagttggcttaggcagaattctcctctgagcaataaagacaacatgcttctcactgaactttttctccaattcacatactagccagacttggattttctgggaagatttcagtcgagaaacaggaacaaagattatgatagctttctgactaccaccaacttcagtttccttggctgctgtgatattcagctccctgagctgagccttgaggtccacgttcatctttggctccagaagagcctgggagatgccgaacttgaacttgtctggcttcttgccgttgggcttcgtgatcctagtgttcaaactgaacgtggccttctccttgctgagtgctggcttaggaagaagcccaagtctcacagtttgggatagatagcttttgaaatgtattcacactccactgctttctgaaactaaacatcctgagtcttttttctggaaacagtggtaaaagaggcaaggagtttgcttgtgaatattggtttcattctttaaatagatatttgtttattcagggccttctgtgcactaagcactgtgttgggtgctgtggacacgacagacctggagccttcttatggaacttgttctgcctataatttggcccattttgagggggtcagagaatgaacacttccacttcctaaactgtgctgggctgtgatgcagtgaggtctttgagggtctcgggaataagtcgggttgtttacccttgtaataaaaggctccagattgtggtgccgagacttcccagtgtcagctgtctctccgtgctgctgtcaccgtgttgtttctgtaggagcagaaagatgtgatctctttcctaacccatcataagggtcatggccgacactcctataacaaaagacagttaacaagagaaaagcatttaacaaatttatttaatcaaagttttacatgacatgggaaatttcagaaatgaagacccaaagacccagggaaaattgagtatttttatgcttagattctataaagaatgtttagaaatgtgattggataaagggtatgatctaatggtaatagactgaaggcagagggtacccagtaaggcctgtctgtttagattcttcttggcttttctgtgtagcattccttcctccagggtatagggcaggaactctctggcatgagggtctacaaggaagaagtgacctttctagattgtatgggttgccttgggggagagaggttctagtttctgtgattccccccggggcgggagacaggagggtaggagaaggtcagagagagactttgcttctgaggtggcttctgagaccttccagtctcctttagttcaaagtactcagcatgccaaagcgccatcgtttgggttaccattttctgaggcccagcacttcttatctgccatgttatttaacacatgtttgcctaggctagggccttacagtggcttttctctcccacggagtataaagtggatgtgttttgtgataatggttggccatttggatgtatttcctcttcattccacatggttgaggttgctggaagtatagcttccaaggaagtggtgacttacattatagtatagtcagtggcgtgctggcctccctcagttgagcagggaggggaatgctggtttatagtgtttgctgatttccatggtgtaaatgctcccaccatggccaatttcaagctcccgacatgacatcactgaacaaggagtccggaatacatgtgcaacagcaaggcatcatagcgtatttccaccatacagatacaatagatgtaaataacctcaaaagcataggtaacagtaagtgtagtaaaataattaggaagtgatgagttttgagtattcattagctttgtcttttttttttttttttttgagatggagtctcccactgtcacctgggctggagtgcagtggcgctatctctgctcactgcaacctccacccaggttcaagtgattctcctgcctcaacctcctgagtagctgggattacaggcacccgccaccacgccctgctaattttttgtatttttagtagagatggggcttcactatgttggccaggctggtctcaaactcctgacctcatgatccacctaccttggcctcccaaagttctgggattacagacgtgagccactgcgcccggcctgctttgtctttaatataacctaattgtaagtttagatcatttcacttttaacaatggctatatttaacaaactggcccacaaaattcatgttgaaccatcgattctcactatctgggtgagtgtggtcctgcctcacttttctcttagcttaagcagtagagagtctgagtaaactgggtcccaaggctcttgcccccactttaaccagagcagccccacttgtattcatttcgtacataatggggttctgtgtttgaggagagggttccaatgttttttattttttaaccttttttttttagatggagtctcgctctgtcacccgggctggagtgccatggcacaatctcggctcactgcaacctctgcctcctgggttcaagcgattctcatgcctcagcctcctgagtagctgggactacagacatgtgccaccatgctaggctgatttttgtatttttagtagagacggggtttcgccatgttggccaggctggtcttgaactcctgacctcaagtgatccacccacctcggcctccccaagtgctgagattacaggtgtgagcacccagcctccacgttttttaaatgtttttttaaaaggcattggtatagatggtctatgaggttccttccgtttatggtatcttaagttagccatgtcttccattttccctttcattcccttgtcccctcttgtcactcaggcatcctattcctgctattcccagagatcattttgtcccatcccaggctctccatcttcactgaagagatagctgttatcagctgatagggttttaggtgatattcctcccaggcgtattttactcttcaacacatgactccagaagacacataaggtctttcaaataaaaggaatgaatttttaaaagctgaaattccaggcagggtgctgggggtgaggggtggggtgctatctgtactcagtgcccttaaaatcataacactgaacagtcagacctgattctactttgcagtatccttcaaaaatctcttgatttcgatgggttgctaggttacccccaaaaaactgcccaagggtgtatctctatttttctttacacaacacagttttcctgcagtgaaaactgaaaccttattctagcagatgtttggttcgtcttcccctgaatgcaaagttttcatccatggaaatgatagagaggctgcaaaggttatggatatgacacaatcctttctgaaggcaaattcaccctctttagcatgccagaaaaattatttttccaggaaaactaaacactaagcacatgcttggatgttcctttcaagcaagagaggagccctttctatcccattaaggtcaggcaattgcccaaatgatttgcttcactgcctatcataacggggagtgtgggatggaaccagcaggtgtttactctcatctctctccatccagcaggctagccaagcaaagttcataggcacaggcaccctctgaagcctggagtcagagaggctgaggctgggggacactcgggacccctccaacacacacacacacacacacacacacacacacacacacacagatgcatgcatgcccacacatagaagaccacaacattccctcagttcaacacagcagctcatgagagtcagtattatggaagcaaaagtagagcagagcagtggaataagatgcatggaacctggtggcccagaaggccacgggatggggcacaataatgagcttctcggccagctgcccagtctgctgggtgcatactgttcaaatgtagataggatagccagtggcccaggagctgtgggggacaagagggctgctatttcctgcctacacggctaccttcggaggcctggggtactttccatagctttgcttctcaggttctgtccccacttctgacaccagcagcaacctccctttggccccattttgctgaggacatggctcactatctgaaagcttcaactgtaaggaggtacgtatgcatgcccaacacacaaaacagacccaaagccaaactctgtccagttgaggccagcttaggcaataaatcttgctcaattccctggtcagaatacctctggctacctctgcaagcccggtctagtcttgatccagggccgtttggccaaggtccctgcacagtcggcactctttcctcttccctgtccaagctgagctcactctcccctggctttccccaaagtccttcactttcagaattggaatcttttgaaccaaaactttctttcttacaaaaatatcttctctaactctcacctctagccttccattctagatttctaggttctcttgtgtcttctaacacttgaattctgagggaatttggtctctccaggggaagcagagaggcactccttatttatccaataacattcagtggctaattatcatttatagaccatcgtggaagtcatcaatctcagagtgtgcttttcccgtatcacttgctcctgatgttggagagagattcgaaatctaaatgtaagtcaccagcaaaatactgtcttttcaatgcaccaaaaggagggaaagttagcttatcttgtagaatccttcaaagtactgtgaactagctgagtaagggtaattagaaaacggaaaagggaagtcaaggacaaactcccatgtagttggagaagtctcacaataaagtaaaatttcccaagaattgccggaaagcaagtcttacaaccactgggaaatgatgagtccaagaatttcagaagagcctccacccttcacctggccttgaaatcaccaaagagctcctactgctccactccaggctcaagaagcaagctgcttttcattgctactcttcaaaatgtgctcatatccattatctcatttgattctcaccatgaccctgtgaggtaggtaggacagatattagttttccccggctcacttctggaagattcccaggagtcagattttgcacaattgtaagttgacaggtttggctctatttgcacatgctaacaaaatctggcctggtccaaccgtatgtaaagggaagatttgtcatgcaacattgacctaagctatgcagagagaagcctgatcatcggggaaggggactaggggaaatttcttgggaaatgtaataattctactcctcctttcccttcctgggcctaaaaactcacgcttgaatgggaaggcttgcattatcctcaagctactcaaaaagtttcttgaagactggataccaaggccaaattcctatatatttagctatatttgatcaaccttaccaattaatcaactgtacatcgtgggcccagctcttgcagggaggaagagacagagaagtaggagatcagagtcaatggatcctgacctccaaaagcttacagttttgctgggagctaaacttgtacacactacacaacaatgcgtagcagccaaacaaaaggaagagaaggtcagagagggttgaggcagccaggggagacatcccagaaagtcagaacagaggggtggttaggagcatgacctctgaggttgggcagtaaacatggctttgaattccagatctaccattatcagcaatgtgaaccttgagcaaatcactatacgtgatccataaaatggggtgaaaatgaataagtactttaaaagttgctgagaagattaaatgagcacagtatggtatccattatctcacttgagaaaataaaatttggtgctgtttaagctaaccattaaaaatggggaagatttggagacactcagggggagagacaggacaatacgaggcgctgaattaaacaaaggtactgaattaaaaaggaaaggaggtggatgaggatattgagaatactggtattgctaaagcagagagtacatacatataaagggagtaggagacaataaactgtgttagattgggtgcagcaagatggcaaaaggctaccaactggaggagtttagactggatatgataggaagggagaagccaccagagatttttaagcaagagagtgacttgacgatagtagtcttcgaataggattggcctatggagcacttgatgacttggagagggactggaggatatccattgtttgaggcatgagttgacatgcgcctggactagagacatgagagtgagaatagaaaacatttgaaaagtattttgtaggaaaaactaaccagatagagtaggtaattggatatgggagatgaacaagaaggaagagtccaagagtcttccaaagtttttagtctaggtgacttcaaaagtggtggtgccattgttcttgcttataagtgggacctgaacaatgaaaacacatggacacacggagaggaacaacgtacactggggcctgtctcgggggcagggggaggagagcatcaggataaacagctaatgcatgcagggcttaatacctaggtgataggttaataggtgcagcaaaccaccatggcacacgtttacctatgtaacaaacctgcacatcctgcacatgtatcccagaactttaaattaaattttaaaaaagaaagtcgtggtaccattgacagaaaaatggaagtcaagaagagcagtagacatggaaggaagatgatggactcaatgttcaatttatagaaatgtctagaaaaaaagttgatactggaataccctagagagaagaatttccttcttttacttcttttctgacagacacagacctcattttttgttagatgattatattatctgcaaatattgacaattttgtttcttcctttctgatgctattaattctattttttattctatggcattggcttggagctctagtaaaatgttgaatagcagagtagcagtagaaatagacatttctatcttgttcttgactttaagggtgaaaacatctaatatttccaaatttgttaacaaacacttgtgtattgcttctgtgtgtgaaacgttattatgaacactttacaaatattaggctatttaatcctcctacaatgttatgaaatagatattattattattattattattattattcctcttttacagataagaaaactgaggcatagaaaagctaagtaacttgcccaaggtcacacagccaacaagtgttcaaagctccactgcttagctttggagactgtgttcttaactaccctgctacacttgctgcctctttttaagtatgaagttttctgtacctttctggaaagtactttttatcaagttaaagtttccttgtatttctaattttcttagagctttctaagagcaaatgagtactcaactcagttttatcaaacatttttgctgcatctattgaaatgatcatattatcttttcctttattatgcaaatataatgaattacattggtatattttctaatggtgaaccagccttgaatttctgagataaaccctacttggttatggtatagtcttctttttccaaagtgcgagatttgatttggtaataatttatttaggggttttgtatagagttagttttcggtcctcatataatttggcattggtgttatgatagctttggaaaataagttggaagtttctcatcttttttaatgctctgaaattgtttgtttggtaaagggattatctgttccttaaagctgttgtacactttacctttaaagactacttgtgtgtgttaagggggctgaggtgtacacatctttgattctatttccatttcttctctagttttgttgatacagtcagattttcatcttgctctcaagccaattttggtaaagtatcccagaaaattgtctatttcatctacgttccaaatttactggtataaatattaatacaaaataccaattatttataattttatacctgtaccaggacttacacaattactaagaataatattctcttatactttttaatatagtcttttttatttttattttttgtttagtcccacccttcatatctgatttttaatatattctaaatacagttctgtcctctctctctctttttcttcttcttctccctctccctatccttcttcctctccctttctctgcctctttttactcttgagtggttgttgatgtgttttgtttgtttgttttgtttcgtttttagcaaacttgctaatctttgcctattttcatggtcttcccaaagagctggcttttgcttgtattgatcaacatttcatttttgatgattgtgtattttgtaagtttttgctttaatctttcttagcaaaccttactcctgcaaagctcatctgtctagaatatcctttcccccttccctttcacttggctgactcctactcattcttcagtttatgcatcatgtctttcaggaagccttccctgacacttcagagtgatttaaatgctcatcctctgtcctcccccaacaacttccagacctcatcattccatgttataattagctgtctgctttatctctcttccctattagactgcaaattccttgagggcagggaccgtgtctggttcataattgtacccccaagctcctaacatagtattaatatttgccatccccaataggagttcaaatggaaattttattggaggtagcaacccacccataagctggtaggtagatctcacaaaggagctcctagtacagtctgttgcctgaagtttggggtctttttttaaaaaggaaaaaaatacccttggtagctttagtttcttgatttttaacataatcaaatcccttcaaatgtgtcattccatggtctgtctaccctttggggacgtgttctgcgcattctacctctgcactccagcatggatctagaggtttcaaccccaaagggcacaaggccaagagttggccctaaaggagctgagactgactagagttagagtctgcaggctgccccagggcttctttatttcaaagcagcttcctgcatgaaagccttttccttctctgtagttaaggttggggtacctcacccccacttccactcctcttgtttccaatctcatctgaaacacctttccctctatgttcatctttcctctcaattccctccccttatttgccattgactctgtagttttttattacttgtgtccaggaggtgtttcgagaatgtgaactgaagtagtagtttatgaaattggcaacatctgtgctctgctgccctcagttttcttctggaaacttatgtggttagcactcaggtccaaggaaagcagaacacagaacgaactgaaagagaggcatacccaaatcatggaacaccatcagcatcagggctggctcctgcccacgtctcagctcccacctccaccctaagctacaggctgatagaagactatttctagagacaaacatcaagctggtgactgagggttttcctgctcactgtgaatttacttcctgggaaagatggtctcacttcctcacatcatctgggttcctctttgaggaaggcatcatgaaactgaaatataaaaacacttctgaaagaaaactcattctgaaattgtagggaggtcagagaatacaggacccaaaggatacccactctgtgctacctgcctaagacagaactaaggaaagagagatggctacagggaaccatgcaggctcatggtggtgctaggaaaaggtaatggactgatgctgccaggcagcctatctcagtcttttctttcttctttcttcttcttctttttttttgtagagatgggatctcactatgttgcccaggctggagtacagtggtgtgatcatagctcactggagcctcgaactcctgagttcagtgatcttcccacctcaaccttctgagtatctgggattacaggcatgtgccaccatgtccagctaattaggtttttatttttttattttggagagatggggtctcactatgttgcccaggctaggcaaactcttggcctcaatcaatcctctcgcctcagtttccagagtagctaggactacaggcacatgccaccatcgacagctaattttgtacttctttgtagagacagggtctcactacgttgcccaagctggtctgaaactcctgggctcaagtgatcctcccacctcagcgtcccaaacctttgggattacaagtgcgagccactgcacctggccccattactcagacctttctaaggttgttttgttgacagcaaatgtgctccaggcactgtgctgggctctagggatatagcaaagaacaggacacagttactgccttgaggagcttatagtctggtatctgtgtgggacacagtgtccacatttggaactttcctggctactatgctatctggcaccttgacttgaatatgtaccatctcttcagcattttcagtggccccagagacagaaactgcatctcatttatctgtacccccaacatctagcacactacttaaaatatggtaggtacccaataaacatttgttagatgaataaaggaaggaaagaaaggagaagggaaggacggaaggaaaaagggctagatgaggtgtcccagaaatgtttcatattgactggagatgatgttgagtaactttcataggagccaatctcagggaaatgcttgagtccctgatgatcattgattggaccccccagaaacaaccctcccagtcaagatgtctctgaagcaactagaatcctgaagcagttcccaaagtcatgggacaaaagctcaggcatacctaggtcagcttcacagatgctagtgactttgaattggtcacttttattgtagtgtttattcatccttgaaggtattaaaataatagggtagaaaaatagtttgatggttcctcaaaaagttaaacatggaattaccatatgaccccacaattccacttctaggtatatactccccaaaaatcgaaaacagggactcaaatgagtacaagcacatgtgtgttcacaacagcactactcacaatagccaaaaggtgaaaacaacccaagcatccatcacatggtgaatagataaacaaaaaaatattgtatatctatacagtggaatattattcggctataaaaaggaatgaacttactgatatggattacaatgtggatgaaccttgaaaacattatgctaaaggacagaagccagacactgaggcctcatattgtatgattttatttacatgaaatatccaggataggtaaatttgtagagttggggcactgatgatttccagagtctgggagaaatgagaagaatctgcttaatgggtaagaggttttactttggaatgatggaaatgttttggaactagatagaggtgatggttatgcaacatgtgaatatactaaatgccacttaattattcagtttaaaatgtttaattttatgtgaatttcacctcagttaattattttactttggaaaaagtcaaagtagaacagcctcaattctgtggacaaactgggtagttgtgggaagggtagactagctgggtgtagagtgggaactatttccttccctacccaccaccccaccactccccaatgcttgttcctttcttcagctaagtcaagtgtttattcctatctccattcctgttcatatccaagaatcatctggaattattcttaagaatattctacttctctaaggactgttcatcagaaaaaggcagttgtaatttattgggagtccttctaagaaaccccaaatatcaaagattttaggaatatggaaaccatcatgtagacctatgtcagcttaagaagatggccttttgaggagagtcgtcagaaaatgttgatgtagccaaggtgatgggtgcatacaaaatgctgggtacctgggggatgctaggaaatgcttgttgattgactgattccttgattgagtaaaaaaagacatttgcattatcctaagtgaactaacacaggcacaggaaaccaaatactgcatgttctcactgataagtaggagctaaactttgagtacacatggacataaagaagggaacagcagacactggggcctaactgagggtggagggtgggaggagtgtgaggatcaaaaaagtacatattgggtactgtgcttattacctgggtggtgaaataatctgtacaccaaactcccgtgacacaaagtttacttatataacaaacctacacatgtactcctgaacctaaaataaaaggttttgtttgtttgctttttttttttttaaaaaagccagcaatggcaatagccaggaaggcacacccagcagagggaatggcaagagtaagagcaggaccaaagaattataccacccggaattatgctgcagatgttgacacagcagagagcttcaggagaaatagaggatgggaatctttctttacctaactctgctactgagatcctttggaaaagtagtgatgaaatgaaaaatacaaatatcaaggcaacaaaatctgaaaaaaatagaattagtgctgaaatataattaactgattttctatttgaatcatcgtatgacattcatagaatacttgcatcatggaactatttataagatttttctgctaatagtcaacacctcaacaactgtcaactcactttttgctcattcacaaaaaaatatcttagaaaacttaaggagaacaactctttagtctaaatggcaagtcttgttttataaaataatatctcaacatagctgcatgtgaaaaatggtcatttttaagcagtctttgtaaaagtaacaatgaattttgaagtagaagctgatgctttgtgtcttctgctatttgtgtggtcaatgacacggctactgctcccagagtaaacgatacgtgccagtgaatattttgtgcaagttaaatgttcatcatcctctttctgagaaataaaaatgcattactttaaaaacaaccaaaaaaggacatttaaacaaaggattcccctccagtagactctcgtttatgggcttcagaccacattttgtgtaagagctttcagtcatccattttttctttcattccacaaaaatttattgagcacctgctgtgttccaggaaatacagtaatagggatgcgccatcataggcatggataaaggaaattcacatacaatccccccaatttttttttcttttgagatggagtgtcactctgttgcccaggctggagtgcggtggtatgatctcagctcactgcaacctctgcctcccgggttcaagcgattctcctgcctcaacctcccaactagctgggattacaggcatgtgtcaccatgcccggctaatttttgtatttttagtagaaacagggttagaccatgttggccaggctggtcttgaactcatgacttcaagtgatccagctgccttggcttcccaaagtgctgggattacaggtatgagccactgtgcccagcctacaatcccccaaattctttgtaagcataatttcaaccctttactatctctaaactttgagcttgagtaagctgatgggcaagaacagggcaagttatggtgacgatagtggtgtgtccacaaactggaatatgtgatccaataagtatggttaatggacaacagagaagaatacttgcaaatagggctattgaaggaaatggccctttgacaagggaggtggaacagttgggggaaagcctggtcaatgtcttcttccttctgtcctgtccccttccccatgcctggaccacctggaaactatggattaaagcagtattctcttgcacccctatggctacacacacccctgggtgcagcggctgctttcccctatctccagcatagctcatgagggactccatgtgagcgctgggttgcctgaaattgagggaaagcaatctggtcagaactaagtagggcctgcttcttgttgcctatgctacagttaatccattgccatctgtctttattttgctgactcactgctttcatttgggttggcagttcttttgctgttggctgcagtctttaactgtttacggaggactgagatggatggagaattaggggctttgcattcattcgctgaatgaaatcctacccaggtactgtgggcctcttgtcgaggggctgaggccaaggcccctggattttgatggatggtggagattaagtgtagggtaacacatcatttagtctgattgcaaggccaggtttctcccaagcattgccaaatgagctgggaggtcatgcgaattgtctgcccaagcacaagggagcgtgatatcttttaattagagtaaggatgaaggatattagggaccttggtctgtcagagaacttggaacacccaaatgctatacttcattcaagtttctctttaagtttcaccttatccatggaagcttttctgcataaacttccatccccacactgcatcccatccctcctccgaaatgcacttccctgcgctttgaatctcatcagcatttggcttcaactgtatacaatcttggctcccacagccattttgaagctgcccttcagcagatttgagacccattctttatcctgtgagatagaaccttatcaagatgtgaaactctgtagcctttatagctcattttgttatatggcaattggatcctgggaaaaggtgacttggaggaagccatcattggcctttgagacctataggaattcagtagaaacactttcaggatgctttgtcaaatgacttgtgttaagatgccaagggtttgtcgtgggctcatgtaagttttaacccttttcaaggctactttctgtaagcattgtatcatttctggggtagagggagttgagggttttttggtatatctgcctactcagccttggtgtcaaccagtacttcctgggatttggggtaggaacaatagaagttaaaaaggaactttgtgttttaggtagggggaacgtaggtactggtttgctcaggatagtcctgtgttacacctgctgtcctagtgtcattatcgaaggcacatttgtgcccttcacccacaaaagtgttccagtttgtacaataaacttagctttaggcagcaccttagctttaggcagcaaatatgtaatgtacaggatcacacccagagctagaaagactacagagttttgcagttgatgagcttctatctcactgggataaagaacgggctttcaaatctgctgaaggacagcttcagaatggctgtgggagccaggattgcacacagtggaaacaaaatcctgatgagattcaaagtgcagggaagtgcatttcagaggaggggtgaggtgcagtgaggggatggaagtttttgcagaaaagcttccacggataaggtgaagtttggagagaaacttggctgggtgaggtggctcatgcctgtaatccctacactttgggaggccgaggcaggggaattgcttgggtccaggagttcaagaccagcctgggcaacatagtgagaccctgtctgtatgatttttttaaattagctagccaggtgtagtggatcacaactgtggtcccaactactcgggcggctgaggtgggaggtttgcttgaccccaggagactgaggctgcagtgagtcatgatcataccactacactccagtctgggcaacagagtgagaccctgtctccagagagagaaagagagagaaatgtgaatgaaatatagcatttgggtgttccaagttctctgacagaccaaggttctgaatatccttcatccttattctaattaaaaaacaccacactcccttttgcttgggcagataattcacatgacctcccagcttgtttggcagcaatatgttttataattatatattttataagcaagtgtaaaaaatacttgcttataaaagttgttcccttaacaacttaagattgcatggtcagactatcccagggaaagggcttctccaagccaccaaccctagaaagtatcctctaccaatcggacaggatcaaaacgtcacctccaggaattggagctctcagacactgctggcaggactgtaaaatggtgcagacactttgcaaaactgtttggaaattctcaaacaattcaacatagagttaccatatgactcagcagttccactcctacacatatacccgagagaagtgaaaacatatgtctacacaatagcttgtacatgaatgttcatggcggtattattcataatagccaagaagaggaaacaactcaaacgtctatcaactgatgaatggataaacaaaatgtagtatatccatataagggaatattatttaaccatgaaaaggagtagagaactgatatatgccacaacacggatgaactttgcaaacataatgctaagtgaaagatgccatcacaaaagactgcatcatattattccatttctaggaaatgtcaaaacaggcaaatccatacaaatagaaattagattactggttccctaggactgagcagggtggggattcagggatggaagagtgacagcttaatggtacagagtttcttttgggggtgattaaaatgttctaaaattgattgtggtgatggttgcagaactccacgaacatactaaaaaccactgaattgtgccatttaaatgggtgaattgtatggaatgtaatttagatctcaataaagccattaaacgtgtggcctccaggcataactcagactcagtaccagctacccagttaggcttgcactcctttagcaaggacatgggcactctcttccagagagctcttctcaggcttcaaaatgggcaagcatgaacttgggcaaatgcctcataagtgcaaaccagtgggaagaagccttgttaatacccataagcctttggggtttttttccccctttatagaaacatccaacccagagccacagagtccaataataattgacagacaagaaccttagagcttgcctactccaatccctctgtgtagatgctcagaaagaggaagtgacttgctcaagtcacacagctagtcagtggcaggacatggaccagaacctgatgctcctaactcccactccagtgctctttctcctgtcctggcttctccactacttccctttcccctgccttgcccaaatcagcccctttggcccttcttgctaaaatctaggagtcaagtctgagaatccaagcacaaaatcagggtgaatttacaattttggaaatatggtacaattttcctaagtagtagatcagaagatctgtattataggtcttccaacatcaggatgtggatggagtacaggatttgacccctggtacaactaaatttgtggaataatcacatgcttctttttatactgtatttggcagtattagaagagaaaaataatattcatcttaggaaaaccttggtaactgcaaatttgctggcaaccttatttcctcttgctttcttggaagaaatcaaacgaaaaagcagctgtacaaattagccctgaccaacaggctcaggaccaaaacaaaacaaaacaaaaaataataaagccaaaaacaaattaagcttaatatttaaatcagaatggaaaatatatccaactatacgcctactggaacccttgaaactgctaatctctacttgattattcacaacctgacctttgcaggaggtcaggacaaagctggggacagtctgaccgaaatgtatcagcaattttccaaactccttcatctgcattcacagattttcctgataaccctaagagcagcaaaaccattgatcatgcttgttggagtcctattagtaccacagtgaaaagaaaatgtgcttagtaggccatcagtcaacagaccctgtgtgccaggtacaatgccagtgctagggggagacaagacggggaagaaatgatgcctaccaacaggagccatacacccccaaaatagggtgaaccaggcatggtgtagggcaagagcatggggcaagagcaaagctgaagggctaggagagtagatgtatgttgaataacattgaggggactagtctttctggaatagagatttcttttgagggagttaatgggatgtttgattgaaaaagaaggttggagacagattgtggaggcaaaatggagcattttgaagaggtgagtggccagatgaaaaccacatcaggggagccttctcttcagcctcccctcaacactggttttggtattctctgggctcccacaaccccctgggccttatcctagcactttacacattttcctgtaattcactgcttccttgtacttcttccctcaaactgatttccttgtgggaacagcttacatctggttgatgcatatatccctaatgcctaacaaagggtttaacacgtggtcagcactcaggaaatgtgtgttgatgggatgggacaggacgggatgggacttgatagaaggttagatctgtggaggagccatctggaagagaaggcaggaagaggagatcagttagaaggatgttgccctgggagatgaggaaatatggccctgacccaaagcagtagcgatggtgacagagaagaagggaggatgtctgatgtattttgaaagaagaatagacaggacttgggaaccttagttaacactgacctgaggaaacaatgcaaaaggactgtggaaccaaagtaggttccccatgaggcagtgtggtaggtcctacagaccccaataggattaaccagcctccatttgcactttgtggacaattggttatgagcacagctgtacttttcatgtctagaggtgaaagggactagaccattgctgaggggactttgcccagctgtctctgtgccggctgtgctaagtccccagggagctcatgctgaccaataaggcaaagctcaggagtgatgaaccaccgtttggctgtcttaatcctaaggcctcaactcagctctgaccacctggaggtgtcacacaaagaagtccaaaataaagaagagtgtcagcccaagaaacaagagtctccttttcctagccatgcctatttcgttccaccttcagtctttctgcagctcaggaagggaggggtgagagaaaaccacggaacttttcaaaatcccattttccaaaagctaaatcagattcattctgtgtctcctgcgcagactgcattagtctgggtaatgtaaacactgtgaggccacagctgtctgccagctgcaacgttaaagcccgttttggggggcatgaaaaaacctgtctgtaactatcacagatgagaagtgttagttaatgaatggtccctgctgagtccagagcccagctgagttatttcagtcttgagccttagcagagatttttattgggtaacaaatttcaaatgctccagttacccctagaccccagattggagctcgttgctcaatccaacccccacgccccagccaaaactaattcactccagggacattcctgattgcagctcaagaatcttggtgtttggagtgttgggtgattgctcaaggaggatttggtaagggcttaataataacatcagcctccttgtgctccctgcagaagtgtggagagtgacctttttcaagagtagggccatccgtggcttccaccagggctggtcagcttggagcagcctaaggaatggtggctttgagttggacaccactgtttctgctgggccttggcttaaagctctgggttttgctggcacctttccactcctactattctttctcctcctacatgggctcaggtcaggggcaaggccaagagggccaacaaaccaccagctgcattgagacaggggctagggcccaggcctttacgtgcataattcagtggcatttcgtacgttcacaatattataccatcatgacctttgtttagttctggaacatttttatcatcgccaaagaagatccccatacctgttaagcactcatttcccatcccctcccctccctgtaccggctcccggaaaccactaatttgctacctgtctctgtggatttgcctattctggacgtttcatacaaacggaatcatacagtatgtggtctttgttgtcaagccagtattctttgagtacccactgtaatagacatgaggattcctcctcaggtgcagcagctactgctttttagaatacttagcttaatcaaggcacatgctgggtgattgatttgcaccattctgtttaatcttcacaacaactctctaaagtagataataataatgttcccatttcaaagatgagtagtccaagactaagagaaattgagtagcttggccaagatcgcactagtagttaagattccaactcaagtccttccattatttatcatgtattcagccctacttagagccagtctacttacttagaagcaacatactctcttcgtggtatgtgctgcctgccccatcttgcccgcccttaaatccccactgtgacagaccccataggcaagggaataatctcatgagccccttgtgaaaatacccatgtgttggcagggctagtagcctggtatgagtgcccctagtattcatatgcccttgggcacacccagagttttctttagttcccagagagctgaatataaccccacctccttctctcccactcatgaaagcatatgggtatgttagtgagagttatttatagagaaatctttgaatctgctcaaatttatttttaagtaaatcatatgcaagctttggtatttgattattagaaataaataataagtgaggccaggcgtggtggctcacgcctgtaatcccagcactttgggaggccgaggggggcagatcacccgaggtcgggagtttgagaccagcctgaccaacatggagaaaccgcgtctctactaaaaatacaaaattagccaggtatggtggcgcatgcccgtaatcccagctactcaggagtctgaggcaggagaatggcttgaacctgggaggcggaggttgcagtgagcttagatcgcaccattgcactccagcctgggcaacaagagcgaaactctgtctcaaaaaaaaaaaaaaaaaaaagggaagaagaggaagaaagaaagaaataataactgattatcaaacaccaacgtgtcctgacatcaaaggtgagaatttttggtccaaacacatctagaggctgcaaagagctacacctcagctcagttacctccagtttgcaggtgaattcccagatcagtgaagttctccctgaagactgaagatcggattgtgtcaaaggtctggggtggccttcatgaagcagcctcaaaggctgtgcacctcatgtctggacttttgagcagtgactctggctgcatctgacagggactctcatgtcccaaccacatgtacaagaaatcacaagggcttgacccaagttctgcaataaaactcaagaaaaaggaaaaggaaaatgtgagttgttccactgttttaaagacttcaggatatatgttttaaaaattcacaaatgggagcggcactcaggaaagttcaatggaactgaaagagacaaatattgatactcaacagtcagcttcaataataataataataataatgggaccgcctgaattcaaataaatggaacagatgttcctcatgtgttctgagttgaaaatcattccttcatgtgggatcagttaaaaatcaagcttgggacttactgtatgtttaatataaaaactctcaataaaaatactttggaggcaaaatccaagtgagggcatgctgcaatcatcagtgcaaataatcaaccagtcagcatttgcctgtaagagaccaagggatgtacatgtgtgaggatgagaattactgagatagaggtggtgatagaaagttatttgccatcacatctaaccggagctcagcatgcaggggttttctcaatgtaagtgggacttggaaattgaagctgtggtgagccatggaaaaatggaaaaatcaattattttgatatttagtggacattagaggaattttcaaaagatgggctcttagaaataaatgaaactgtcccacagaatagctaatttcaacttgaaccagcccagccccagtatgggggtggatataacgagaggactttagtactttagtctgccatcagtactccatccacacctaacatcagagctggaagacatactagaaactatgatccaacattctcacttcactgataaggaaacaggcacaggagtctcttacacatgcccagggtcatagaggaaattcatctccaggcagaattcagggaacccactaaaagaaagaggcagaatcaaaatggaatatagaaaacattgttgccctttcacaatacaggcataacattaggattctacaagaaacaccaaactggcatgccctttcattccacagtaccagctaacagccctgttcattttaaagaattagtggagtaaaacagtcacccaatccaaaaaagagaaacaccaaacaggcagccacaaagaaggtcttgacgaaaccaggaaagggtcaagggcattgggaagctgccttacaaggccaggcaggaaagattaaagcaaaatagttggggaagatgaaggcatagaagggatgtcatataatcaaagtatatagagaaactcctgaaggtcgtggatccaggggagttagacacattcatcagattctggagtacaagagagatgcacagcctttgcagtgattatcaggaaaaacagactgaaaaaagcagctttactatacacagtggatatgggatgcccagtaaatgtgaaggaagtgtgcaaaccttattctgaaggtgttgtgaagttaaaaagcattttaatgcttccagtaaaccaattcttggtttaataataacattaataatagctaccatttattgagcacttacgatgtgccaggcaccatgctgagctctttacatggttttcttatttcctccttttacctttatttcatccttttttatttcatcctacagttgtgatgtaggcactacctccatttttcagatgaggaaaccaaggctcagagaggttaactcatcttccctaagtcagacagctagtcagtggtggaacctcccctcaaatccaggtctcccttaattccagagcacagaaacactcccccatcctgcctctgtaattgggacagcttggttgcttgagactctccctctgacaaaagtggtattttagaatgttcattctggctggtggaaaaagtgaactggaaagataggccccaggaccaaggaaccagttaggaggcagaaccaatgaaagggaatgaaaataaagaattctgtgaaatagaactggaaggagaaactgacagactccaaagacgaataggatcttactgtgccaggatctgcttttgccatttaggatatcgtggagatcttcctatgataagacatataaatctgccttgtaccttttgtgactgcttaggcattcaatctgtgggagtactactacgacaaacactgttctagtgagcatgctggatatacgtatatctttgtatactggtatgtatataagatcaattccaatcagtggaatttctggcctgaaagaaacatattttaaattttgatagactttttcgggaagattttcatagttgagtgattattattttaaattaggggtgtgggagggaaccttccttggtagatatactatagcagaaataaattagttggtcatcattcaaaagtgtaatcaaaaagcacaaggcctttcataccattcctaccaaacaacatcaatgttgtcgaagctaattacaggaagaaagggaacagaagacacagtaacccttttgggaaccattttcaaatggagaactgggaactcatctctcttcattacttaattttgagggaaggggaactatgctgaagtgttgagcagctggatagctgtggctgtcatttttttttttaagggaaagggtctcactctgtcacccaagctggagtgcagtggtgtgatcatatctcactgtagcctccaattcctgtgctcaagtgatcctcctgtgtggctgtcatttaatagacagcctattgagaggcttctaggaggaagattggcaaactgaatacagggcaattttcagatataataataacaacttgattttgtttgtagttgagaaggttggctattgtttttagttaggggatttaaataacttctttaaaacagctcccaaagggaagggaaggtaaactcaagtgttattatgaagtataatggtctgtccctccaagtgataagtttgattcactgctagcagagccagttctgcttggcacctccccagtactaactgcctctggccaaaaagctaccaggccctggtgccagatcctgggtgtcatgagccaagtaagaagaagggagtagatggggagagaagatagctgaggcaagctgtctctcccagagagatgggttacaacagaatccaatgcaagcttttattggagagacctatgtgtggagacaataggcctactttttaaatttccacaaaatgaactaggtacagaataccactattttattcattcacttgacaaatatttactgagcatctactatgtgccaggtactttgataaacactgggagtaaactgttgaacaaaacagaagtgtcccctgccctcagggagcttactgtttcataggcaaggtgagtgaaaagcaagtaaacacacaaatatagaattacagatggcaaaagaaaaaatacaggtggggcatggactaagggtcaggatggtgtcgccatggtggcctggcatttagagtgagttctgaataaagagaagggagccacctttcaggctgaagggaacgtgtgtgaaagcacttttgggattcaggctcttgaagtcgctggtcaggcaggaggctccctgaaatctgctccactttttgctcctcactgtgcaaaccaaagtgctctaggctttgtggttgctcagggcacagaggaccagatgggttccagagaccagcctgaaagttccccagtgaggatgcatggtgatagcctgcgagtttcagccagttggatgaggtgagcttccaaaatattcttaaaccctacagcctccgagacccatttcccagtgatttccattcctggtcatcactttctttctgcaggggacacttgcctgtggaaaagcagtgcctcgccttggttagggttaaagattgaggcagtgctggccttcaggaaaagtgcaagcagcaatggagagagagcaaaaactgaagccaaggaagcagcccctgccaacaacttccgttctttccctttccttcggcatggctgcccaaggagcccccagtgactgttcatggtgatctgtttgtttcacaattgacaaagaaggagggagccctttctgacatttttgcccagaggacccagatttctcagtttgaaactgccaaatacgcaactttgggtggatatttggctgaatcactttgaagggcttgtcagtgcctaaaatggaaattgttagaaagcagaggagggtggttgccagcaaccatgaaatggtaatgaccaaatcatttatttttgcaatgaaatgtcatcccctaacactacaaaggcaggttttttctagcttagaagtactgactacctataaaaatcttcaaaagtgattctgtgtgccatgcacatgtacacatataccccatttctctcaccctctgccttccctcctaaaccaagcttcttccatgttcctggagcccagctgcaacctgggatgaattaagatattggctgattatgaaaggtaatcaggcttcagctatcatataaaatgaaggggagttcatttggttatttgtaagatggtatgtggctgactttctatgtgggaaagtcagtaggctgtaatagatcatgccccaaaatacgatgtggatcttttaaagatctgtttgagtctagctgtagttgcacctaggagacatgatacttaataaggtttctcctatctatctatctatctatctatctatctatctatctatctatcatttatctgtcatctatctatctgcttcattagcaggcaaattaggcaagatctcccattgtgtactttgtatttttaaatgctgacaccttttttctgagtttaggaggaagatactggaaaatacattgtgggttgacactggggaatgcaagaggatctttctttgaaaacagccattaagatactattcccctgggccaattcctgggcagttttaaccacatacaaagccccaggttcttcttctagcttttctatattgactcctgtgttaagatcagtgaaaatttatactatcatataatttattttaaagtaatactttacaagcctttggcttgaaaatatttcagtaacatctgcacattcaatactgaaaagtaagatggctccattctgctctcattatagtaggctttgagaggtatcttttctttgtatcacagtcattagtccagtggttgatcagcttctttttcaacagaagtggctttttccaaagtcctttgtgattgttgatgtgggatctattctgaaagcaggtttgctgttaaggaaggttataggaacattaccgtttagccatggaccttgatcatctgaatgtggtagctgggtgttatctcagtgcatttgaagctcatgcttatggaatccctgttatgcaaggggttggggaagcccactggaaaaagtggctccagtgtggatgaatccgtccttcagattcctttgtagggttggcttaaagggcaattataaattagtctgtgtcatttctgtccatttcccaaccttttaagagctctcctggccctcgatctgcatgtatctaataccactttctcagcctcagtttcctaatatgtaacacgaaggacttggactagacaagctacaagttctccccaaactctgacacttgataaatctaatgcacttatcagcagagaggaatgtggctattttccaactctttctttagtttggggaaactaattttatataatgttctttccctgtgtttcccttttaaaaggaaaacatgacccatttccggtgttgtaaagtcaacactttgcagctctgcacgaggaagcttctttctatgtagaaggggcacagaatgccacgggaaccagggcaggaaccaacacctgacaagagatgcaggcacatgcggcatgtggggcgggctgtccctcacaggagccagaatcatcagtactagcctcagtcctcccatgcagctggccccactcagaagcataatggtgtggagcagagatccctgagctagcattcctggattagagtgcttactagctgtttacctccagtgagttaattaacctttctgtgcctcaggttcctaatctgtaaaatacgaataataatcacactactgcagagtacagttgcaaggattagataagatcacgtgggcatgtaaagtgcttagaacaacgtgtagcacacacatattaagtgctcggcaaatgttaactatttgtccattgggctcaaatgtccaagtatggatccaggagttgaaaggttggattccacagggccatcctccctcttgtgtccaagactctttgtggtctaggacaacttttgtgagaacaacttgtatctgctctggaatagatgactttcccttttctatagagctactgtccaactagcccagccttagtgtccctgggttcacaagtcagtgataatgaccaaaaatatgaaaaactatctgacgagagggaaagtgtgctcattgagaccccagcaataagcaattgtctgccattgcagaggatttaacagagctcagacgtgaaggctcttgtagttgacaaaggatctttagaaaagaatgttccctgagggtgctccatgtctacagaggcccaaacaagagaaaacagattgtggttagacccagggaagacatttttaccacacacagataaaatgctgggccacattcccaaaacaggttatgtagtgtcttcccctggtaaattgggaaaagagtggctggccatctgtcctagattgtttcatagaccaccagagcaggaagaacccttagaggtcatcatatccaaacctctattttaaggattgagaatgctaatacacagagggaggagataattgccctatagtcatatagcaaattattagcaggaccaggatttaaatcttaggccaacacagcttgccactgcaccttagttatctcttaaggcactcaaagtgctgtcccttctagttctggaatgctccatggtatcaatgtactaaaaaagtaactgaggcccacccagaaggactcgaaggtgttgagcagtatccaaattgcaattcctctagtttacccatccgattttggagctccagctgtcaaagtgtttcagccaagcctcctcattcaactaactggtcttaacttaccatttgaaagcagctgtggttaaagcagagcttgctgactcagcccatgtagtaaggatgactaaacacaagaatttcctgtggaggggggaggagggggatggaaaatatctttcaaatgcatttgtttcagggaacccttctgatcagtcaggaggtagcccaccgtgggcccatgaggaaaagcagcaggctgtccccgctcagcaccaaggcaggatttgcagatgtttcctttcttttttctaaacaacattgtggctgtctcggcaccattttggtctggccagcatttgcacagagcttcatctgccaactgatacagcccaaagccaagcggagcagatgccttccctgactggaggggcctttcacattcctctgctcagagcccaggggtgaattggggctgatctgctttatctcaagacagtttcaattctgagcccaccttgaactcaaaagagaggatcacttatgctgaccgatcagaaaatattgtgggctggcttccatctccaggatgcaccttggggagtttgcaatctggagtaacgttatcattttcaggtctgagtaccacacggccattggacaacttcaggaaacaaacattgaccttcagttgggttgctcaccagcttaaagcagtaatccagtgaacccaaaatttgggtaaatattttaagactgttggctggaaaagagtctgccttgctcaattagaaagtggaagacacctggtgcatttgggggtgacagattttatttacaacttgcaaaatagaaaagggcagcagggaaaaagagagagtgaacatactcagccatattctgaaagccatatacaactcaaacagttcagtcattgaggattcaagtccaagaggcctgcctcaccctcatgctcacaaggagaaaacaggactaactgcctccgaggtctcaaacaagaccgaggattttcttttctttttttttttttttttttttttttttttgagacagagcctgctctgttgcccgggctggagtgcagtggcacgatctcggctcgcggcaacctccacctcccgggttcaagcgattctcctgcctcagcctctcaagtagctgggatcacagttgcgcaccaccacacctggctaatttttgtagttttagtagagatgggatttcaccatgttggccaggctggtcttgaactccagaccttaagtgatccgccagactcagcctcccaaagtgctgggattacaggcatgagccactgcgcctggccaaggatctatttttcataagcaagtaaaaatttcttcatctaatgggggaaatgttctggaacaggcaatgtggagtaatggaaaacaaactggtctggcaagaggagaggggagaaggaaggagggagtgtcccagttcccttgggtgtgaagggtgacccaagaagtgtaagctttgaagtgttatcttacttttctaagcctgtttctgattcagtaaatactttagctacacatagtgcctagtaataatgttttctgaataagtgagagtgagagagaaaaagaaagcaatgaatatatgaatgaatatgtcaagaaagtgaattaatatatgacagaatggtaaggatttgcgtagttcatggagttggtttgaagcttaaatgaaataatggttatgagttctcattttctaacactacgcttaatacattatctgtatactcactatcttatttgaatctttcgaggctcctgtgagataggcagggtaaggactgtcacctgtctgatagagggaattgagtatcggagaggtggagaggcaatagatgatggaactaggggctccgcatgcagtgctccttctaacgtaccacacaacctcttactttcagatgaaaaaggtttttaaagaagaaagttctataggaccaccacataggatctatgacttacaactaagcaccttttatatgagggcttaaacactggaagtgggcttagaagaagaaatatcaggctaggactaacaatgctattgaagattatggtaagaacttgtcaactcaaaatacaagaggccagggggaaatggtgttggaatgacttgggtttggattatctaatatttttgtaaaagaacaatgggacctctagttggcaaggaactaacagttgctatttgaaataacatgggccactataagaaggttgactgtagactcaagtaagtcagccagtatctacttagtttgtcccatcaggtgtctggcctttcatgaagccataagctgtttagcaggaacagacttgtggtctgagtcttctccaggtttacatgggtcttagaacctttgactcatgatactgaatggtgctgtttaataaagtcatatagtctagtccccatccagtaaagctattcctatctgatgagtcactgtccaccctccagtgacaaaacaaatgaacaaacaaacaaacaaaaaacttactgcctactgtacctatagtttccagctttctgttctggacagttatgatggtcgtctgtgccatcatcatttctaattgcatggggcactagggaaatagagatatgttcattgtaagtgtacctcatgcaggcaattagacattgaaaacaaaattttcataaagcaaatccttatttttgtgccctagatcggcttgttatttaaagaaatcattgatctctagtttatcattttctaaaacacagaattaggttttctttttcttttcttttttcttttttttttttttgagatggagtcttgctttgtcacccaggctcaagtgcagtggcgcaatctcagctcactgcaacctccgcctcccaggttcaaacgcttctcctgcctcagcctcccaagtagctgggattacaggcgcatgccaccatgcctggctaatttttgtattttcagtggagatggggtttcaccatgttggccaggctggtcttgaactcctgacctcgtgatctgctcacctcgccctcccaaagtgctgggattacaggcatgagccaccgcgtccagccagaattaggttttcttaatgcaggagttttaaacatggggtctgttgctcttggactagctatgggaagctgggtgaatttttctgaaactatgtgcagaattgtgtttttgcttttacatacttttctgagaggatctacagctttcctcaaattctcaaaagggttaacacccaaaaaggtgaagaaaaactgggtgaaaaaaatggtggaactataattgtgtttgtgagtcctaaagtatgcagcttcaactgcaattttttaagaaggtggctttgtctctgtcaattgcatggtctggttctcttccttctgctgcctctgaaggataggtacccatgggacatagtgccaagctttgactttttctctgtcgtatttgcagggtattaaccatgctaataggagttgaatggcaattgttgtagactaaaataaggtattatttgataacatttctaattccttgtcctcagttgtcaaccccagagtacagcctataaggcagacatctttgttgcatgacttcagctttagaatcagagagctctgtgaccttgggaaagtcacttaatctctctgagcctcagttttcatctggcagatgggaataataacagggttgttgtgaggattataagtgagatgatgaggctgggcatggtggctcacgcctgtaatcacagccctttgggaggctgaggtgggcagatcgctggagcccaggaattcaagaccagcctaggcaacataacgaaaacacgtctctactaaaataaaaataaaaataaaagattagccaggcatggtggtgcacacctgtagtcccagcaactgaggaagctaaggtgggaggattgcttgagcctgggaggttgaggctacagtgagccatgatcgcaccactgcactccatcctgggcaacagagtgagaacctgtctcaaaaaaaaaagtgagatgatgtatataatgtgctggaaacatagtaagtgcttaataaatagcaatgccaatggtacctgtgctgataagcaagttcttaagaagatccaaagctctttcctgaggatatggatagctctgtctgggagctaccttgctgcccggggccatgctcagtggtccatccatgggcatgggaacaaaaacagtcggacctttgtcactttattcaaaacatagggtttggcctgttcaacacttgtactctgctagaaactgttgaggagccctgaaaccatgtttgactattaaacccagaagttctatgtagggaaaagggaggaacaattggtgcagtcacatcagctcaaaagttccagtcggtgctttgacccagcagcaataatagtgtccaaagggccttcccatccctgttctcattttatcctcaaaacagccatatgaggtaagcagagcaggtgctggagaagccacttattgcagcaatgatacaagcaggtccagaagttttaaggactttgtgaaaatgcagtggtttgtaaataagtaaaattcgtgtgttagcaggaaatgtttattgggtattcgtttttgaatattgagtttattgagtataactgaatatagcacagagctgggcacatggaaaggcttatatagtcagattggtgtggcaagaattccatgacaatgcatcaaaaagattatatatcatgaccaagtgggatttatccctgggatgcaaggtgagtttaacatacacacatcagtcaatgtgatacacctcattaacaaaatgaggctaaaaaccacctgatcatcttaatagatgcagacaaagtatttgacaaggttcaacatcctttgttgatacaaactctcaacaaattaagtatagaaggaacttacctcaacacagtaaagaccatttgtgaaaagcctgcagctaacatcataatcaatggggaaaaactggaagcttttcctcctctaagatccagtactaggcaaggatcccaatctcgccacttctattcaacatagtattggaagtactagccagagcaaccacacaccttttttgaaaggcatccaaataagaaaggaagaagtaggccaggcatggtggctcatgcctgtaatcccagcactttgggaggccgaggcaggcagatcacttgagttcaggagttcgagaccagcctggccaacatgacgaaaccctgcctgtactaaaaatacaaaaataagctgggcatggtggcttgtacctgtagtcccagctgcttgggaggctgaggcacgagaatcgcttgaacccgggaggtggaggttgcagtgagccaagaacgtgccagtgcactcctgactgggcaaaagagccagacccagtctccccacccccccaccaaaaaaaaaaagaaagaaagaaaagaaaggaagaagtaaaattatgcctttgtagatgacgtgatggcggctgcctataatcccagctacttgggaggctgaggcaggagaatagcttgaactaaggaggcgaaggctgcagtgagtcgagatcgcaccactgcactccagcctgggtgacagagcgagactctgtctaaaaaaaaaaagtgatattcagatttgatgtaatccctatcaaaattccagcagcatttttcacagaaagagaaaaacaattctaaaatttgtgtggaaccacaaaagaccccagatagctgaagcaatttttttttgttgttttgttttttttgttttgagacggagtcttgctctgtcgcccaggctggagtgcagtggcgcaatctcggctcactgcaagctctgcctcccgggttcacaccattctcctgcctcagcctcctgagtagctgggactacaggcgcccgccaccatgcccagctaattttttgtatttttagtagagatggggtttcgccatgttagccaggatggtctccatctcctgacctcgtgatctgcctgcctcggcctcccaaagtgctgggattacaggcgtgagccactgcgcccagctaaggtgaagcaatcttgagagggaaaaagagagaaagttgggggcactttctgatttcaaattatattacaggcaggtggtccagtggctcatgcctgtaactccagcgctttgggaagccaaggtgggaggatagcttgagtccagaagtttgaaaccagcctcagaaacacagcaagatcctgtctctacaaaataatttttttaattagctgggcatggtggtgcatgcctgtagttctagctaccagggaagctgaggtaggaggattacttgagcccaggagttcaaggttacactgtgctatgattttgccactgctctctagcctgagtgatgagcaagaccctgtctcttaaaaaaaattatattaaaaatctatagtaatcaaaacagtataactctggcattaaaaaaacacatagaccaatagaatagaatagagagcccataaataaacccaagcatacacagtcaactaatttttaacaagggtgccaagaagacaccatggggaaagggcatctcttcaacaaatggtgttgggaaaactggatatccacattcaaaagaatgagattagacttttataccatacatacaaatcaactcaaaattggttaaaggcctacatataagacctgaaaccataaagctagaagaaaacctagcagaaaagcgccttgacattagctttggcaatgatatttcagatatcacaccaaaagctcagattacaaaagcaaaaataaagaagtgagactacatcgagctaaaagcttctgtacagcaaggaaaataatcaacaaaatgaaaaggcagcctacagattgggggaaaatatttgcaaataatatatctaataaggggctaatatccaaaatatgtaaggaacacacacaactcaatggcaaaataaatcaataaataacctgatttaaaaatgggcaaaggatctgaatagacatttatctaaagaaaacatacaaatagccaacaagtatatgaaaaggtgcacaatatcactaatcattaaggagatgcaaatcaaaatcacaatgagatatcccctacatctgttaggttggctattgtcaacaagtcaaaagataacaagtgttggcaaagatgtggagaaaaagggacccacctgtacactgctggtgggaatgtaaatgagtaaagccattgtggaaaacaggatagaggttcctgaaaaaattaaaagtggaattaccatatggcctatcaattccccttctggatatatacccaaaggaaatgaaatcaacaccttgtagagatatctgtcctcccatgttcattgcagcattaatcacaatagccaagattcagaaacaatttgtgtccatggatggatgcatggataaagaaattgtggtggccgggcacagtggtacacgcctgtaatcccaatgctttgggaggccgaggcaggaggatagtttgaagccaggagttcgagaccagcctgtgcaatatagtgacaccctatctttacaaaagtaaaaaaaaagaaaaagaaaaaaaattagctgggcatgataatgcacatctgtagtgccagctactcaggaggtggaggtaggaggatagcttgagcccaagagtttgaagctacaatgagctatgatggcaccactgcactccagcctgggcaacaaagtgagactctatctctatataaaaaatgaaattgtggtatgtatgtatattgtgtgtgtgtgtgtgtgtgtatcatatatacagaatactattcagcctagaagagagggtgatcctgccatttgtgacaacatggctgaacctggaagacattaggctaagtgaaataaaccaggcacagaaagaaaatactgaatgatctcacttatatgtagaatttttaaaaagagctgatgatgtacagcataaggactatagttaatgacattatatgtaatttcctaagagagtggagtttagatgctcttaccacacaaaaaagtacttatgtgaagtgatggatatattaatttgcttgattgtattattttactgtatatatatatacacatcatgttatacacctcaaatatatatgcaataaacattttaaaagaatatgtgaaagtaaaatcataagaaagtataactagacactgggtggtctggtacagctaagagctgtgagactgtagcaaagggaagatgtaggtcggttgcaggatccagggaaggcttcctggaggaggtgggccctgggctgctagggaggtggagggaagcagtgtggcaggcagataagcaggagcatagaggctgggatgagcaggctgggggaatggaggggctcacacagtggtcagccggggggtcgctttgggaaatagtggtaattttgattaaagaggttatggaaggcattgattgctcaaacaagggaaggggactggacttgatttcgtaggcggtgaggggctgtgaggtatggcaacagagcggcaagaaaaggcagtggagttgggagagtccagctgggagccaggagtaagaatctagccatcaatgatcagagtctgggctaggacgaagccatagaaacagagaaaggggaaggatgaaagcgctcactggtctctagagcctttgcttggagtaacacaaagacctttctctctgtaaggagcaagtccatttttggtctttatatttctacagcatgagaaatgcctctttcatccaggagcacgtgccctgcttgaagaaaaccaggcaagacagcttgcaaaggagagagcctgggagatgacttttcatgttgcacaatggttcttcaccaaaggagtcacagagggtcttttgacatagacactgccctaacttatgtgcaagttactgccctgcatcctagggaggctttggggtgtgggatgacaaagtacctccacagtccccttcctccgcctctgcccatagttctacttgatgtaacaggtcttgtgagtcttttcaggtgggaaaatgctctctcagccttcacaggtcagtcatgaacctgatcccacatggacacaattctgttgacattttagcatgaaaggtacaaaagggaaatctgcaaaggggtctcaggattcagttccctggatcgtcctgtgcatttctttctcagatttgaggtttttccttttattttggagatggggcctcactatgttgttcaggctgatctggaactcccaggctcaagtgatcctcccaactcagcctcccgagttgctggggttaccagtgttagccacccaacccatctcagatttgagcatttctttcagaaatatgagtgaggtggtttcatgtggagacccctctgaggctctgaagcatcatttctacctgctatgtgtgcctgagaaacccatgcctggcccaatccccatataccctcaagtacaaatgggataataggaccccctgggggtccatgcacttgaccaaggttgctcttagaggctggattcagcacagattcagctactccggctcaggggcagggcaaagcaaaggtaccaatacattcatctggctggaaaaggaggattttgtttttacgaactttaaaggaatataaaaatgactttgttgtgattgaattgccttgctggatgaagtgccctgtggctccagggcttagagaggcttgtatggagactgtgtatttccttatgtatgtttctatatagatatatttccttatatacaaacatctgcacaattgtgtttgggagccccaggctaaaactaagaccctgacatgtttgaaactttgctggatagaaactaggggtggagaaatcctgtttaattgctgcaagtagtttttagcttataagagatgaaacatttgatattcatttaggacaaactcttcctgttttaatgatagcatctcctatgtattgagagcttcctatgtgtccggcactgtgctaaacgctttacatacataatctcatttaatcttcacagtgtccttaaaagtgaggtactattgttgtcctccattttacagagaaggaaagtgatgggaagagaggttgagggacttgattaaggcaaggtggctaataggtggaaagctggggtttgaactgtagtcttaatgactgtgcaaaacatccttgtgagaactacttaagtttcttctccctgcaaatttaaagcaaatactttctaatgaaatcaggtgtggtacaagaagcaaaaatggctttgcaaggaggaagatatacaaagtcatctaccagggaggcagagtagcatttctgcaaactagtttgctattggagcaattacatctcggctgaagagagaacaagtacggtgaggtgatggagtggagtttgactttgagtcccttgagtgcaagaaggccaagagccagaggctgacaggcctgagaaaccatagcacccatggagctgcttctaagcccaggggttcaagtgtgacctagagttgggcagagcagacaaccagctcgttgcactaaacctacacctgccttgtgtctcgtgcctttttatcatggtagtttttaactcgttatttctggcacactggaaagttttcatttttgggttgtccactgtgcatctaactaccgcattgaactcttattcattcttttgcgaaattttaattcagttacacctcttgggtttctagatatgcaagcatatcattgcaaatatatatgcatatatatatacatatgtatatatgcatatatatacatatgtgtatatgcatatatacatatgtatatgtatgtgtgtgtgtgtatatatatatctatatatataatctatatatctatatccactttacagataaagaaactaaggcactcagagaggtttagaaattactctaggtcagacagctaataagtgatagtgcacagatttaaaaataggcctaccttcagatcctgagctgtaaagtactatacaatatctctcatacataaattacatttttataaaaatgagatgacactgtatacattctttgtaatgtcctttcacttaataactttcttatatgcctagatgtattcaataacataattttaaggatgtataaaatacctttatcataaaagtataggccaagcgtggtggctgatgcctgtaatcccagcactttgggaggtcaaggtgggcaaatcacttgagcccaggagttcgagaccaccctgggcaacatggcaaaaccccatctctacaaaaaaacacaaaaattagccagccatggtggtgcatacctataatcctataagctactcagaaggctgaggtaggaggatgcacacctataagcctataagctactcagaaggctggggtaggaggaacacttgagccttggaggtggaggtttgcatgagccttgatcataccactgcactctagccggggcaacagagtgagaccctgcctcaacaaaagtaaaataattaacatttattgagtgcttaagatggatgagacatcttaacatggattatttcaaataaatttgtttacatgaggcaggattactggttgttgtagtcatatcagttcagaaactccagcttgtcactctcctacttgctggcaccccagcctgtcaccctcgaccagctttggagctgtgggatctgcatggattgttatgctatccaatgcaaaatgcccttgttttattcatatgggtaaggagcaagcagcaagtatctggactgagcacagggcatggcaaaggcagccagagtgaccctccacgttgacaaggattcctgggaggatttaacattactagtctaaattagggaccaaggaaaactgttctcatctagtttcctggaagctttgcaatgatactggaaccctaggaaaaccatggccgagaagagattttaggaggtacaggagccaaaggtgaagagacaccattggtgggttgagggggaccaggtatagtgaaagcatcaacactaacatcttgcccacaaataagatcccttccagccaggtgcggtggctcacgcctgtaatcccagcactttgggaggccaaggcaggtagatcatgaggtcaggagttcaagaccagcctggccaacatggtgaaaccccgtctctactaaaaatataaaaattatccgggtgtggtggcgcacgcctgtaatcccagctactcaggaggctgaggcatgaggatcgcttgaacctgggaggcagaggttgcagtgagctgagattgcgccattgcactccagcctgggtgacagagcgagactgtctcaaaaaaaaaaaaaatttcttccactgatgcacaatgtctatttaatgctgctatgcttatactatgaactgaactttgtctcctcaaaattcacatactgaaactctaacccgaaatgtgatggcatttggaggtggggcttcagggaggtacttagatttagatgaggtcatgaaggtgggttccccgtgttgggatttgtgccctttatagaagaggaaaagaccagagcttggaactccctcactttctcttcacccagatgcaccaaggaaaggccacgtgaggcaggaagagggccttcaccaggaactgaattggacaacaccttgatcttggactttccagcttccaaaactgggagaaatcaatgtctgttgtatatatttttgctatggtggcctgagcagactaagacactggccatttacttcaactgattgcctacattttgaaagtgttagagaagaatggtttatgcttctcagatggctctcagaattacgttagaaaatatattttattcattctttaagaaaaatccgcaaacaattaccgagtacctgctatgtgccaggcactcttctaagcagtgaccaaggcagacatgatccctgccttcgtgtagcttacaatctaatggaaaaggcagatattgaacaaataatcttataaatagtgatgttatttccagttgttatgtggtgctaatgaagaagtgaaggagctatgaacagatataagaggggcccatgacctgaagagggaggatgagatggcttccctgtatgtgtgcatgcgctttccagggcatggtgggagatgacaatgacattactagcagaaagaatggcaccacaggccaggtgtggtggctcatgcctataatcctaacactttgagaggctgaggaaggaggatcatttgagcccaggaggtcaaggctacagtgagccatgattgcaccactgcactccagcctgggtgggagagtgagaccactgtctctaaaaaaagaaaaagaggccgggcacggtggctcactcctgtaatcccagcattttaagaggccgaggtgggtgaatcatgaggtcaggaggtacagaccatcctgaccaacatggtgaaaccccgtctctactaaaatataaaaaattagccggacatggtggcgggtgcctgtagtcccagctactcgggaggctgaggcaggggaatcacttgaacctgggaggcggagattgcagtgagcggagatggcgccactgcactccagcctggcgacagagcaagactccatctcaaaaaaaaaaaaaaagaaaaaagaaaaaaagaaaaagaagagtgatacaatttgatggaataaagcacatttacagtgttctccaaccaccaccactatttccagaacattttcatcatcccaaaggaaatcctatgcccctttaagtactcactccctgttgttccctcctccttgccctacataaccactgatctattttctgtatctgtggatgtgaacattctggatatttcatgtaactgggatcatatagcagtctttttgtgtctggctgctttcacttagcataatgttctcaaggtttatccaaattgtagcatgtatcagcacttcattcctttttatggctgaataatattccattgtactgatagactacattttgcttgtccgttcatcagctgatgaacatttggattgtttcaacctcttggctattatcaatagtgctgctaaacatttgggatacaagtttttgtttgaacacctatttccaattctattggatatgtatctaggaatagacttgctgggtcatatggtaattctgtgtttaacttactgaggaacaagaaaatagcactacttttattgttgtaaagaaaaactcaacaaccaaaacataatcatatggagatatatatttgtatttttcttttgcagcttgaaggaatacacatttgttgtctccatttttatggttcagtccaggcacagcttagctgggtcctctgctcagtgtgtcatgagcctgcagtccaggtgttgtctaggatgcattctcatctggagatctggagcttggggtccgcatccaaggttgttcaggttgttgacagaattgagttccttgctgctctagtgccgaggctctcacctcccggaggctgcccctctctccacaaccttgtttgcttcttcatgtccagcaggaaatgctgtctctcttcagggagggctaatagctttcacttgattacatcagccccacccaagataatgttttttatgttttgttacagtccagaggccttttttttttttttacatatatacctattatgccatgaattcatgcggagtaggttccagcagctccggctccttcccactggttcttgcacagtgtgcttctctgggtggagcgggctggtgcttcagttgaacccaggtacctttctctttggcttcctttttctctgaacagtttccttcatgcaattcaggatgctattttttggctcttaataaagtgcttaatatgctcaatatgcacattaattctcttggcaagaatcttaaccttgtgtttttaaaataatgccaacagcacactgggtaacaatgtaggctcttccagttttgccatgaaaacatttgtggggtattcctttctgaacagtgcccattcccttgatgtctacaatatcacctttcttgtagattcacaggtatgtggccaaaggaatgaacccacgttctctaaaaggcctagagaacacgtattgggtgcctcttctctttccctttgtgttcattattttggcaaaatactagaagatggtggttctggccaaaagtgatcatctgtcttttttattaactcaaaatcagctgatatgtgactttaattacatcttgaagctatattttaaaatattttgtacagatgtagagggtacaagtgcagacttcctacatgcatatattgtaccatggtggagtttgggcttttgatgtactcatcactcgaatagtgaacattgtacacaataggcaattttctgcaaaacacatgatttcattcttttttatggctgggtagtgttccatgatgtatagctaccatattttctttatccaatccaccactgatggacgcttaggttggttccattatctttgctattgtgaatagtgcagtgataaacatgagtgcaagtatctttgtcatataatgatttatttccctgtaggtagatacccagtagtgggactcctggatcgaatgatatttctaattttagttctttgagaatggatcaaatgacatttctattttttgttctttcagaactatccctactgttttccttaagttgtgctaatttacattctaaccaacagtacataagcattcccttttctccacatcctcaccaacatctatttttctttttaattatagccattctgactggtgtaagatggtatctcattgtggttttaatttgtgtttctctgattagtgatgttgagtgtttttttcacatgtttattggccacttgtatgtttaaagctatatttttaagcattatgataagcaatctagccagattagtgacaaaatgaaccctactctcaaggaggagaatccaagtgagtaattcagcacacgcacatcactacagttagaaaaactacacaaatacaacttttttttttttttgagatggagtctcactctgtcacccgggctggagtgcagtggtgcgattttggctcactgcagcctccgcctcccaggatcaagcgattctcctgcctcagcctcctgagtagctgggactacaggtgcatgccaccacacccagctaatttttttgtatctctagtagagacagggtttcaccatattggccaggatggtcttgatctcttgacctcgtgatccacccgcctcggcttcccaaagtgctgggattacaagcgtgagccaccatgcccggccacaaataccactttctattggccaacccaggaagaaacatgaacttccttcctcaagtttgaggctggagtctttgtcttagccttcagtcactagagtaagactggtgttctcctcatccaaccatgaacacattgaggacaagggcacatctgagtcatctctgtcatcccagtgcatggcacagtcaacatttgttggtggaaggaaggcaggaatgccacccatcccccccggggagatggtcttgggcacagtctctctttgcattgctcctgcagggtactgagccacctctaccctcacagcaacctcctctccatcatccatcacttcaggtcactcaatgatgagcaagccagctgatagcactttttagctacacaaatggataaatcacagaaaccaacatttgtcagactcagctatcctgattcttcttgtgaacaaaatgatcattaattcctttagacgagtcccccagtctccagccatttgtctcctttccccatgggcaaataaaaatgggaatcttattagtggtctctagtcatctcatagcattgcggggagagctgaagctggatgaatggacatccctgagcttgtggagttctcaccaagtgggcagtgactgggtatgatcccctttggagcctgtcactgctgttgacattgaaaataccggtgtggaaacaaatgctgtctttgtcacaggctcaactacaggggcctctccttccctaagctggcagctgagactaagtacttgagatccctgggccagctgttgtgaagtaaacgccaggcagtaggtaaggcaagattcagaactgggcagaaagccaggctggagagggagcactgataggaggggagcacaaaagttggcaaacaaatgctttccaagtaggttttaaaaaacacaatctggcctctaaagtagacaaagcaccaatggggggtgcaggggtgggggtgctgcctgaaaatgcctgctctgactatcagctcaagaagattctagaactggaaaggcactgtgagcaatgtttcccgaggaggcttcccttggagcacagaaagatagccacaccctttgaagttagctgggagcttacaaagggcagtgttgtttccactaaggaagaatgatagccctgcataatggtgtccttattctgtaaaccccagaccttgtgcgatgaggggcaagtgagcctgcaggccccagcaaagggggaggaaatggttggcaaaacacatacttttagcttgcttactggtcaacatggaaggtcttccctaggaagatggtgtggtcaaagtcaggggtctgtttcaactctcttccaaggatgattgctaaatcatatcaagatacctttttaatttgatgatggctgatgtaagtttccaaatgcttgcatcttctgtcatgtttgatgtatttcagtgaatcatgccacaagctgagaggccctagagatgaaaggctgatgagaaaaaacggatgagcccattgttttacatcagaatgtgaatggtgatatttctgagtagtgggattcctgtcacacaaaaggggaagtcagtaggctggcagtagctgccaagggcagcttattggacaattattagggaatggaatcctaaaattggaattttaacatagccttgatcaactttggaatgcctatggtattgcatcatacatgcttatgtcagggaccacttccaaaattctgactcatctcccaggccaatgaaaccatttcagcatgtgaattacacccctggtgttgtccaagggaatttttgtcagccctggtgcccaggactgattccattaggcctaggagaagctgtgtggtgcaacagaaagagccatgaggagccctgagctctagtcctagctctgttgccaattaactgtcattccaagtgaatcttttagtgaatctgtgtcttggtttcttcagcagttgaaaagagacagttgaatttgatgagttagtctcttacggctttaaaaataaaaatgcatgtttcatagcttggcatttaacaaagaattgtggatatgtaagtaatctaattttataattttctttaggtatgaaagggaccttaaacatcgtatagtccaacccctttatcatacagatgtagaaaccaaggtccagaaaggggaagggatttgatcaattagtgcagaattagggttagagatcaggtttctggattcccagtccagtgcattttccactacatttatttttaaatcaagtaatacatgagcatggtttaaaaatatcaaataggcagctgggtgcggttgctcacacctgtaatcccagcactttgggaggctgaggcgggtggatcacgaggtcaggggatcgagaccatcctggctaacacggtgaaaccccatctctactaaaaatacaaaatacccaggcgtggtggcgggcacctgtagtcccagctactcgggaggctgaggcaggagaatggcgtgaacctgggaggtggagcttgcagtgagtggagatcatgccactgcactccagcctgggtgacagagcaagactctgtctcaaaaaagaaaaaaaaaaaaaaaaaaaaaaaaaaaaaaaaaaatatatatatatatatatatatatatatatatatatatatatataaaatacagagagctgataataaaaaacaacagttctctgccccactcctccccatccccagtcccactcctcagaggcaaccattttttaacagattctgttggcaattcatctgatagttacttctgaatctctaaatattactctgttcccattcttgatttatccattttggacattatctattaactcctgttataaaaatggaagatttagctcacttaacattactcccaactgcctctctttcttctgcctccccatggttgatagcaatattttatgagatttttaaaaattcactttttaaaatagcatgctattttaaaaatttacttttttggtgtacagctctatgagtttaggcaaatacataaagtcatgtaactgccaccacaatcatgatatagaacagttccattaccccccaaatcccctcatgctgccctttgtaattggcttctccctttaccccctacactgatctgttttgttgctacaattttgtcttttccagaatgcccagaaattgaatcatatactatataaccctttgatactgacttctttcactcagtataactattttgagattcatgtatgtgttgttcattcttttgtattgctgaatagtactccactgcatggatgtaccacagcttatccattcaccagttgcagaccatttcagttgtttccagtttgatagcattatttttagttattctattggttactttttaactgaaaatcatatactgaaacctctacttcttgcaccatcatccactatatagtaagtaggtcttctttttcagaatagtaaatgctttggactgattgaaaaacataatactttcatttctttagtcacagttttagacggatttaatttgagggtgtgatttttcatggggttgggaaggtttgctcaaatgctgtccagcagccctattcaaggctacagccattctaaatgcctcctgtcacatagggggccttctctagtaccagatatgcttgttgctgggaagatacgcatgtactttctgttctgaccgttgctaactcaggcagtagtttttgggaaaaagacctttcttcatgtggatttcagcttttgtctgtcatgctttttctgttccagctgccttcaccagtgagcacaaagccacatttcaaaggaaactgacaaattatccccagctgccagaagaaggttagttttctgtgtgttcagtgtcccccttctctgataaccaacaggttaactttctaaagggaactgacaaaagcagaaattgtccttttacccaaatgagttgtgattgttgatttttttaaagatgtggatttgtaatattcctctccattcctactctaatttataccaggaaatagagtgtaagtgatcacaatggaacctctattgtttgcaagattcatattaatgcattctggttttttaagtgcttacaagatctaaattaatttttaaattagctagcatagtgtctttactcaatgagtagccatttaaaggctgaatgatgtcagccctggccatagagatttatgtgttgttatatttcatttgcatttttaaccatctttgtacatgtgttatgcctctagcacttatgctgtataacaggagagagtctaatgcctagcacagtacactacatatagtaggtgctcactaaatgccatttgaattgaaatgatccaaaagagtgtcatgtatatatgatggtaaaatattctgtgttaatgcagtgagtcaggcattctcaaacactaataggaatgcaaattggtacaactctcccacagggcaacttggcaaaatgctcgaaagccttaacaatgttcttatcctttcacccagtaattctccttctaaggatttatcctaaaaggaaatagagatgcacaaaaaaatacaaatacatggaaattcattgtggcaatatttaaaatagagaaaaagtggaaaaaacttaagttgtccatactatgaaatcctatgcagtaacatttatactatgaaatgcaatgtaattatttaaaatcatgtttagaagaatatttaatgacatgagtaaatgctcatggtctaacttaagtgggggaaaggaggatacacaaacatacagtgaaatcccaagtgtgtttgtgtgtgtgtgtgtgtgtgtgtgtgtgtgtgaagaaaaaaaatgactagaaagaaataatagaaatattaacaatgattagccagccatggtggcacatgcctgtggtcctacctactcagcaggctgagatgtgaggatcctttgaagtttgaggctgcagtgagctgtgattgcaccaccgtgctccagcctgggtgaccatgtccctaaacaacaaaccacaaagctataattatccctacgttgtgggattatgagtcattttcattttcttatttttgtaatgagcttatcttactttaaaatccaaatttttttaatttgaaagaagtaactactacttatgctagagggctgacattcataaaatcctagtaatgagatgtagaaccatttctccaactagtgtcaaatcttcatccttaaaaaaaaaaaaaatgagatcgggtctcactctgttgcccatgctagagtgcggtgggctgatcatagctcactgtagcctcaaactcttgaactcagtgtcaactcttcagatgacatgtggatggttacggcagtggtcagtttttagaaaaattaaataaagcccagaagccatttcagatttaaatgctctgaggggtggggtacagtggctcatgcctgtaatcccaccactttgggaggccaaggtgggtggctcacttaagcctaggtgttcaagaccagcctgggcaacgtggcaaaacctcattatacaaaaaatttaaaaaattagccaggtctggtgacatgcacatgtagtcccagctactctggaggctgaggtgggaggattgcttgaggtcagaagttccagaccagcctgggcaacataggaagaccccatttcaacaaagaaaaaaatgtgaaaaataagtcagacatggtggtatatgcctgtagtccgagctactcaggaggctgaggcaggaagatcgcttgagcccaggagttcaaggctgcagtgagctgtgatcatgccactgcactccagcctattattatttcaataataataataataataatgctctgagccttagtttgatattgaaaggaaaatatgtttatccttttctctaggcctagttaattttcatccttttctctccatccccacccctttttaaactttccagatctgtggaacaaatgttgagcaaactggaaataaataaaatccaatggctttaagataccacaaatccctcccttcctgtgtactaatggctacctgcccattctactccccagagtgaagggctagagtcagccaaaatggaggcttttctgattcaaacatgaaaaatgcaaatgctcaaaagatagaaaaacttaggaagtctgaaaagattgagacataacatgtacaactctccctcccctagattcttagcttcacgtgatataaactgttgggctctgctgggggaaaaacccaatcatagaaggcagatatattagtctgttctcatgctgctctgcagaaatacccaagcctgggtaatttataaaggaaaaaggtttaattgactcacagttccacatggctggggaggcctcaggaaacttacactcatggcggaaggggaagcaaacatgtctttcttcatgtggtggcaggagagagaagtgctgagtaaaagagagaaaagcctcttataaaaccatcagatcctgtaagaactcactcactatcacgagaacagcatgagtgtaggcacccccatgattcaattacctcccaccaggtccctcccacgacacttggagattatgagaactacaattcaacatgagatttcggtggtgacacagccaaaccatatcagcagatgtattaaggacagttcatatttcaaagaaatcacacaatcctagacctttagatctggaaggaaaatattccagcaagtatagggctccttccaaataccagatactatgctaatccaaatgttatctcataaaaaaccacctaccatcgcacctcattttatacatgaggaaactaaagcccagagaggggttattaactatcttagctcacatcatttgttggctgctaagttgtgatagttcccatatcttctggaaactctcaagtgaaaagatgggtttttctagtataatctttccttcagctccaaatattccaaatacttactgtgtacttgtgcttggatgttttgctaacagctcaagctaatcaggtacaaagtcaaactcatggtgtttccctcatctccctgtcacccaggatctgaaccaaagtctgttttgctttttactgaatttcatcccccacaaacagtctgttaacaagtcctgtcaattttttccttcaaaaactaccgccaggtcctaacatattgtcaaggaaactcaacctctacctccttaaaaaaacaacccttctcgaccacttcagccatactgctgcctctcttctggcttcatacagcacttttaatctgcatcacacagtttagtttagcacttgtcattcaggggcaattagcatgtgctcagcagcattcactcatgcaacaagcatgtattgagtgtctactatattctacaccctgaaatggagaattcacttttcttgttttcccatatagacatcaaataccctgagagtcgaggccacatctttcttcatagtttcttaaacacccagtgcagttctgggcacatactgaagatctgttagttaaagagcagtacagactcaaggaatctgtcaccagttcagcagctgacgagctcagctcaggggacactttagtctatagttctgcttcaacatctcacaagctacacgagtatgatccactcattcaacaaagacaacgtattaaaatgtgagtttttaacaccataccttcagagataagtaatgagatctaataactaatcagagacgtgggatcctaaaagtcaacttctgcttttagaaagatggagtagatgtacttttccctattcctttcactaagtacaactataaaccctagttattatatatacaacaaacataagacaaccaagaaaggtggagagaagatagactgactaaggaccttgagactcaaagagtgacatgagttcgtgagttccctgagctttctttttgcctcaaatatcccagactggctgctagagaagctagcaattcagaaacaccagtgggaacagatttttctaaagtcccaacaaaagcctactctctctagccaaaggaccagaaaaggggcatcctagaaagacagaaaacttttagaccattactgctctactatagccaaacaccacaggaaaaactgcaaccctcacctccaactgtccatgcaaaggctgagtggtgagcctgaacttctaccccaatttggcagtaacaaggcaacccttccagttttttctactagagcaatgtcagaaaaaaaccactaaaacctaaggtttaaataagatccagagtctcatgacataatatccaaaatgaacagtattcagttgaaaatcattcatcataccaagaaccaggaagatttcaaactgagtgaaaaagacagtcaattcatgccaatactaagatgatgagatagaattatctgacaaagattttgaaacagctatcataaaaatgcttcaatgagcaattacaaacatgcttggaacaaataaaaacggaaagtctcagtaagcaaataagaatacataaagaaccaaatgtagactttagaactgaaaaacacaataaccaaaatgaaaatctcagtgaatagggtgaacaacagaatggaggggacaaaggaaaaaaatcggtgaacttgagtatataacaacagaaattatgcagagagcaaatagactggaaaaaaataacagtctcagggacctgtagaattattacaaaagatataacattcatgtcattggagtcctgggatgagaggaggagactaggactgaaaagtatttcaaggaataatggctgaaaattttccaaatttggcaaaagacatacagattcaaaaagcttagagaatctcaaacatgctaaacccaaagaaatccacactaagacatatcatagtcaaacttctgaaaactaaagacaaagaaaacaatcttgaaagcagacagaggaaaaacaatgatttggccaagcagagtggctcgtgcctataatcccagcagttttgggggccaaggcgggtggattgcttgagcccaggagtttgagaccagcctggacaacatggtgaaaccccatctctgcaaaaagtacaaaaattagccaggtgtggtggtgcacacctgtagtcccagctactcgagaggctcaagtaggaggatcactgagcccagggaggtagaggctgcagtgagccatgatcatgccacactgaacttcagcctgagtcacagagtgaggctctgtctcaaaaaagaaaagaaaaacaataatttgacagagaaactgataaacaattatttaaatggcagttgatttctcatcagaaaccatgtgaccagaaggaattggcacatttttcaaatgctgaaagaaaagaactaaatcctatatcccacaaaaatatccttcaggaatgaagtgggaatcaagacattctcagatgaaggaaaattaagagaacctgtctccatcagagctactctaaaataatagctaaaggaagttatctaaacagaacagcaatgataaaataaatcttggaacatcaagaagcaagaaataatacaataagcaaaaatatgatgaacacaatagactttccttcctctttgagtcttcaaaattttgtttgatggttgaagcaaaaataataatactgtctgatatagttctaattgcatgtagaggaaatatttaagttggttatatcataaactagggagataaagagacattaacagaagtaaggtttttatacttcactcatactggcaaaataacattaccagcagactgtgataagttatgtatatacaatgtaatacctagagccactcagaatctatacaaagatatacactcaaaaccactacagataaatcaaaatgttacaatattccccaaaatattcaaatactcataggaaggcaggaaaaagaaaacaaaattaaaaataaaatggcagacttagatcctaacatatcaccaattacatttaatgtatataaggtctaaatacaccaattagaagacagagactggcagagtggataagaaaaaatgacccgacagtatgtactctacaagaaactcaccttaaatataatgatataagacaactgaaagtaaaaggaaggaaacatatttatcatacaagcattagtcaaaacaaagcatgagtgtctatattaatatcagatagacttcagagaaagaaattatcagatatatatatatatatacacacattatatatatattatatatataaatggctcaacccaccaaaaagatgtagccatcctaaatgttcatgcaccaaacaacagagctgtttgtgaagcaaaatatgtgaagcaaaaactgatagaactgaaagaagaaaatccacaaagccacaatagttggaaatttcaacactcctctcttacaattgatagaacaactagacagaaaattagcaaagatatagaactcaacaataccaacaataacaggatctaatcaacatgtatagaatactccatccaacacaagcagaatacacattctgtagaacatagaacaagatagaccatattctgagccataaaagaaaccacaacaaatttagaagaattgcaattgtacatagtgtgttctctgacaataatggaatcaaattagaaattaataacagacagataacaggaaaacatccaaacacttggaaaataaacaacattcttctaaataatctataggtcaaagaggaagtctcaggagaaatgtttaaaatacattgaactggattgaaaataaaactataatatttcaaaatttgtgggacacagtaaaagccacgttgaaagggaaatttgtatcactaaattatacattagaaaagaggaaaggtctcaagtcagtaatctaagcttccacctcaagaacctagaaaaagaacaaataaacataaggcaagcagaaggaaggaaataataaagataagagttgaaattgaaaaaaaggaaaacaatagagaaaattaatgaaacaaaaacctgttcctttgcaaaaaataaaaaatttaatgaaattgacagacctctagcaagactgatcaaaaaaagagagagagagagaagaaacaaattaccagcatcagaaacagaacaggggatactactacaaaccctgcagacatcaaaaggttaacaactttatacacacaaatataacaatgaaccaattccttgaaaaacacaaactaccacaattcacccaatataaatacaggtagtagctccataactattaaggaaattaaattcataatttaaaaactccccaaacagagatctctaggctcagatggtttcactggagaataaacatttaaagaaaaagtaatgccaattgtacataatgtcttccagaaaatagaagtagaggaaatatttcccaattcattttattaagctcatattaccctgatactaaaatcaggcaaaaacagtaaaagaaaactgcagaccaatatcactcatgaatgtaaatgcaaaaattaataacaaaatattagcaaacagacttcagcaatatgaaggaattatacaccatgaccaagagaggtttattccgtgtatgcaagtctggttcaatatttaaaaatcaatcagtgtgaaccaccatattaacagctaaagaagaaaaatcacatgattatatcatttgatgccaaaaaaatgacaaaattcagcatccattcatgataaaatctctcagcaaacagggaatagagaggaatttcctcaacttgataaacagcatctgcaaaaaaacccctacaactaacattttacttaatggtgaaaaactgattgttttcacccttagatcaggaaaaaggcaaggatgtgcactttcactactcttattcatcatagtgctggacattctagctagtacagaaagtccagaaaaggaaataaaaggcatacagattagaaaggaagaaagaacattttcttattttcagatgacatgatggtctgtatagagaatagcaagaaaactattttttttaaactcctaaaacaaataaatgagttcagcaaggtcaggagatacatgcataaacaaaagataagcatacaattgtatttctatatattaataatgaatacataaacaccaaagttaaaaatacaacaccatttataattgctcaaaaaagacttaggtgtatatctaacaaaacatgaataagacttgtatgttgaaaactacaaaatgctgaggaaagaaatcaaatatctaactcaatggagaagcataccatgtactttaaatgctttaaatccattttaaagattaagcataaaggtgtcaattatttccaaattgatatacatgtttgacataattcccatcaaaacagcaacaagatttttgtacaattttatgtcaaatttatacagaaaagtcaaaggaacacaaatagctaaagcaagtttgaaaaagaagaataaagtgggaggaatcagttgaccctatcatatatctacagtaatcaagactgtgtggtattggtagaaggacagacacataaatcaacagaacagaacagaacccagaaatagtcccatataaatatggccaactgactttttaaaagatacacacacaattcaatggaggaaagatagccttttaaacaaatgatgatggagaaattgcacatccatggcagagaaaaaagaaccttgtagtagtcacggttctccagagaaacagaaccaataggatgtgtgtgtgttggggggcctgtttagagagagaaaaagagacacagcgctgggcgcggtggctcacgcctgtaatcccagcattttgggaggctgaggcgggcggatcacaaggtcaggagatcgagaccatcctggctaacacagtgaaacccccgtctctactaaaaaatacaaaaaattagccgggcgtggtggcgggcacctgtagtcccagctactctggaggctgagacaggagaatggcatgaacctgggaggtgtggagcttgcagtgagccgagatcgcgtcactgcactccagcctgggcgacagagcgagactctgtctcaaaaaaaaaaaaaaaaaaaaagagacacagagagagagattgattgattgattgattgattaaggaattggctcatggaactgtggatgttggcaagtccaaaatttgcagggcaggccagcaggctggagactcagggaagagttaatgttgcaacttgagttcaaaggcagtcagctgacagaattccctcttcctcaggggaggtcagtcttttccttaaggccttcaactgattggataaggcccacccccattatggaaggtaatctactttactcaaagtctactgatttacatgttaatctcctctaaaaaacaaaataccctcacagcaacattcagaggtgtttcaccaaatatctgggtactgtggcctagccaagttgacacataaaattaaccatcacaaagctcagtctaagactcatactttatacaaaaagtatctgaaaatggatgatggagttaaacataaaaactattttaaaatgtttaaataaacagtagaaaatgtttgggatctagagcttaggcaaaaaggtcttagacttgatcaaaagcacaatccatgaaaggaaaaatcaataaattggacctgaccaaaatataaaacatttgctctgtgaaagaagatgaaaagacaagttatataacataatgggagaaaatattttcaaaccacacatctgacaactgacacatatctagaatacgttaagaactttaaaaaactcaacagtaaaacaaaatccaattagaaaatgggcaaaggacataaagatacatttaaccaaagaggaaacatggattgtaaagacatgacaagatgttcaccatcattaatcattagggaaatgcaaattaatacttcaatgagatgtcactacatacctattagaacagctgaaataaaaaaacagtgacaataccaaatgttggtgagaatgtagagaaactggatctctcagacattgctagtgggaatgtgaaatgctacagccactctggaaaactctttggcagtttcatataaaactaaacatgcaattaccataggacccagcaatcacactcctgggcatttatcccagagaaatgaaaacttatgtccacacaaattctcatacatgaatgtttataacagcgttatttgttaacagcaaaaaactagcaacaaccaaaatgtccttcaataagtgagtagttaaacaaaccgtgctacaataaaaaagaatggacaataacttggatggaccttaagggtattaccttgagtgccaaaattgtttgcacaaagatctccactcctcactcctctgccattgcaaacatgctagcttcgattcattgggattcaaaagacaaattggcaaaagaagcacccaggtgatttcaattttgtagcagtgtatgagaagtggcaatctctgaggcaatgtttcttaaatattattatcccatacctgcaagacacacatattcacacatgtgtatgtgtacacacacacacacacatttccaagatgacagattttcatgcaatgagatttttgcctgtattgattcattttcaaagatgaaagatagagacctacctgagctgtgctcgaatgaggggaaagggtgatggttggtagtggcataaggaaaatagcagggaagaaaggaagataacacagagttgcatgaagaggattgtgctgacctgggctccagctctgtagtgctggtcttggccattctctcgacatgtgctgtcttccccatctgcagccccaactctgtatctgacaactgatgttaaaatgtctcttctggccaggtgtggtggctcatgcctgtaatcccagcactgtgaaaagctaaggggtggggtggggggggagggtggatcacttgaggtcaggagttcgagaccagcctggccaacatggtgaaacccggtctctactaaaaatacaaaaaattagctgggcgtcctggcttgagcctgtagtcccagctacccaggaggctggtgggaaaatcgcttcaacctgggaggcagaggttgctgtgagccaagatcacactccagcctgggtgacagagtgggactctgtctcaaaaaaacaaaaaagtctcttcttcagggaggccttgccagatcccgagaataggttagatccctctgttatgcattctttattataacacttgcatataacccttgtatcatttatcgcaaatgtaattacacatttttgagatcaactatctaatactaagtaatgatgtgtgaatttatctatttacttcgtgtctcccatttgggactgtaaactccattaatgtagaaaccctgtgttagttccctttttgatattcccagcacctaacacaatactggtccaaagaaggtgctcagtacgtatatgttggatgaatgaagccaggtaataagaccctgattgacttaaacacagttactcaaaatcatgttaaggaaaaataaactttcatttttaatttatttatttattatttatttatttatttatttttgagatggagtctcactctgttgcccaggctggagtgcagtggcgtgatcttggctcattgcaacttctgcctcccaggttgaagcaattctcctgcctcagcctcccaagtagctgggactacaggcacgtaccaccacgcccggctaattttttgtatttttagtacagatgggttttcaccatgttagccaggatggtcttgatctcctgaccttgtgatccgcccaccttggcctcccaaagtgctgggattacaggcgtgagccaccgcgcccggcccatttgtatttattttctctcttacaaaagaggaaaaacatccctatcccacattggataagactgaatagctacagggatgccctggaataaaaagtactgtttgactacatggactaatgataggaaagcaatggtttcctaccctttgagtctgggggtccactgtatttttttttttttttttgagacagagtcttgctctgtcacccaggctggagtgcagtggtgtgatctcagctcactgaaacctctgcctccccggttcaagcaattctcctgcctcagcctcccaagtatctgggagtagaggcatgccccaccacgcccggctaatttttgtatttttagtaaagatggggtttcaccatgttggccaggctggtctcgaactcgtgacctcaagtgatccactcccaaagtgctgggattacaggcatgagccactgcgcctggccccattgtatgttctttgaggtacagaatcccaagccctgaatcttctgcacatgaaaatgcagacatcagtactcatgtatccatcactggaggggtttctttccacccacaaaatatcccttgaaatcatccagtagagcccaggggttgatggaaccatttgctactcaagctaaaaattacgatttccatcccccatacttattttccccaagggaacaagcgaattaggcaagcacaaaggatttgagaggaggctgcactttagactttgactttaggaccccaatattcttcctcaggcttctccaggtttccagttccctgtcactcacattggagccctccctgccagccagttaggaaatagagattccaccagtgggagaaactggaggggttgggggaacatgctcaaagtcggaacacttcagggacaagtccaacctgtttagcctctcacacataagcttgccttttcttctcaacataccatgatttagtgccaggccacctaggttccccgcatctcctccacccagtcccttcagggaaacagggtcctttctggctgagttccatgttcagtatccagtgctctcctcatggccacctgacaccggagctgttgctcaacccctcccttgatcggatgccctgtattgcttgaactcatttttctccctgggcccctaaatcagtcaaatttttccccagctgctcttctgctctctgctactcttgattgaattcatcccttctctcaaatgtctccttctcacttcctccagcttgtgttttctccatccttcagtattctccaggctcctctctctcctggccaatggtgctctggtgagatcattttcttcacagcaccctcaccccacatccatcctgggcctgctccccagctgtagatgcggtcatttattcaccagcattttgcaatcaccaaacaaccacaggttcctgtgggttccctacacaaggagggtctaactccagcacacacataacagaaaagagggttctacgggaggcagaggttgcagtgagccaagatcgtgccactgcactccagcctgggcaacagagcaagactctgtctcacaataaataaataaataaataaataaataaataaataaataaataaataaaataaagagttctagaaaaaaagggtgcaagattcagatattactgagtttgaagatgagagtatttttcagcaaaacagctagaaaatcgctagctttccccctaaagagggggtaagctaatcaaatcatagttaaaatctattcaagggtgtttttatatcactttcctatatgcatcctctttgtatataaaccttcttcaaaatgctctcagaaagaatacaacaagtaccagaaccttataaattgggcttttctagggtcaatcacatttttaagtgggggtaaaactgtaccagttcatagaaataagaaatatcttgacagttgttttattctgcatgaaacgtgccctttttcttacagtttggaggttatgaagggaggtaacagaacaacatcgattttaatccctgtccccttcccgcactgcctgcctcattgaaagctagtgggtcttatgaacaaccttaagatgcctgcgagccacggcagaggccaccatgaatagcacttgaatgaagtgagagaaaaaggaaaattgggaagcatcttactggtgccatctcccctacttaccattttctgtgatgtacctgggccctctcttcatgaaattgttctggagaactgagggatttaaagggctacgcctccctagagcagtctgcatcttaacaggatccacaagtggaggcttttttttttgaaacagggtctcactctgtcacccaggctggagtgcagtggcacaatcatagctcactgcagcctcgaaatcccaggctcaagcgatcctcccagctcagcctcccaagtagctgggattataggtgccaacaaccatgaccggctattttttaaatttatttatttatttatttatttatttttgtaaagacaggggtctcattttgttgcccaagctggtctcaaactcctggcctctagtggtccatctttcttcctcggcttcacaaagtgctggcattataggccccagccaccgcacccagcccataaagggaggcttaaggaaatgtctgacttctgtggggagagaaccagctgtggagtgagctcagcctggccttgactcctggtcacttactaggatgtgacctgcatgagcaagtcatccaaagtctctaggcctcagtttcctcctctctcacatgggaataataacagtccctacctcagaacactgtgaagcctacatgaagcaaggctcacaaagccctaagtgcagtgcctggcatgttgttagtactccataaatgttaatgtgggctgggcgcggtgtctcatgcctgtaatcccagcactttgggaggcttaaggcgggcaggtcacttgaggtcaggagttcgaggccagcctggctaacatggtgaaaccccatctctaccaaacacacacacacacacacacacacacacacacacaaattagctgggcgtggtagtgcacacctgtagtcccagctactcgggaggctgaggcaggagaatcacctgaacatgggaagcagaggctgcagtgagccaagatcatgccattgcactccagcctgggtgacagagtgaggctccatctcaaaaaaaaaaaaaaaaaagaaaagaaaaagaaaaaaaaatgttagcgaggagaaggaagaggaggagagggagaaggcggcaagatgaccttggagtcccctggaaagaaggggcctagctgccctctgcgtccttcccctaccactcttcctttcacggcctaatccaaaggtggcttcacggcccctcgggtttaacagctgagactttgtttccagactcacaggtgtgctgtagtgagcacctgggtggaatgttgctctctgtttcctgcaattactaaatcgctttaaggggaatgctgtacatttttttttcaaatgaagtctgtgcttgtatttgctcacagggaattttaaaattgaggagatgatgagcttgtttactaaataaatatgtgtgtttggaccatttgccttctcctccctccagatgccctctcctcctcccctcgctgtgggcttcaaaagcagggcaggcggtggggcaggaaaatgccagttgttggtcttcttggacccaacaattatttacagagcacaggatttacagtcaggaagaattttttttttcacagaaatgggcaaatcctagatgctctctatgtatacaaacttcctttccaacagttatgaaaggacattttacattttaaatgagagccctgttggcggtacattctcaaatgctaagttccatcaaaacagcatgttgaggggaagaagggcacatggcaatgggcacctttgggtcccaacttctccccagcaatgctgtgactcaggaagtcagcaggggtccttcttttcacccctagttccctcccccaactccttgtacatctgatgtcaaagcataagctggtaacctataccgagagggagaattcaacccaggggcagctcaacttgaacagttctatccagaagtccaactttaaattctaccccccatagaaatagtcccattcctgcagctgctctctaccagctgcctaaccagctgccattgggccaaaattacccccacctcagggtccccacctcaggacatcataaacacactccctggggctcattcattaacccatgagctggagttgcccactttggaagtcagctgtggtcttcactattttttttaacttaaacaataaagagcaactcacagatatccctcactctcagcacatgtggaatgagataaaaacaaaagcttgctaagtcagaccccagaaccaactcaaggcagagatgatgtgaatgtggaactaatcaagaagttacacgtgttagaaagatctggcttaatggttctctttttaaaaaaaaaaagttttttgagacagagtctcactctgtcacccaggctggagtgcagtggcacaatctcagctcactgcaacctccacctcctggggttcaagcgattctcctgcctcagcctcccgagtagctggggctacaggcgcgtgccaccatgcccggcttttttttttttttttttttttttgtacttttagtggagacagggtttcaccatgttagccaggatggtctcgatctcctgacctcgtgatccgcccgcttcagcctcccaaagtgctgggattacaggcgtgagccaccgcgcccggcctaaaatactttttaaattttaagtggcatcatgaaaggtggaatccttgccccgtttttctgattccttgttgtttttatttatttagggagaaagacgttctgcctgtgtttatgtgtcagttgcagaatttgtgggtaacaggaaatcaggtatgaaattgaggctaggagctcacagggagcaagagataaataatccaggattcaagattaaaatcgctgttgcttctgtggtgagagcttgtcacacaggcaattcattgtggattaattttccagtgatgtagtaacaaaatcagcacatcaaataaaatatttaacacccaggaaaagccaaatgcatattctgcatgtgtgtccttaagtggtacttttatggaaggaaatcttatttgaaacaaatgttggaacagaagttgagcttatgaagggcaccgagaaaccctcacacataaggttttaaaatgttgcccagaaaaagcataatcttcagtgtcagtcccttggatggtcagcgtgcacgttcaatgctcgtgtttatccacctgtgtgcacaggtgtccactcacttgcaaatccttcacgtcaaaatctgatagtcatattgcttacctgtgttaaatggaaaatggaagtcgactggtgggtcctgttgtctagcaccctactacttggtctcaggacaagaagggaatctcagaatgatgaatggggttatatctggataccccttgctgggctgcctgcgatcagcatttctgcccacagctaagcaattcaagtgctctgaccccaaagtggtgagcccccaagcttctatctggatctcttgaaggaagtgtgtagggtgttgcatgtgatctgtgcaaaaggaaggagcaaattggagttattgagtgaaccgatagccaggggaggcccctgtatagacagatgtcgtggaggcatagtcaggaaaagtttgccatgactcggatttctttctctgcctgcccagatgcctgcctgcaacctcttttttttttttttcattcacttgtacatacattcctcaagtatttaccaaacacctatttcaggcatgggcctgggctagccagggcagtagtatacagaagtcgtttgttttctcctctccctctcaatgggtcttctctccttctctctctccccataattcagtggtaacaggggtggatgaaggaatatccaaaactcgtctctgtaggagacatctgcgccaggaatttccagcaacccctgaggagagtggcagattgatgggactctagttgggactaaccagggggtggagggaggtgggggcggaaagagccctgcagccaggctgtctgcctgagcctattctatagctcccattgattggacacttgctctgtgccaggccctgtacgtgcagtttttcagacctcattcactcctccaatcccattgaggttgctattataactgtccctattttatatgaggaaactgaggccaggagagggaagggacttacccaaggtcacacagctaggaagtgacagagcctcaattcaaacttaggtctgtatatctccaattctctgggcatttaaaaaaaaaaaaaacaactcagatgtggtttagacgtaagccaaaaaaaaaaaaaaaaaagccaggcatagtggctcacgcctgtgatcctatcctttgggaggcggaggagaagcatcgcttgaggccaggagtttgagtctagcatgggcaacatatcaagaccctgtctctacaaaaaaattaaaacaaaacaaaacaagaaaaccctccttatcattatatcaaaagtccagacattttaaaaagagagagcttaggagcttctaaaaggtgctatgaactctgtttccatgtgtggtttagtctaatttctatattcaacaataataattttaataataactaacacttactgagcacttgcatgacaggagctacactaaacagttttacactcatggtgtcatttaataatcataacgacccgatgcagtgttatcgttattattattatcctcattaacaaatgatgaaaacaatgcttagaaagtaattcccaaagttagttagcgccgtcttattccaagtctctcttggtacatcaaagccactcaactactagactatcctgcctcaaaccctccaggacctcattgcttccaaacttctttccctagactttcttctcacctttttttctgtccttataagtctgtccaaatacattgcactcatttctgtcctatgagtgagctaagtcattgtcttctccataaccttgccttttctcctcacccaaatcacttcttatctccaatatccaattagacagatctggaagttccaaggatgtgtccatatagggaaatcagaacaagaatactactaacaccaagttttcagtcacccttctaggttcacagaatcttaagaagtcagcaaaaccataagcccttgtacttaaaaataatcaatactacttaaaacttggtatttattttattttatcttattttatttacaaacactatggtgactttaaaacttagtttaaaaaaatactccccgaggtctgtaatctcccacatacaaaatctctaaaggagaggcttaaaagagaagtactcctccctgaaaatcagactattttataaataatgataaggtggcccttttgaaagtattgcttatttagaggctggggatttaaacttagatcactagtgagggtgtgttccaattaccatatccctagataaacatgaccttctttaatcagctctttgctccctagtttcttagcagaactgccaatgagccagggcagctgccattttgtgccagagtttctttttccattttccaaggaagcaaagaataaggaatgcctcacttccctccccattccctgtttggagtcatgccctctgagaacttattctatttcagcttctacctctatgcagtcagaaaaatgattccgaacaacccatagaatgagcacctgcttcagttattgtcccaatgtgaaaatgctaatccctgggtttaggcgaggtttgctttccacacaaaatggtcaggcccctctaataggccagcacttctggttttaataccccagtcttgatttctaacaggtgggtgccacagttgttcagctcttattatgagctggttcatagctcgaacaatataggattcttcataaagagtctgagaaactgggccgggctcggtggctcacgcctgtaatcccagcactttgggaggccgaggcgggtggatcacttgaggtcaggagtttgagaccagcctggccaacatggtgaaactccgtctttagtaaaaatacaaaaattagccaggcatggtggcgggtgcctgtaatcccagctactcggggggctgaggcaggagaatcacttgaacccaggaggtggaggttgcagtgagccaagatcccactactgtactccagcctgggtgacagagtgagactccaactcaaaaaaaaaaaaaaaaaaaagagtctgagaaaccaccagatggtattattggggggaaataaactcagttcctttcttcagcaacccaagctagtggttttaatcaggaatgaagggcgctttcaccctgctgctttcttcaaactcagtaagtgccccccaccctttttccagtttttacaaattaaaatgtttgtaaaaacccaacttatgccagggaactagggctgcctagctctggttgtttccaacatggcactaatgagacattgcccattgattcagtcatttgactgtctgtactctttccctccctcccatccaagccctgacatccaggtctggagtgtcacaaacattcaggcttggcaagagaagcccattctttttaaagatatgatgaaatcagaaagacacacaatccctgtcctcagagtggaatcaggaatatgtgattctccacttccataacaaatgcaagagttggagaatgtgtggtaccctttttccattcaggaagatttattgggtgagtctacaggccattcttcttagtttggggttgccgtatctggtggctttgtacagaagccatacacatttccctcgtcaaaacagattgagaaggcctgaatatacagtgtgtctcgaggttcattgtgttctgggtatgcatgcaacccacggaataaatgtgttacattgaaataaggaatgactgtgtgctgacaagaagtccaaaatatagagagtgataaaatagaaacagtggtccagaattatctactctaaatgcccttgaatttctgtctcccatttattgcctctatttttctcaatttcccctgcttgaaaagctattaacttccccacctctccaccaccctagactctgatacccataaacaaccgttgccactcttttatgtcctctgttatgaacaccttcactgtgtttactttcttggcactggcatagactagacagagaactatagaagcttctcgttctggctttgccacttatgacctttgtgtctttaatgaatttcctaacctttctgatcctcaattcttcttccataaaaggaagctaataataataccacacagagttgctatgagggttaagtgagatactgcacgtacagccctaaacacagtaatacagtgtctcaatatatatccatttccctccttcctgttttccttcctttcttctttctgcgggaatctcagtcgctacgtttaagcaactgcctatgatgaaaggttttgtctagtgggtggacccagtttctgtctttgttctcatcacttaggtgtaaaaagaaagctttaaaaagtaggattatttttgagggcatatagaaaagttgttgctctttgtataagacaaaatatccaagtttcaaaaatcccagtggcctgcctaccttgaacctctttctgttcttctactcccaagggtgctccaattggcggaaggtagccacgtgggaaattaaacggcccatctatatctatttatacccagcgtaaatgcagagcgatcaattttagaactggtggcttggcctgagaaatagctatgtttggtggaagcagggcaggttcataaagaagtgcacagagctcttggaatacaggaattatctgctcttcttggatgtgggtgtcctcctagggatgagcatctgccctcactgtcctaagttctagaggcctcagctttccgggaaagcacaaaccaccgctcagctggagtctatctgggtctcccctctccaacttgtgacacaagtcttgtgtgaaagcctgagaacactccattcttcctcttgttgttttcaggaaagatttgtccctgtctctcactgccacataccatcttagagcttctctcagcttccccgagtcatgcatgggaaattgctcccacagcccctctatgctttggtttgctcagttttaaagttgattctgtcccctctcctaaaaactcagccatcagacactgaagcagaatcacccaagtgttttagagccatagtccggaagccaagccacctcaggactttccttttctttcatggtgattaaatttattgtaatgtctggccatttttctctgagttgtaaggcagagaagcaaggtgggctggtggaaaggcctgaggccccgattgacttatctaaccttgatcttggccaaggctctctgcccttctgggacccccgtttccacagttttaacatgtgatgcctgtctttggggcccttacaggagagctgcaaggatcaagagggataacaggagggagtgcattctattggggtagggctggggaatctctagacaaaagatatccaaattaaagcaaaagtgctgtattttgagatttgttgccatatgtaatccatacacgtttaaacaagctttttagaacccctggtttctgtaatcacttaagacattgcaaagaagcataaatatatatttttaaagtcatcactactactactttctaggtgaaatagaaagtatttctactttgaacatttgccctataactgtgacagggcctccatagactgcagttccaaggatcagagccccaaccttttaaattcggtgcaagaaatttgctttaatttggatatcttttgtctagagatttccccagccccaccccagtagataactccctcctgttatctctcttgatcagctctcctgtaaattccccaaagacaggcatcacatgaacccccagttcaggctttcagagaccatgctgcttagaaagaccatttcctcaaaaaaaaagtagccaggcgatcccagctactcaggaggctgaggcaggaggatcgcttgagcccaggagatgaggctgcagtaaactgtgattgcacgactacactccagcctgggcaaagagcaaacccctatgtcaaaaaaaaaaaaaaaaaaaaaagaaagaaagaaagaccatttccactgccccacccccaggctttagggctgggcagtaagctccattctgagtttttttttcttttctttttttttttttttttgagacagagtcttgctctgtcactcaggctggagtgcagtggtgcgatctcggctcactgcaagttctgcctcccgggttcacgccattctcctgcctcagcctcccaagtagctgggactacaggcgcccgccaccacgcctggctaattttttgtatttttagtagagacggggtttcaccgtgttagccaggatggtctccatctcctgaccttgtgatccgcccacctgggcctcccaaagtgctgggattacaggcgtgagccactgcgcccagctggtttgttttcttaatgactaatacttagaatcattctgagtattttcctctatatcatgacctgccctcccttctcccctgccaccttccccttgtaattgccaccaatacacagtcacatccagtcacaacaaaaacctggctgagaggtcaagtccctgttagaaaatgttatataatcttccgtatctcaggattagaggcttcaggcatcaatgacattgtaagactttcaagagaagacctacataaataacctctgtatgtgtgcatgatgtatgtatgtgtgtgtgttcccatgcatgcatttgttcataatacatgtgctaatctatccctccactacacacacacacacacacacacacacacacacacacgcatgcatgcacacatgaggcattctgtgatagaaccttaaacaccatcttttttttttctttggtggagtctctctctctgttgcccaggctggagtgcagtggcgcgacctcagctcactgcaacctctgccccccagttcaagcgattctcctgcctcagcctccagagtagctgggactacaggcatgcgccaccacgcccagctaatttttgcatttttagtggagacggggcttcaccatgttggccaggctggtcttgagctcctgaccttaggtgatacgcccgccttggcctcccaaagtgctgagattacaggcgtgagccactgcacccggccaaagatcatctactctagcctctgacgtaggacaggatctccctctccagtgaccccaacaagtggacagccagcctctaactgaatgcctacagggaacaaagagatcttagtttcactctaggtttctccatccatttttggacaacttttatagttgggaacgtctccctgatattacactgcaattctagttcagtttctcctgtaggcatcaaatatcagcaccaataccacttttaactggcccctttctttctaagtttttgtctctattccttgttgcttcatcatatttctaattctaaatggaatttaagattgtaacaaaacacagagtcagaacattaataattgcaggctcctatctcagaaaggaggcatgtgtgtctgttccatttgttgggaagatataattgttagtttgctagggctgctgtacacaaactgggtggcttaaaacaacaaaaaatgtattgtcttacagctctgggggctggaagttcaaaatcaaggtgtcagcagggccatattgtgtgacggctctagagaagcctcttctagttctggtatttgctgacaattcttgacgttcctggggttgcaggcacatcattggagtgatgcacatggccgccttcttcctacatgtctcacattgtcttacctctgtgtgtgtctgtctctgtgtccacattttccccttttgtaaagacataagtcattggattggagcccaccataatgatttcattttatattgattacctctgtaaagagcatatttccaaataaagtcacattctgaacactaggggttaagacttcaatatatctttttgggaggacacaattttttttttttttttttgagacagagtctcactctgtcgcccaggctggagtgcagtggcacgatcttggctcactgcaacctccgcctcctgggttcaagcgattcttctgcctcagcctctgagtagctgggactacaggcatgtgccaccatgtctagctaatttttgtgtttttagtagagacagggttttaccatattggccaggctggtctcgaactcctgaccttgtgatccacccacctcagcttcccaaaatgctgggattacaggcgtgagccaccacacccagctgggaggacataattttatacatatatatgtatatataattatctagctatatagaatatatagatatagaatagatatagatatataatgtatatatagaatattagatacatagatatagaatacatagataggtattcctaaacatttgtagtccagtgatgtaagttcaagtctcagtcctggagaaaaatttcagaaagaaagtccttcattctttgttaagggaagatagattaccagtggggggaaacttcctttttgttgttaataattatattaatatcatatatgtatatattattagatatgataagacttttatatttatttttaacattatatatggtgtattttaaaatattatgtattataatatgcaaatgatgaacacaagtttaaccaattgcttttttttaaacaagtaattaatttcaggaaaaaggcaccaaaccaacaccctgttctacttttttttttttttttttgagacggagtcttattctgtcgcccacgctggagtgcagtggcgccatctcagctcactgcaacctctgcctcctgggttcaagcaattctcctgcctcagcttcccaagtagctgggactacaggcacgtgccaccacgcctggctaattttttgtatttttaatagagacggggtttcactgtgttagccaggatggtctcaatctcctgacctcatgatctacccgccttggcctcctaaagtgctgggattacaggcgtgagccactgcgcccggctcaacaccctgttcttgctcttttttttttgtttgtttttttttggagacagggtctcactctgggctcaagcaatcctcctgccaagtagctgggacaacaggtgcgcaccaccacatccagctagtttttaaaaaattgttatgttttttgatattgctagtataaggagctatcacacccaaagtcaaatcttcgttatatagaaagtccagatcagagaagtgtatagtgatatttaccagtacaatactctatcatatgtggatatggggtcaactgcaaagcacttttgggaacattcaggctcggggacactcaaactgacgtgaagttagcctggatctctcttttagtccagagttggcagagtgaaaagcccagcccagagggagccaagggtcaagttggggtaggggagaattcacccatcttgcctctgatttcccaagaacctctagcattttctgatttctgtatctgtgtatggaactgggagtggatgtgtaggtctgctctcaggaggaacagatatccagcctgtggtttaggttcctttttctagctaagggaatccttggacaacctcagggctaagtccatttgcctgggtaaacttggggactctagcaagccccttcgaggcaccccaccattcttcagtacctcgtgaacctgaggcttctgcttctgattatgctgtctctcaattgcctggacttggtctagatacggcttgataatttcttctttcctcccatgtaaaggccagactaggggagagttccactttgtcttctttccagaggacgacttatcacagggatggaggaaaaggggtacaaagagtgctggctgcacttggagtcactgactaagagctaattgacaggacattgggtaccgttggatgggacagacatagagcccttggcatcaatgatcctagaagataagcaggtgtgcaagtggacaggccaggacgcttgttaggactctgtactctctaactattatagaaaggctctactgctaccccaggccttcaactggtagactagagaaggagtgggggaaggggttagccaataaccagattcaggcccttaggggctggacaaggaggcacaggggcaggtggtgatttctggtggtcattcattaatttcttccttctttcatttaaaaaatatttactaagtacttactgtgtaccagatactatagtagatcaagaccccatttttaaaggaatttatggtacaataattaaggaatggggagaaatagtagggatcagggcaatagtaagaaacagatttggggattttcttctcctcagtatgtgtgtgtgtgtctgtctctccatcactgtgtgtgtgtgtgtgtgtgtgtgtgagagagagagagagagagacagagagagagagagaaaatttatcttcctacaatgtcctcatcacaaagcaatgcatctttacctactccgatatgcacgcatgcctcccaaattgtaggctcgctaacaatgaccaacagccttcctatcaaaggaaccttttctaaaaccttctctacgtctcaggagccaaatgatggtgaatggcctcagtcaggatgttatacacatgcaccaagtgaccacattctgggtggggcatgcacaaggtagctttgggttttggaaagatgcattctggtcaagtcagtgaaaaatcagccaagtagcctataaagtcaactgtggtttattttggacttaggccacacctaaggggccatatgcgtgcacctcactttaagaaaacctgtactcaaaaatcccaattttgaaagggagacgggaatgtgcctgaccatttttggaagccatctagagccctcatttattgacacaggtgtatcaaagaggtggtgaagcccttgaaggaacatctgattcaatcctctgccttctgatgatttcagatcacctcaggcaaatgggcctttatctggttttggcagactcccagagactactaatgggttaaaaatgtggccgtggctgccgtggagttgagaggtctgcacagacacaaacctaccttgtcttttaaaatgagaagggactctggggctttgtggaaaagggtgtagttttctgaaaaaaatcaaactcaaataaattgttaagttaaaacataaactgaattaggggcatacatttgggatgtccctcacacttcatggaaattatgaaatacatctctttgttcaagtttaaaattcaaccaactcagcttctctgcacaaaaggggaggagttcccatgacctgatctttgcaatttcctctaaagtatggctttctgtatttatttaggaatatttatgttcagtcagggcatggtttacccttgttgtgtagccttattatggtttgatttcacattggactactcaccttttagtaaccaaatttgcgacccagcggaaatttctctcttacaaggagcttggattcttatttattttgcaacctttatttgtgtatgagatgaaccatgacatttaaactatgcttgatagcttaacagattataagaacaaaaccagatggcccaaacaaaaataatgctttgattgctttaaaattcaatgtcaaaaattaaaaacagctttcaaaaagccttgacttttttcccccgagataattttgaatcatatatgtggacatatactttccccccaaattagaaatatataaaaaatttaacaatggttatttgggggttgagaagggtgtttccttcttttttcttttcgacaccacccaatttttctgcagttagttttagaatcagaaataaatttttaatggctgctttttagtttaattttaatgaagcctttttaagggttcggtcaaggtgtttttctctgctgagaaaatggacattgttaagcattagcagttcataattcttcttccacacaaaatgatgaataatgtgcggttactttaacactgtgcttcatgaggttggaaaactaaaccggtctcagcgtctttaaaattaatgtaaattctacaaaagcagttatttaattttctaactcgctttaatgtactttcaacatcattagtattaatcacaattgtcactttctttgagagcagtgaaccaactaattccttaaaactgggctttaaaaagaacctccattttaaaaggctctcaaaccttgagatagtttgcaggtcacagtcagaatgtgactgcttgaatgtttaaactaaagcacccacaaagtgttaggattcctttttttccgttcttgtcttgtaaaagaatctttattctgactcagattcatttttctttaaatcagctgcaagagagtgaacaaactttgctgcaaatcaaagccctgacagttacatttccctgagataattgcatgctgctttggagtttccttttccctgctgtttccttttgttttgacaacaagtttctgggaaaacaatatacaaatgataactatgctgtcacgagtatactgaattttaaaaataaataactgtcgacccaaaaagcttccaggagcctatggagtgaattctttttccaaaccgttccaaaaccagatgtggaaatgtttagctaattccccttcccattcttcatgcaaagagttcatacgtgtctctaacgacatcagaggagatggggaggcaaaaaatcctgtctgctttcaaagcgatttctcttacacttctcaattctctctctaacgtcacaaaactaatttggacttcagcttttgtctctttttaaaaggatttttttggggtcctgagattaaaaatgctctgtgcttagaccaatattcaatctcttcattataaaacattaagaaatagagctcatggtaagaacacttaaaatctaccctcttagccattttgaaatatacaatatattattattggctgaactcaccatgctgtgcaatagatcactagaacttattcctcctgtctaactgcaactttttactttttgaccagtatctccccttaccccttccactccaccccaataaccaccattctactctctacttcttaaagtaaggcaatggtcatgttaaccagcttgatctaaaataatcattccacaatgtaaacatagatcattgttacatgtatacatagaacactgtatcccataaatatatacaatttttatttgtcaatttaaaaacaaaacaactgctgaactttataagcagcattttcagcataaaaaatttaacgatgggggagttaagtggcagctcttcttcctctttcctttttttgttttggccaatccattctcttcctgtctataagaagaaaagggctgtcttggtttcacaagtactacgagatctcagtctggctttgctaatcagattgtatcactgtcagtgactgatatagatagctcttaaacataaacactggcatttttctgaacttaattaaaagagcatatgtgtttatgagggaagaaaggaaatacagtttatattcccaaaatgaaatgttttatgattttttaatgtagaaaatttattaaggcttattagggagttcttgaaaaaaagggaaagaggaaaactctgttaaaggagctagtgggaaatgtatatgcataaactccatttacaaaaaaacagaaagctacttgtactctgtagcttcaaggaaagcaaacattttgcatccaggtgttattagaagctctgggtttgcctgacctctctatagctcagttcaggacgctgtgtaccaacagctgagccctacttggctatacaaatgcatctaggctcattgcttcgggcatgttgcaaggctaatttgcaatcgagtcaaaatggggctacagtgatacagaccctgagactgctttttttctcagcacagaggcctccccaagaagctggacagtagtcccaaaatgagtgctcccttctttgcatttatttcttccccagtccccaactccacgtcagctctaaagagttctaaagactttaaatagaattctgcccacagctcctgggatactgtgcatggcccgcatgatggctaaaaataccttcagctgggcacccccacacagccctctcttctggcatctccttcccatctctaacccctcagccttcttttccctctgcccccaataactagagcccactttctccctcccttgttcgggatcccattcttccagcacatctcagcaaggtgttagaaaagtcagctgatgaattcacactgtgttgtgaatgacttataaccatcccccctgccggacgtggtggctcacgcctgtaatcctgtaatccgagcactttgggaggccaaggcaggcggatcacctgaggtcaggagttcgagagcagcctggccaacatggtgaaaccctatctctactaaaaatacaaaaattagcagggcatggtggcgggtgcctgcctgtagtcccagctacttgggaggctgaggcagaagaatcgcttgaacccaggaggcggaggttgcagtgagccaaggtcgtgccactgcactccagcctggacaacagagcaagactccgtctcaaataataacaataataataataaccgtcccccaacacacacacacacacacacaaacacacacacacacacacacacacacacacacacacacacacacacactactctacccttccctaggaattgcaggtagcaggagaagggaggctgccctgctttgaggatctgttctcagcaagaaggagtaagtctcaaagtgtgccaatgagctgggcattcgcaagctcattagaaagtacattctgctttccccctaatctcctttctctccccttagagatgagcaaccttaaacctgggtctcagtgacctcttctttaagctttatctgagctgaagggtgtgctgtcacatgcctagtcatcttcgtttatttctcctatcacatggtgagctgttcttggctttatgaaagtcagaggaaagagattctgccgtgttcaaatttggagagttgtactaaatgaacccctaaactcaatgacattattgagccccttcctttgagactgactcagtgcaacataatacaagaagtgaacgtgtgggggtgggaagtgaggtagtctaaaatgattgcttgagggacaacagtctcatttctcagaaattctagacattttataattatatttggattatctttggggaaggaggagaaggagtacaggaaagatgcttgagggagggggaggaaatggatggcttagctctctggaaaagagtagccttaaacttgggtgttaattttggggtttgaacaaaaacagttgtttccttggcctagtccagaactacttaaggaggaggttttcattcagggcaattaggcccaggttgtgggatgatgttaaagaaagaaggaaagaaggagagagagaaaaagagagaggcaggaagggaaagaaaacccacctaaagcacatttaagacaaggtggtcttctatagatcaagacaatagtgcagtagtgatggggtgattatctcagcttccaaaaggcacctcagcaaatgttatgcagtattccagagcaggtggtttctttacttaactgttgagtcatccaggaccagctcacatcagaatttacttatttgtgttgttattattgtttcctttttgtttgttttggggatttttggtgcgggggagagaaagggagtaggtttttgtttgttgctgctgcttctacttttgctttgtgaaaaaaacccaaaaaagttgtcccagaagagacatttcagaaggaacaaagaggaaggagcctggcagacctgtggggcttctcttttacacccacaacacccctgagagaatgaggaatcattaacggcagagtgaaagacagtgagaccaatccgtaccaatcagaaacaaaacatttcatccaggccagtgcgtttttctagcgggctcctgtgccatggtttccattaaacaatgcagcaaattcgtcactatcaagggaagagaaagagctgtatttttgcaactggggaaaaagagaagagagaaatgtcttgggacgttttttggcccattgccgtgcacatagtaggcattcaacaaatattagtcaaagaatgaatttgtgcaggggttacttatctcagcagggaacaaaagtgaatccctatatgcatgtacatttccttccaaactttaggtactttactatgtgatttatgtcattttcacttgtaaaatgaaagttgagttggaaaacattggatgatgttgctcttgctttcttctttcttcatctgttacctccttctgatagcatgttttagatacttattcctagcactgctttttctcctcactggtctgcctgtcactctttgagagctagaagcaataggactaggaagtggccacagagcttcctatggaaaaagaaaacaataaaaagctagagaaaataaaagacgtaatgcaaagattttaggagatatcttgtcaatcaatgtgtaaagtacaaactcaatcctccctctctccctccctccctccctccctccctctctctctctctttctttcctttcttttctttcttccctttttttttttttgagacagagtctctctctctctgttgcccaggctggagtgcagtggcacactcttggctcactatagcctcaacctccaaggctcaagcgatcctcccacctcagcctcccgagtagctcatactacaggcgtgcaccaccacactcagctagttttttgtattgttttatagagacaggctctcactatattgcccgggctgctcttgaacttctgggctcaagcagtccttccaccctggcttcctagaatgctgggattatgggcataagccgcccctttctttaatataagacttttacggtagttttcatgtgtaatatgcattgaaaaatgtaaaattaaaaaccagcatgtttttatgtttccacaattttagtattttacaaggtgtcctaaagaatttatcagggactctattggtcataatgacttatgatgctgctgccagagtttatgaagcattcgtttgatcattttaagtaagccactcggcaaaatttcaatatctggttgttaagaataaaccacaattccttcataggtttttatttgatcaaatctgttgtaacaacaacaaaaaagcgatagggaagggttcattagtatggcctatgagaggacatggaggcccctaaagagggaagtattgccatcttgaattaaactctatctcctatctctttattcaacgtttgacacaaaaactgttctgttttgggttcatcttgaggttaaacacaaaaggatgccactcctgatcagtgtaaactgttgttctacatattagggatatgtgttttatgctagaacagcatgggaaagtcactttaaaaagccattgtaatcgtccataaacacgtgagttccaacaatgaaattaaagttcagttctctctcaaatgagtgttttcctcttcttaatgctttaggaacagccctttgcttaaaaaatatatcatgtttgaactttcaatagaaaataagatgacttgcctcttgtgtttttttgtgctctagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaa

SEQ ID NO: 3734 - DNA, 167759 bp, human
gaggaaacagccctagctattcctgaggcccccattactgcctggtcaagggctttggggcacatactgcctgtgcgtccatcctcatgaactccaaatctccccgctactccacaggacaaagaaaacgagactgacaacgaagtctgaaggagaaaggcaagtatctttctgctggactggccctcaagacttagcacaagtgagtttttggagttttttcctgtgatttctgtgtgtacatatatactcacctcttttctgtgttcacttcactgaaacacaaatccaccacacccataaggccaaccctgggttactttttgagcctgcagagatttcccccaacagacaaaacttctaagccccggaagttctctgttttatatctaggatgtgaactaagactctgtgagaggggttctggtctatatcacttggggctgcctccttcaagggatggtgagaagccccctgaaatgaaataaaatggtttctcaggctcttccttttgaatttcccatttcctgcctcagggctcaacaaaggacttgtgtatgagggggtgtgtgagtgtgtgtaccatggcaggagaaggcacacaggatccttgttgttcattcacttttcctgggaggaaacagcagtgggtgtctattcccagcagtattaggaagcagtggtgtgggcccctcgccgtctctcttcccagcttgctgggaacgtcttttactccaagctggttaagtaaccacagagttgcatctctggcttctctgactacctcccactctccacttgatgcccacaaaaacaatgtgttcagctgatgtttgggtaacgttgtacatattcctagcaaggacattggacatattccttgcagataaggaaggtaggatccgttcctgactcaggaggctgatgtttcattctaataaagctcaaggtttctcctcgcccacagtcgtgctttttgataacctggcaacagccaaacctcagtcattgctttgaatggccctatctcagcatttaagagcatttttcaggggctgggcttcataaagattggggtttttttgagatcctgttaaaaaatggggtaagcatcgtgggcacatgctcatcacaacccagggaacaaactgttggcgaggagtgtagtagagcccacatacagaccaaatgcattaattatgaatggttcttatcttgtgattaaaacagatctggcaggcctggaacttggcagcccttggttagctattagttctatgctactgtaccggctgggcagtcataaaactgtatctctttgaaaaatggtccatcatgtagaacagcctcctctgcacccattagctcaaattgatatgacttgatggcctaatcttgggcttctcagatgctggatttaatttctgtctggagctttaggaaatctggaggaagggacacaagggctgcatgcagtgaggtagggtcagaggatgtacacaccagcccccacctccatctgcacaactccccttactgatggaaggcatccctctagttcatgttgccattgtgtgcccccactctgtcaagccctgttaaggaattaactacaagttgggagttcattggtaagatcctggggcatgacttgcaggtgcaatcacagcttactgcagcctcgacctcctgggctgaaatgatcctcccacctcagccctccgtgtagctggaactacaggtgtttgccatcaatcccgggtaattttttatacttgtatattgacaggtgtctcaaggaggcaaaagctcccaaggatggaggccatagtgctgggataagaactcatagtgtagatatttttggactgagtcttatcagaagacactttaggaatttcaggaatcagaagggtgtgattgggaaaacaggggcagagcttcccaatgccccagaaatcccaccaaatagaccacactgagtctccagtcagatggtgccaatctctctgctctaccccggcagtagtaggcctacgatattgctagatagcattcatgaagttccagctaggccaagtacttttgcaagttcatgagcaggcccctagggtagtctagcttgtagtctagatgagaaggctgttgctaatgcttgaatggacttttatttgattatttgatttaaatgtctcaaaaatggagcaagaacctaatctattgacaaaaacatgaatttgggaatcaaatccaaccattgctcatttattcaccttcaaaagttgagcattttatattgagcattaaatatgtgccaggcacagtgaaaagcattcatgtgacaggtaggtacaattatatccccattttatagagatacaaactgatgctcgggcatattcatctcggttgcacagctctaaagtagtggtgctggaattaaaaacaatgtagcacagagcataggttgtgaagtcaggctgcaggaatattcatattcttatagataaatgtgtaaaactaagggatgtttcttttcataagtgttctctggaggagctctcagcctcacgtgggaaaatagctctgtcactcagaggagagctttaggaggatgatacaggtatgggcaccatcaacatatagaaggcaagtgaagctgagggagatgagaggaagggccagaaagacttgctgtaggtcacacagccatcaaggacagagccaggcccaggcaacagcacttcccccattgccgtttccttcagctgcaacttccataccaagaggcggctccatcctttcctcgccccctttctcttactttacagtcagacaggagttatttcccaggaagcaataacagtattgacaatcagaggagtttgggacaggcaccgtggcttatgcttataatcccagcactttgggaggccgaggcaggaggattgcctgagcccaggaatttgagaccagcctgggcaacataatgagaccccatctttacaaaaaaatttttaaaaaattagctgggcatagtggcgcacaactatagtcctagctacttgggaggctgaggcgggaggatcgcttgagcccaggattttgaggctgctgtaagctatgatggcatcactgtgctccagcctgggtgacagagcaagacccctatctcttaaaaaaaagaattcatcttgagtaattattcatagctattgagtatgaatgaattctgtggtaaatagacaactctagggatttcagcacccactcccattgggaaaccttgctctaaactctcacataaaacactttccttctcagaaactcaatgctggctgtgaagaagagcttccagagcaatgactttctcttgacaaaggctggccctctcaaaaatggtaacatttgtctgttgcagtgtgcaagctcacacctttctctcatatggagccttcaggtcctcatgtgcttgtgctttcacccctggatcagagtgcatcttcatgtgctgtccacatgtgtacaacaaaactgtctctctggggccaggtgtgatggctcacatctgtaatcccagcactttgggagactgaggcaagtggatcacttgaggtcaggagttcgagaccagcctggccaacatggtgaaaccccgtctctactaaaaatacaaagttagccgggtgtggtggtgcacacctgtaatcccagctacttgggaggctaaggcaggagaatcacttgaacctgggaggtggaggttgcagtgagccaagatcaagccattgcacaccagcctggggaacaagagcgaaactccgtctcgaaaaacaaaacaaaaaaaaagatagaaagaaagaaaaagaaacagaaaacacctttctctatggaaagaatatcataatggctcatatgctcttttctgggcctttgtttcaggggacaagaaccccaacagtggaatttcaggcatcagccagcaggtgggtggattaataaagagagattgagagaaggcacctttctgccactcctgaaatcatactcctggctctgagtgtcagtcccgtttggaaactatagctggaaaagtctcagctgcccctgacacggtcaaatggaaagtgcatgggctctggagtcagactgtctggggtcgtgttctagctctgctacttactagctgtggcacttttcataagttactcaatgcgtggtgcctcagttttctcgttctataaaacaagataagtatagtacataattcacagggttcttaggtgggtagatctagataacttgaatacatataaacacttagcagagtgcctgtgtgccgggtacaatgggaagcacttaatgaatggtatctagtcttatcatttccttgctaaagctacctcttcttttaagtcccttaactaagtaggtcactttagagaaactcaattcaactggaattattgagtgtctgttgtgtgcctagcattgtgctggggacactgtgaggaatacaggagaaatctatgaaggaagaactgttctcaaggagctttttaggcaggatgttttgagtttcctccaacagcccaactagcagccacgtggagaggcccacggctcttccttacatagtagcatagcaaggggtttaaacttatgggctctgcaatcagacaggcatatcatctctgcctcctgactgaggtgtgatgttgggaaaggtacactacctccccatttctcggtttcctcatctataaaaatgtgcatcataattacatctttatacattgtgtgcccatcaacatagatttatgattattgatttatgcaattgtcttttcaatcagataggaaaaaagggagttacaaaataccttaaaatctttaacatttacctttaaatattaaatttactggtgttcttttctttcttcctgtggattcaaactactatctggtgtcccgtcatttcagcctgagagattccctttatcatttcttgtagtgaagatatcctagcaacaaactctcactttttatctagctgggaatgccttcatttctcctttattttaaacaacagtttggttggggatagaatttttggttgacagttgtttgcctttcagcactttgaatatgtcatcacactggcttctggtcttcatggtttctgatgagaaatcaactgttaattttattgggggtcttttgtatgtgatgagtcacttccctcttgctgcttatgagattctctttgcctttggcttgtcacagtttgattacgatgtatctagatatggacatttttgagtttatcctacttggagttggtggtgctttttggatgtgtaggttaatgtttttcatcaaatttggggagattctgcctattatttcttcaaacattctttatactcctttcttcctctcctctccttctgaaactcccattaagtgtacgttgttatgctggatggtgtcccacaggtgtctgaggctctgacatttttcttcattcgtttttctttctgtttctcacgctggataatataagtatcttcaaatttgctgattctttcttctccccattcaaatccgccattgaacatctttagtgaatttttcattttagttattatatttttaattcaaaaatttctatttggttgttttaaaataatttctatttatattttctgtttattgagatatcactctcatattttagttctttagacatggtttcctttcactctttgaacctatttgaaatagctgatttaaatctttgtgtaaaaagtccaacatcaggccttcctcagggacagtttctattgattgttttcttttcctttgtatgggctatttctttgcagatcccatacattttttgttgaaaactgggcattttgaatattataaggtggcatcctggaaatcagattctctgtcctcctgagcgtttgttgttgttgctgcttgttgtagtagttatttgtttagtgacatattctgtttgaacttctaccagagttggccagtcctatctcatagctacaatttgcaaagtataactccccctactgtttgctttggctgccccacaactcttttgatgaaacttaaagccaggcattaagagaagcaagatataaatatgaagcttgtcttgatgcctcttagatcttcatggagcaacctttattcaaataactcataaattacaaggcaaatcagcattcattatctgcctttatgtcagaatgagaaaaaaatgagagatttacatggcatgagagaagaacgcattccactcttctaagaggcgttaaaggctccctttttagtgaaataagccacaatccagaaggagaatggaaatccatgtcacttgagagagatgccactagccctttccttctatttgcaagcctccctacttttgagggagggggagcacacccctgctaaccggagttgtctaggtcctgtggtgttaccagagacaggggtgcctatgtgaggctctctctccgagcaaaggaggaagccttaggaaattgggaggtaatcagagactgggccagaaggactggtaaggtagcctgaggagcatgggcagagtgtctccagcactggatgggggtaaagaggagggagagaaagggggaaagggaggtaggtaatgggataaaatatggtcaataaattctgtgacactggggcaggcttagagcaacgggtagtttgcccttcctgactccatattttcaccaggaagttttttttttttttttttttttgagacagagtcttgctctgtcgcaaggctggaatgcagtggtgtgatctcggctcactgtaacctccaccttctgggttcaagtgattcccctgcctcagcctcctgagtagctgggactacaggcgcatgccaccacgcccagataattttctgtattttagtagagacagggtttcaccatgttggccaggatggtctcgatctcctgacctcatgatccggccgcctcggcctcccaaagtgctgggattacaggcgtgagccacagcgcccggccaggaagtttttaatattgttattttgttcttgaaatattccttaagcatcaaccttatacattcattcaacaattatgtaccaagtgtcaggcattagaaatactgagatgaataaaacaggtcccgattataagggaaagtaatgtatagaaaattacagtagtgtgagagcagaagtgtgactgagggaaggccagggagctggatctgcaaggagacccctcactccagcttcgagtaggggtaggaaatagaatttataaggcttctagcaggaggtaatgcttgagatgaatctctaaccttaaagcacaataaatttgtcaagcatcattggccaaaggagtgtgtgagggtgcaaacatcctagtgagaaggaacagaagccagaaggagcttctggtatattctgatacattctaagacggaaaaatagctttggaggatggacatagggtgtatggagggttccaaaggagattagattagaaatttaaataaagccagatcatgaaatgccctgcaagtttttgtttgcttgttttttgagacagtctcactctgtcacccaggctggagtgcagtggtatgatttcagctcactgcaacctctgcctcctgggttcaagctattctcctgcctcaacctcccaagtagtggggattataggcacccgccaccacacctggttaatttttgtatttttagtagagatagggtttcaccatgttggccaggatggtctcgaactcctgacctcaggtgatcgatccgcccacctgagcctcccaaagtgttgggattacaggcgtaagccactgtgcctggcatgccctgcatgttttaaggaggcatctgtgctttatcttgaaggttatgagggagtcaacaaaggatttcacaggggaatgacctagatagtatagtaaggcagttaagagtgcagaatctatatatcagtgatgttcaaagtgtagttcaggtaccagcagtctcagtgtcacggggaacttgttaaaaatgcaaattcttgggccccattctagacctactgaatcagaaactagagataggccccagtcagctgtgttttaacaagctctccaggtgactgcaatgcgtgctcaagctggagaactacttccctacacagaccacctaggttggaagcctagctctcccactatataacctggggcaagttctaaactccagtgaagagagggggtaaggggaggggacgggaagtgagggaacagccatgacactaaactaagacccacaggccatataaaaatggttggtcatccagaaggaatctgggtgacagtgacattcatgataatagcttacatttattaagagcttactgcggaccaggtattattctaagaacttcacaaatattaatctacttaatcctcacaacaactttataatcctatttttcagctgaggaaactggggctcagaaaggtaaaaatatggtgtgatgtggagagatgtttacaattaaagtgggaatttttttttttttttgagacagggtctcgctctgtcgcccaggctggaatgcagtggcacgatcacagctcactgcagcctcggccttccaggctccagcgatcctcccacctgtctcccaagtagctgggactacaggtgcactccaccatgcccagctaatttttgtatttttttgtagagatggggtttcgtcatcttgcccaggctggtctcgaattcctgggctcaaatgatccccccaccttggcctcccaaagtgctgggattacaggcatgagccactgcacccagccgagttttgtttttattaaaagaaaaaacccataaatcatgtatatatgcatggaaaaagactgggaggaaatagcccaacatactcattgtggtggtgcaattgcaggcatttttaatttcttttttgtagttatctttgttttccagaatttctctaagaagtttatattgcttttgtaatcagggaaaacacccttttgaaaaagaaaagaaattgaacatgtgcacttgaggaagatgtgagcatcctctcagtgcacaatgcagacccacagaaagaaaaatgcacctggcttgtcgctatttcatgcaagaggattctgagggccttatcatgttggcacgcagtgagggaactggtggaggagtttggaaaaaaaatcagtgcagatagatagttcctaaacacccttcatccagctttctctaatgttaactgagttaaccatagcacagtttccagatcaaaactaggaaattaacaatggcacaataatattgactaaaccatagtttattcacattttcccggtctttccactaatgtattttttctgttccagaagccaatctaggatcccacctggcattgcgttgtcatgtctcattagcctccttcaatttgacagttcttcagtctttgtcttttgtggctttgacactttctaagatcctggtcagctactttgtaaaatgtccctcaatttagatttgttttatgtttttttttttcatgattagattgaggttacacgttttttgagaggaatatcagagaagtgatattatgccattcttagcactccctggtcttttaataactgtgtccccttaaacgctttcatcatgcaattttaaaattataagcataaatggttgcaaagatgtttatttccaatctgttgtaaatatcagcatttgaaatgcaattacttcactcttttaaaggtattcaatggaatctaaatagcaaagtcatttttacccaccattattttattttaaaatacatgaagatcttttttaaacatttaacattttactccttgaatctgtatttctagtccactttcctcagataattttatcttaaggtaatacattcttggctgggagctggggctcatgtctgtaatctcagcactttgaaaggctaaggcaggaggagtgcttgaggccaggagtcaagaccactctgggcaacatagagagagccccgtatctacaaaacaaaaattttacaaaatcggccaggtgtggtggtgcgtgcctactgtcccagatactcagaggctgagttgggaggatcgcttgagcttgagaggttgaggctgcgctgagccatgatcctgccactgcactccagcctgggtggcagagtgagaccttgtctcaaaaaaaaaaaaaaaaagtaatacaattttatacctaaaaggtaaggcttaaaattctcaccctatgtgacttctctgtaacaaaaatatgctttataaattgaaattgatttatacttgatttttaccataaagcactattagaattattatgattattatacacagtgatcaaaacaagtatatttaaagttttttaaaaataattattacttgtgaaaaggaaatttttatttaaatatatctcttaatgaaatgaatgggactttcttttcaggtatctaggataaataatacttattgctagaaagagacagtattcagaatcacgtctttttttttttttgagacaaagtctcattatgttgcccaggctggactcaaactcctggactcaaacagtcctcctgccttagcctcctgagtagcttggactgtatgctctcacctttcagcatcaattctatttctaattttttaatatatttaagggctgaataaacttgtttacataagtaagaagaagaaaatttaaaagttttataatagcactgtcatgtaattccataaacatctgggctataaaccaaaaatcagttatctccctgcaaaaataactttttcgttttttattgagatataattcatataccatagaatgcacacctttaaactatatgattaagtggttttagtatatttagaaagttgtaaaaccatcactactattcaattccagaatattttcatcatccccaaagagaaactcattacatgttagcagtcactccccatttcctcctcgccccaactcctggcaaacattaatctttcggcctctggatttgcccattctggtcatttcatgtaagtggaatcgtgtaatatgtggccttttgtgtctggcttatttcactttgctgaatgttttcaaggtttatccacattgtagcatgaatcagtgcttcattcctttttatacctgaataatattccattgtatggatataccaaattttctttatccatttgtcagctgatggacatctgagttgtttccatcttttggctatctgtgaatagcaatgctatagacattcatttatgccgagtgcaatgacatgtgcctgtagtcccagctactcaggagactgaggcaggagggtcacttgagcccaggagttcaagcccagcctgggtaacacagagagatctcatctctaaaataataaaaagaacacattgatttacaaggttttcggtgggcacatgttttcgtttctcttactgggtcatatgggaatttatgtttataaatttttgaggaaatgccagacattctcaaagtagctgcaccactttacattctcaccagcaatgtatgagcgttccaattcttccacacccttgccaacacttcctgttattatctgcctttttttatttttatttttattttttttgagacggagtcttgctgtgtcacccaggctggagtgcagtggcatgatctcggctcactgcaacctctgcctcccaggttcaagcaattctcctgcctcagcctcccgagtagctgggattacaggcgcatgccaccatgcctggctaatttttgtatttttagtagagacggggtttcatcatcttggccaagctcatcttgaacttctgaccttgtgatccacccgccttggcctcccaaagtgctgggattacaggtgtgatccaccatgcccggcctgtcttttttttaagagacaagttctcactctatttccaaggctggagtgcagtggcagcgatcatagctcactgtagcctcaaaatcctaggctcaagcaatcctcagcctcccgagtagctgggactacaaggtgtgtgccaccatactggctaattttttaatttttttttcagaggtggggtcattctatgttgcccaagctggcctcaaactcctggcctcaagtgatcctcctgctgtagcctcccaaagtgctgggattataggcgtgagccaccatgcccagcctgtctttttgattatagccatcctaatagatgtcttcactaggtatctctttgtggttttgatatgcctttccttaatggctaatgatgttgagcatcttttcgtgtacttattggccatttgtatatcttctttggagaaatgactcttcagattctttgcccatttttaattaggttatttgtctttttatcgtttagttgtgagaattctagatactctagatacaagtccattatcagatatatgacttgcaaatattttctcccattctgcatgttgccttttcactttctgggtggtttaatttgcagtacaaaagtgcttcatgctaggaaggcacagtggcctatgcctgtaatcctaacacttcgagatgctgaggcaggaggatcacttgagcccaggagtttgagaacagcttgggcaacatagtgagagcccatctctacaaaaaataaaaaaaattcagctgggtgtggtggcacactcctgtggtcccagctactaaagtggctgaagtggaaggatggcttgagcccgggaggtcaaggctgcattaagctatgattatgacactgtgctctagaaataaaagtgtttcattttcatatagtccaatttatctctcttttttttcctttgtcacttgcgtgtttgttgtcctatcatcctaagaatttcttacctaatccaaggtcaggaagatttacacttatgttttcttctgagttttagttttagttgttacacttttagctctgggtctgttgcattactgtgtacattttaagatcaacatgtcaatttctgccaaaaaaaaaaaaagccagctgagattttattagagattacactgaatccgtagaacaattgggggagtactgccatcttagcaatattaagtcttctaatccatgaacaagaaatgtcattccatttactaaggccttctttattctctgtcaatggtgttttatagttttcagtgtacaagttttgcacttcatttgttaaatttatttctaattagtttattattttattgcaaatagaattgttttcttaatttgattttcaagttgtccattgttagtgcttagtcatagaattgattgttgtgttttctggcatcctgcaaccttgctgaacttgattattagctctaatagttttttgtggattctttaggattttctaactaaggttgtgccacctgcaaatagagatattttttacttcttcctttccaatctggatgtctttaatttttttctcttgcctatttagcccagctagaacttccagtataatattgaatagaagtggtaagagtggacattcttgtattgtttttgatcttagggggaaatcttacagttttataccattaaatttgatgttagttgtgggtttttcatagatgttctttaccagattaaaagttactttctagttcttgtttattgagtgttttttgtttgtttgtttgtttttcattgaaacggagtcttgctctgtcatgcaggctggagggcagtggcatgatctcagctcactgcaacctccacctcccaggttcaagcaattctcccacctcagcctcccgagtagctgggattacaggctcccatcaccacgcccagctaatttttttatttttagtagagatggggtttcgccatgttggccaggctggtctcaaactcctgacctcaagtgatccacccgcctcggcctcccaaagtgctgggattacaggcctcccaaagtgctgggattacacctcgcctggcctactgagtgcttttatcatgaaggaatattgaattttgtcaaacacttgttctgcatctatggagattaacaggtagtttttgttccattaatgcagcatactacattgactgattttcttatgttgaaccaaccttgcatccctaggaaaaattttatttggtcattgtgcgtaattcattttatttgttgttggattcagtttagtagtattttgttgaggatttttgtgtttgtgtgataaaatacagataacataaaattcgccatttcaacaatttcagagtgtacaactcagtgacatttgttatgttcacagtgttgtgcaatacttaccactatgtagtttcaagacattttcagcatgacaaaaggaaaccccacacacactaagccgtcattctcccctccccctggcaaccactaatctgcttcctgtctctatgtatttgcctattctgaatattttttgcccaggtgtgaggtgaaaagggtttgggtgaaatttcctctatttagaaaattactatcacaaattctttatcagtcagcagccagtcagcagcctgtcccacacaattattcacaggccccttttgaacctcctgcatttggcaagaaagggaggtgagcatggaaaaggaagagggcaatctttcaactgtctcccctccttctgctagagaagggggactatgagaagaggactgcccaggatggctccaggcaaaatataaacatttgtctcctttgccctcaaatctcccctttctgctgctatatccaggccctggtggcctcaagtagccaggccctaggatatctctaagatctcttccctccaggcggggctgcaggccctgagactactttcataattggtttcctgttgggtgtcccttgcctgcaagccttactaactggccagatggcatccacttgcttgagccacgtgttcttgtttgctaaggcctccctaagttatcctgtccaaattccctgaacgtgaggaatgtcaagccccaaagctgtaaaaacggtgactcactgaagtccaagaaggaggtacttctggagagcagggtgatctttacgtacttttcaagtaatgcccatgggcaaatttgttatttagtgaagcaggatcaggcagtgggaaaaaaaaggtgacaccccaccctcacagtatgccttacagcccactccacagctttattaggagctaagtctctggagagattctggggaattttttttctccagggaggctttctggcttacacttctccagaccccaaggacactcccagatgcaaggtgatgtcattggagtgttttcagatagagaatttaagacttgctctgacctcatgtgctttgtgtttccagtttaactcaaactttccaagacttgagttcatttacctttaatcaaaattccctttctgggctccacttctgattacacatgggcctctaagtcttcttggccatcaggtaccagttgatcaaaagtgtcacacatttaggtagggccagtgtggctgacatgccctttgaagttcaaatagggttggaaatgagtgcaatattgctcacatgatgtcaaatctcacatgtttgaaatagagtgtgtgacatttgacaaattcaagcacatggtgaggcagctattctgcttacagagcaaagactccactaaggactaggtgagtgactgctcattggggcctgcctctttgttgacaacagactcagactggggcctttttgacgaaaaatcagaatgctatttccaacccttaggcaagtaatgggctaatgaatggctctagaattttaggagacaggcctcactctgggggacagtccccactgaaggcaaagttctttcctcacccccacatgtgtggctgataaaagctacttgtctggctgggtgcggtgtctcaagcctgtaatcccagcactttgggaggctgaggcaggcggatcgcttgaggtcaggaggttgtaaaccaccctggccaacatggtgaaaacctgtctctactgaaaagacaaaaattagcaggggtaatttttggcacgcacctataattccagctactctggaagcagaggcaggagaatcccttgaacccaggcagacattgcagtgagccgagattgcaccactgccctccagcctgggtgacagagcaagactctgtctcaagaaaaaagctacttgtcatatgtgcgcaatgtacttctccctgaagactatttcaaatggtttcagtttggccatctacccagaacgcacacgtacccagcacgcacatgtacccagcaaatgccttcctatttctaccatctttacccatagaaggccttagagtaagtactctttttcactgagtcaggtttagaccacagaatcctcagatcagcactcccagcagcctgggccagttgcttggagttggtatacaagataatgaaaattgctatcattttactgaggatttattatgggtgaggcactgggtaagtgcattacatgcattatctcttttaattcccacaatagtcttgttatgtactattattctcattttacagacaaggaaccaaggccaagggaaggtaagtaaactttctcaaggtcagattggcagaactgggctggaattcccgtctgtttgactccagagactaacctcttaaccgttacgctatgccagttcattcattcactcaacaagtatttaatcggcacaaattctgtgttagcatggttctaggccctggggatacagcagtcagaagatcttcgcccagtggaacatgacactgtgtgggcctctggaagaaggccctctgggaatcagtgacttgacactggataatacatccatttgctagcaggatgagggatctcaaaaatgtgggagctccacgcctaaacacagggagtatatggaaaactcaagccacaaggcaaaagggcaatggcaaagtttcagctcaaccctgacagggctctgtatgcttagcataggctatagcccatgctccagtgcttgagaaggataacatgccctactgatctctgtaacccttgaaggtcaaccaccccaggccctcctaccataagccaacattaagtttttcaagcatcccaggtctgcctgtcttttttgccattagcagctgaatgtgtgaagctcgtggctccccgcaaggaaccctaggggtgggtcacaggtggggctgagctcactcttcctatagatacatttcccccttgtaaagagcaaaggagacagatcaaaggccacctgggcccacttgcttgctagagagacccgggggagctggaaaggaaaggggaggaggggactggggtaggctggagctgtgctgtgattgattggcttgttttgctcctgcacttctgtttacccagctgggcctgctgctgcccagaggaccagcatgtgcatggccactctggccggcctttggggcagtgtcagagtgagctgtgcactcagccatctcctggcaaaactgaggcagggaagtttgtgttttatgtctgcaactttcctgccccactgggccttctcccacctccagggacacccctccgtaacacacacaccccagtctcagccacaaagttcttcaggtcttcttcctcttagtggaacctagtgtcactcaggtatctaagacactaacaggtaaacatctgccaacagcctctagcttaattcttctagcatttcaaaatgccgggcttctctgtaattaattagtccattcaaggcagacaagagcagagggccccaggagagggaaacaaatagcttatgaaagagctacagatccaaggacacaaatgaagtccctggtcttctaggtcagtctttctgttaattgacaaacaaggttaaaacaaatcccagcatctcagtaatgctctctgctcggtttgaatagcagtagcccaaggtagaacggtttcagaactcagtgtgttaggggggtggggggccgtgggcaggatttgaagatttgaaggacccttccaagtgcacgtggccactggtttgtcagtgtttaacgccagctctacttttcttaaaaaccaacccaaccccaaatcagaagcaagtagagactggtggcaaagggcccctgggctttgggtaggcactagagtggtggtttagagtgggctttggagtcagacaagcctgagtgggagtttcaaatctcagctctgctacttataactgtttgactttgggcaagttgcttagcttttctgagtctcagtataaccttctgtcaaatgaggataacacctacctcactgcattgttgtgaggattaaatgccataaagtgtgccaagtgcttagcaactgatctgtgttatcaatatatacagaggggtgtgatgatcaaagacgaggattgtggagagagggggatgggatacctcattctcttcctgaaatgttcagcactttgggtgtgcattcctaatgtttacacagttcaaaggcgagttcaaaatgtggaaacaacccaaatgtctatcaacggatgattggataaacaaaacatggtacacacatgcaatggaatactattcagcctttaaaaggaaggaaattctgatgcatactacaatacagatgaactttgaggacattatgctaagtgaaataagccagtcactcaaagacaaacactgcaagattccacttacatgaagtttctaggatggttaaattcatagaaacagacagtagaatgggggttgccaggggctgggaaagaggggaatggggagctaatgtttgatgggtacagagtttctatccgagaagatgaaaaaattctggagatggagggtggcgctggtggcacaacattgtgaatgtactgaatgccactgaatcgtacgcttaaaatggttaaaatggtaaacgttaaattttatgttgcgtgtgtttactgcaattttggatggattgggggtatatgtgtgagaaaagccatgaaaggttagtgccctggtgaaagccagggattctattttctactccgctatgagaaggcagccagtttccatacaggggaaggggagagagagagggagagggatggggggatagagagagagagaagcaggagaggagggaaaggagaatggcctgggctgtcagtgtaaaacaaaaaatacaaaagttggaggtttttcagctctgaaaatgcaacaagcaaggagagtaggctccatccctaggtgagccccaaagcccacttgggccacagctatagcctggctgggagaccacaaaagggaaggaggaggtaatttggactggcctgaggtaaaaattgcagagatttgcaagtgcaatcagctcttcaactccccaccacttccaaggcagagtgggtgggaccagactcttctcttcctccaatcccactccttccaggctacaaggggcccctcaaggctgcccttctcattcggttccagctgcctgatttccctggagaggaggttgtggaggtggggctgccagtccctacatccctagcagacccacctcttcacgggaccatccggaccctgtacacgtggaccctggccgtgtagacacacctgagtccaggaacgacacaagccgcagggatcccagcctaggcacggaggtaattaggcccgtcttctctgctcctgaagtaatgtttatttgtctttcaaattctgccaaccaaaatggcttaggctgtgatttaccgtcacaccattatgtcatacttccttactgcttttatgaccaagaaagactccaggcacagtagccatattatgtcccagcgaactcctgcccaaattaagtcactgtttctggtccctatcgctggtcaaatatgacttctaagggtaattgctgttttaggggcacattttaaagcaaatgcaaaaaataatgaatgtacctattttgtgactgaaatttgcatctgtctttttaccctctcccggcaaatatgttttatgtttatttaaacagtctttaataaaaatctacagctgcaaagcatcttactactcaatgctttctggttaagaaaattgcccataatcacagtggactttactattcataacagaatattatttttcatcggtgcatggctgcatcccaatgtatgagtgttgcaaatgcaatgtgaggcttatctgaggtcggaagctcttcattcattcatttattcaatccatcaacaaacttttttgcggacttaccatatggggtttgggacctttggggaacagggggcaagcatgggcagaggcatgagagagcaggtcactgataggacaaaggtagccattgtcaaccacagttgatgtattgtgattggttggaaagtgtgacacaagtaatttgttactgataataattaatgtaccagagttgctgaataatttactttagttgtaagttagagtggattcaaggttatctttacaataatagcatcactctcacctgcttgcatttcagtttgttttgatgagagttagagaaaagggtccaattaatagctgcggattccccaaggacactcatgggagtgtgtcatgcatgtgcacatcatctgtcagttatatcatagttgaggattatcagagtggcctacaaggcgtgtgttatgtgggagagtggagagagatgaaccgggagaggcaggatgggtagatacggcttttcagagcttgcataaacacagtttcaggtggattggcccccaaattttgcagatctaattgtcagtaatgtagagctactgcttgtttatcaggttccagtatttccccaagtacagagatgtgatcttaggtaaagtagtgactgtcaactcatacttgtgaatttgacctgtcttggagaacctgtaattatacttctcagaatcaagtacttctagcactggctgtgttgcatgttgagcttcttagaaatgagaatgtgacccaagaggtagcttccaggttaggtttcgtggggtgattgtgccgggaccacatttatctgtcttgaaaaacagatagaaattctcggtcatgagtcaaactagaaaaaggaacttactaataatggatttgatatgctatttctactgggaagtcagatggggtatggggagctgttggggtacagagaaggagtgtctacttttccttacctttccaatataaaatggatttctagaatattggaaatgacacctttcatgaaaatagaataaatgatgagcttggtgttctgatttgaagggtactagaactgtttccctgctcctaaaaatactctcccactgctgcttgattttctaatattagaaattgtggtagaatctctttttatatgtttacaaattatgctttgctctgttcaactagttttcattttctttttcaaatgtatgctggaggaaaagaggatagttcttctaaaaataagaagcacattcaagaatgagctggaagcctgctggaattgttaaggaaaccaattgtgtgtagatgcgacctcagtaattaatcagtgaacatctagcagccaaatatctgatgggagggaggaggccctctccttagagagagggaaaatgactactcccttctgattgaaaaagcaccatcccagaccttcttgctgctgacatgcagatgtacatctggctgtaatctctcactccctgctagcctttgccaaactgtgtggaacagaaatccagtttctcctccatgtaaagcgacagagagaaattgaatagttagatagttaaaattctgagcactggctaggaaaaggaacatgcccaaagcaataaaaagactctcacttaaaaaactgtggctgaagaaagatttgagcagtttaaacaactagtggagttgattggggtgaagggagtagaagtctcaaagccacagacaagccttgatactctgcagacaagctaagaaatatttaaattgtgtgaaatctactcaaggctgatgaataagatagaataagagcttgataacatttgaaagaatttatttgcacttaagtgtctgtgtttctataaatcttgctctaaattttattttatgtggtgttgttttaaaaacagagttatttataaagaatgaaagcataattgagtggggaagtgtgctctgttccctttctccgagctgtccaacctaagggaagactatcattctgtcaaagtggtggtaacttaatcaaattgcaggactagtacataggaggaaaatgatgccctttgaagctttgccttggaaacccacacttcataagtgacaacaaatacaacagtgcctcaacttttggattaaatattgcagccttctttaaaaataaaaaatgcctctggataggttaacatatagagttattagtatcttagtacagtggtttcccaaactgggtatttaacacacgtttcatttatattgagaacttttaaaattcagaaaagtgcagagaagagtatagcaaacacttgtgttctcaccatgcagaggagaaatacactactgtatttactgtgtcttccattctttttaaattaaaaaaaaagtgctacatgaaaagttgaggccccctttatctcctgcctccagtcaactcatttttattaatttggtatgttttcttccaaactatgatatacttttgtatttttttaaacttagcattatgttcttgagatcagtccatgtgggtgcctattggtctagttcattcttactgctgaacagtaacctatagtaccaccacagcacatttaatttattcattcctcctttggtggatatttatttccaaatttttagtattagaaacaaacaacttgcaataaacactgagatatctgtgtctttgcacactggattggaatttctctagagtatgtaccttctagaaagtaagatttctgggttaaagagtacatacacttttagtttttctgggcactggcaggttgctctccaatgtggctctaccgagtaacagtcccataagtcgtttatgagctcccatgacaccataccattgataacttttgagttttaatttttgcctgtctgatgagtaaagacagtatcttgttttgttgttgtttttatttccttgagtactagtgaggttaagtatctttgcatatatttctagaccattccagtgtcttctgccagttgtctgttggtattctttgctcctttttccattgtgttgattgccttttaaaattgacttatagcatttattttatgtcttttttgactctgtttctttttcaattacatgtgtggcaagtgtcttctcccactatatggcttatctttaactttatactgtcattttttcttatagacattataatgtttaatgtggtcacatttaccagtcttttctactaaaatttgtaagttttgtgtgtgtgattaatgaattcttctattctgaggtcataaaggtattctatatttgcatcaaagtgttgtaaaattttgcttttaacagttagatctttaattcattttgaattgatttttatgtagggtttgaataagttatctaattgtatcttttatcatatgaataattttaatgccatttattaaataatctatatcttatcctccacgatttataatcaatctctgtcctttacctagttctcatagacttacctgagttgtttgtaggccctttttatattccactggtctatttgtttatccatctgccaatactatatagttttattttttattttttgagatagagtctcgctctgtctcccaggctggagtgcagtggcgcgatcccgggttcaagcgattctcctgcctcaggctcccaagtagctgggactacaggtgcacgccaccacacccacctaattttaatatttttagtagaaaccaggtttcaccattttggccaggctggtctcaaactcttgacctcaagtgatccgcccgccttggcctcccacagttctcagattataggcgtgagccactgtgcctggcctacgttgttttaatgccatgacattataataagccttaacaatgtgcccttcactactcttcttcacaattgtcttgtatattcttgatgccttactattctgttacaatcttattctctgtgtaaatcttctgtgtaaattaccttgtcaaaaatccagaaaaatcctgttgtgattttggttgaacttgcatagaatttacagaccaatttaaagaaaattgccatatttgtgttgagccttcccatacatgaacatggcatatatctcctttttgaggttactttattctaaactttttatttcaatataattatagattcacgggaagatgcaaatatggtacagagaggccccctgtaccattcactgactttctcccatgattatattttacataactagagtacagtatcaaaactaagaattcgacattgatacaatatgtgtgtatataattctatgccatttttatcacaggtgtagatttgtgtaagatacagaaggccagacgcagtggctcacacctgtaatcccagcactttgggaggccgacgtgggcggatcacctgagtttgggaggtcgagaccagcctgaccaacatggggaaaccctttctttactaaaaatacaaaattagtcaggcgtggtggcacatgcctgtaatcccagctacttgggaggctgaggcaggagaattgcttgaacctgggaggtggggttgtggtgagccgagattgtgccatattgcactccagcctgggcaacaagagcaaaactctgtctcaaaaaaaaaaaaaaaaaaaagatacagaatgattccatcaccacaaagatgtccctcatgctacctttatggttacacccaccccaccctatctctaacccccagaaatcactaatctagtcttcatctttacaattttgtcatttcaagaatgttatataagtgaaataatacagtatgtgactttttgagattacctttcttcattccctggagattcatgcaagttgctgtgtgtgtcaatagttactcctttctattgccgagtctgctagtgacgaattctgttagttttccttcatctgaggatgtcttgatttccccttcattttgaagaatatttttgctgggtgtagaattctgtgctggcagttctcttctttcctggtatggatgtaccatagttggtcgaacccgttcacttgttgagggacgttttggttgtttctggtttgagtgttttctgtttgttacctctgttttttatttctctgttttcattttcttgccttcctgtgtgttacttgaatattttttagaattctattttggttcacctacaggatttttagagttatgtctttgtgtagctttttttgtggttgctctaggtctaacgtgacatacacataacttattacaatctactggtgtcatcattttaccagttaaagtatagcaactttattcctttactttctccagtttataattatcttaagtattttgtttacatacattgagaaaactatcaaacaatgttttactttttgctttaaccatcaaacataattttaaaaaaaaatcaatagaagaggacagcctattgtatttatccatattttttgttctttctttgttctttctcattcctgatgctcaaagattccttctatcacttgtttctgtttggagaacttccttcagccattctttaaatgttagtttgctatcataaggacagaaaaccaaacaccccatgttctcactcataggtgggtattgaacaatgagaacacttcgacacagggcggggaacatcacaccccgtgagccactgtgcctggcctattctcttggcctgtcagaggatggagggctgggggagcaatagcattaggagaaatacctaatgtaaatgacaggttgatgggtgcagcaaaccaacatggcacatgtatacctatgtaacaaatctgcacgttgtgcacgtgtaccctagaacttaaagtataattttaaaaaatgttagtttgcaagtgataaattctgttagtgttcctgcatctaaggatgtcttgattttcccttcattaagaaggatatttttgttggttgtagaattctgtgctggcagttcttttctttcagtacttaaaaaataccatgtcatttccttgtaacctccacagattttgatgagaaatctacagtcactgggttttggcctggatttctttgggtttaatgtatttgggatttactcagctttttgaacctgtaggtttgtcttttgccaaatttgagtaaatttcagccactgtttgtttgaatacatcttcagcctcaccttttattccctctccttctgtgactttgatgacataaatgctttgttatagtgccacggatccctgaggctctgttcatacatatttttcagtctactttctctttgttgtttgtccttggtaatttctatttttgtatcttcgagcttactgcttcttttctctatctcctccattttgctattgggcccatccattgaagttttaaaattttggttgttttctcattctaaaatttccatttggttcttctttatatctcctattttctttgttgagattttttgccctttgtttcaagtgcatttataattacttgttcaaaggttcttatgatggctgctttaaaatcgttgacaggtaattgtaatatctgtgtcatttcagtcttggcatctgttgaatgtcttttctcattcaaattgagattttcctggtttttggtattataagtgattttttattcaactttgacattttgggtactacattatgagactggttcttattgaaatcttctgttttagcaggcctcctctgacgctgctccagtggtggaagaggaggcaccacctcattactgccagctggagatggacgtacagctccctatgtggtcgctactgtcactgtggagaaaggagatttattacagtcacagcttcccacttggccctctccaacaccacactggctaggtgattgggatacttccttacagcctagggaggggaaaagtcagcctccccactcagcctttgctggcatgaataggagtgtttttttctgtagatatttgccgggagtagagagcagttattgttaaaggtgttctgttctacacggttgttctttttctgatacactggctagcgaaagcaggcttatgttggggattttttttgtctgtgcttgttggtattactgggttgctagcttctctagtacccagtctgggatatatgaggcaaaaaggggacagaagaaactcaccaatacgttgcctcagttcccaaggtccctagccagtctgcccttttttctctacctgtcagagtcatcttatatctgccttatacataatgttcagggtttttagccgtacttggcagaaagagtagggaaaattacttttatttcatcttgtcttgaaactgaagtataagatcatcttttatgacgttcaaaaattttaataattttctccataaaggtcttatacaactgttgtgtgtgtatatatactatgttgttaacagtgttaattcagtgaatggaaatggttaccactctgtaatgcatgtaataaagcacttacatatacttgtttaaaagctgtttcttggaatgctactcacacactgctcacgctcctagctctttgctaataatatgtattttggataatatcactcctctttaagaattacatattctaatttattgtttctggtatatttaaatgatactgatttttttcatattaatatatccagcacttttgttgaatgctcttattagttctaacagtttctagatactcttgcttttttttttttttttttttgagacggagtctcactctgtcaccaggctggaatccagtgatgtgatcttggctcactgcaacctccgcctcctgtgttcaagcaattctctgcctcagcctcccgagtagctgggattataggtgcctgccaccacacccgactaactttttgtatttttagtagagacaggtttcaccatcttggccaggctggtcttgaactcctgacctcatgatccacctgcctcggcctcccaaagtgctgggattacaggcgtgagccaccgtgcctggccgattctcttgcattttctgtataggcaatcatatcatctgcaattatgattttttcctttttctaatatatatatattatatatttatatattttatatattagtgtgtgtgtgtgtatatatatatatatatatataatttttttgagttggagtctcgctttgttgcccaggctggagtgcagtggcatgatctcagctcactgcaacctctgcctcctgggttcaagcaattctcctgcctcagcctcctgagtagctgggattacagacacacgccaccacgtctggctaatttttgtatttttttggtagagatggggtttcaccatgttggtcaggctggtctctaactcctgacctcgtgatctgcccaccttggcctcccaaagtgctgggattacaggtgtgagccactgcgcccagccatatatatatattttaatatgtttaatactttatattatatttcatataatatataaatattatataatatataaatatatattaaagtagaatactttaatatgtttgtaattattgtgatttctgttatgcttagatttattttttcattttgttttatatttctattactatgttttatttttttttgttgttgttattttgtttttttttttttgagatggagtctcactgtgttgcccaggctggagtgcaatgttgcaatctcagctcactgtaacctctgcctcccgggttcaagtgattctccttcctcagcctcctgtgtagctgggattacaggcatgcaacaccacgcccagctaatttttgtatttttatagagacagggtttcaccattttggccagtctggtctcgaattcctgacctcaagtgatccgccgacctcagcctcctgaagtgctgggattacaggtgtaagccaccacgcccagcctatatttctattactatgttttacattgcttcttttttatttttttctgccttgattgagttgattaatgtttttatttcccctgccttcttctgaaattttggaagttgtatttctgttaatttagtggtcacctttaaaattttacatacacccacggactgcacacacacaaaaattcaagttaatgtgtatattaacttgaatttttgtgcagtccgtgggtgtatgtaaaaattttaaaggtattaaccagagagagaaaacagattgcatagagatatatctccatttagagatagagatagagatatatttcgatttatcctttgagtaataaaataagctaaatatgttttaactctaatcttctactctctatcttaagtgggactgttgggccacattttggtggcattttcctcttcaataccccccggaattggtcattgtaaccttattattattgggattctttttttaagaaaaaacagctttattgagatatcaattatcaccattttagaacatcatcatctcaaaagaaaccctattttttacagttgaggtttatttaaatttatctatatgtttaccaagttttttgctccattgtttcttgaactccagtcctttattgtaggttcagttttcttcttgatgtacatcatttaatatttttttagtgaaggcttatcactgacaaactctcatagtctttgtttaaaagatctcattttaatgaccctcagttgtgaatgataacttctgtatgtaaaattttaagttaatgggtattttccctcaactttgtaaatattattccattgttttttgagttctattgttgctgatgggaagtgtattatttattatctattgtcagtctattttttaatgttagtttttgaatgccatctgtcttttctctctggttaaaaattttctatttgttttcactatgatttgtctaggtttgtatttatttttattcatcttaagatctgggcttcttcaatctgagttcctattgttttacattagactacattcataatacattgctttcaatttacagtttctgtttttaaatagtggatcaagatctaaagacactaaccatagcagccttcccatcgttgttattccctcagtcttttatggccatcttgcctatacacaatttaacaccttttttggttgtgttcttttctattatgcctctctaaagtattcaactttcttagaaataactcttcattttcatacccatatatcatctgtttacagaatatttatttaaattacatagcaaagctatcataaacaagattaggaacaaataaaattggctcttagtaaatatccaacttaactggtgtgagcaaaagtgcatgggatgtactagagaatggcctactagcttcgagcattcacaatgttttctaaataatttcaactcttgttttagattcagggggtacatatgcaggtctgttgcatgggtatattgcatgatgctgaggtttgggatacaaatgatcccatcacccaggtagtaagcatagtacccaacaatttttcaacccttgcccccctctctcactccccactctagtagtctgcagtgtccattgttgccatctttatgtccatatgtactcaatgttttagctcctacttataagtgagaacatgcggtttttggttttctgtccctgcattcattcacttaggataatggcctcgagctgcatccatgttgctgcaaaggacttgatttctttactttcttatggctgcatagtattccatggtgtatatgcaccacattttctttatccagtccaccactgatgggcacctaggttgattgcatgtatttgctattgtgaatagtgctgcaatgaacatgcaagtgtgtgtgtcattttggtagaacatttagttttcttttggatatgtactcattaatgggattgctggacaaataaatggtagttctgttttaagttctctgagaaatctccaaactgctttccacagtggctgaactaatttgcattcccaccaacagtgtataaatgttcccttttctccacagtctcaccagcatctgttactttttcactttttaattaatagccattctgactggtgtgagatggtatttcattgtgttcgtttgtttttgagatagagtctcactccatcacccaggctggagtgcagtggcacaatcttggctcaatgcaacctctgcctcccgggctcaagcaattctcgtgacttagcccccgcaagtagctggaattacaggtgtgtactaccacgcccagctaatttttgtattttcagtagagactgtgtttcaccatgttggccaggctggtctcgaactcctgacctcaagagatctgcctttcttgggctcccaaagttctgggattacaggcgtgagccactgcgcctggtctcattgtggttttgatttgcatctctccagtgattactgacgtggagtattttttcgaatatttgttggctgcttgtatgtcttcttttgagatgtgcctgctcatgtttttgcccactttttaatggcgttatttgttttttgcttgttgaattgtttaaattccttacagattttgggtattagacctttgttggatgcatagtgtgtgaatattttctcccattctatatgttgtctgtttactttgttgataatttcttttgctgtgtagaagctcttttgtttaattgggtcccacttgtcaatttctgtttttgttgcaattgcttttgaggacttagtcataaattctttcccaaggcagatgtccagaatgatgtttcctagattttcttctagaatttttatagtatgtggtcttgcatttaaatttttgatccatcttgagttaatttttgtatatggtaaaaggtaggggtccagtttcattcttctgcatatggttagacagttatcccagcaccatttattgaatagggattcctttccccattgcttatttttgttaactttgtcaaagattagatggctgtacctgtgcaactttatttctaggttctctattctgttccattgatctatgtgtctgtttttgtaccagtaccacactgttttgattactgtagccttatagtatagtttgaagtcgtgtaatgtgatgcctctggctttatcctttttgtgtaggattgctttggctattcgggctcttttttggttccatgtgaactttagaatttttttctaattatgtgaaatatgacattgttaatttcacaggaatagtgctcaatctgtagattcctttgggcaatatggaaattttaaagatattgattcttccaatcctgagtattatatgtttttctattagtttgagtcatctataatttcttttagcagtgttttgtagttctcattgtagagatctttcatgtctttggttagatgtattcctaggtattttattttttgtggctattgtaaatgaaattgcattattgaattggctcttagcttggacattattggtgtatagaaatgctactgatttttgtacactgattttggatcctgaaactttactgaagtcttttatcagtttcaggagacttttagtagagtctttagggttttctaggtatagactcatattgtcagtgaagagagatagtttgacttcttttcctatttggatgccatttatttctttctcttgcctgattgctctggccaagacttcctcaagcattcatagtgtcatacaatgtattttacaggaggaatggaaagagttgattaatcaggagagtaatgagtaaagaagttagataaaagaacttctactgtattgagcatcttctatgggccaattactgaaatggtatatttaagttataatagtaaataagatagacaaatcttttgctctcatggagttaggggagaagaaacaagtaaatatataaataaaccagatagttaatttcagataatcataagtatgatgaaggcaatcagacagagctataaaatagagggtaactgaggggtggaggctagtctatatgaggtaatcactaaagacctttctgagcagtgatatatgaggtacaatctgaaaaattaggaggcaggaacctggaaattcagaaggagagtgttctgggcagaggaaacatttctggtctgaggcaggaatgagcttactgtgctgaagaaatagaaaggactctgtgactggtgtttcattagcagaagagagtgtacatgagatggggtagattagttacaccagggctagaagaaacagggggtttgtagacttgtaatgattttttatttgatcttgagtgtgatttgaaatcaagggatttcaggatggggataacaagaactgatttatactttttaaaagataacgttggctaatgtgtagggtcaggactctagaagggcaacaggtgaagccaaaagaccagttaagaagctgtcttagtcagtttgcactgctataacaatgtactgcagactgggtaattaaccaacaacagaaattttaaaaaataaattttattgtgtacatctgaggtttacagcatgatgtatgggacacatatagatagtaaaatggttattgtgatgaagcagattaacatatccatcatctcacgtagttactttttaacaataggcatttattctcacagttctggagactgggaagtccaagatcaaggcactggcaggcttggtgtctgtgaaggccttttttccacttccaagatggtgccttattgctgcatcctctggaggggaggaatgctgtgtcctcattaggcagaagggcagaggaggcaataagggacaaactccctctatcgagcccttttttgaaagtatttaatcccattcatgaaggaagactcctcatgactcaatcacctcctaaaggccacacctcttaatactgttggattggggattaagttcctgcacgaattttggaggggacaaaaaccattcaaaccatatcagaggccaatgttgtagcctggatgagagattgaagtggcttggattaagatgacagtaagtgaatatcatagtaaatgtagacaaaaaggtagagatttgaagtatattttggaggtagacttgaaaagacttgatagattcaatatatggaggctgagggtaaggaaaagaggagaaaccgggttggtgccttattttgggcctaagtgggtggatggtgatgccattttctgaattatggaagaccagcatgggaatatattttaggggcagaattaagggttctcttctggtcacattatatttgaaattctgtagcagctatccaagcagatattttaagaagacagttggatatgtgagtccagagctcaaggggagatgtcaagattgtaaatatcaatttagtagtcatcagcatatagataatgactcaagtcatagaattgtatgagatcatctagggtgtaatgacactagaaaagaaggctaaggacttagccttggaatactttaacatggagagatcaagcacagaaggggaagatagcaaaagagactgagaagaaacagcaagcaagataggatagaaccagcaatttatcctaataagatgactggacaagcatgtaaagatataaatgcagaagtgtattcatcacagtatttttttcttttttgagacggagtttttgctcttgttgcccacgctggagtgcagtggcactatctcggctcactgcaacctccccctccaaggttcaagagattctcctgcctcagcctcctgagtagctaggattacaggtgtgcgccaccacacccggctaatttttggtatttttagtagagacaaggtttcatcattttggctaagctggtctcaaactcctgacctcaggtgatccacccacctcagcctcccaaaatgcagggattacaggtgtgagccactgcacctggcccacagtatttttataatagtaaaaattggaaataaatgtctatagagagatagttaaatcatggcatgcatatatatatatttataacagaatatgctaggcaaacattaaaacgatgataccaatcaatatttattgacatataaataagtccataatacattcttacatgcaagagcagattacaaagtagcctatatagtatgaagacatcagtgtaaaattatatgtgtgtatgtgtcagagcatgtatgtaaatagggtcatgatggtagtttttgtttttttgttttttctttttttagatagagtctcactctgtcgcccaggctggagtgcagtggtgcaatctctgctcactgcaacctctgctgccccggttcaagcaattctcctgtctcagcctcccaagtaactgggactacaggcacgcgccactatgcccagctaatttttgtatttttagtagagatggggtttcaccatgttggccaggctggtctcgaactcctgacctcaagtcatcctccctccttggcctcctaaactgctgggattataggtgtgagccactgtgcccagctagtgttttgtttttccactttgtttatagatgtatcccttgagcctaaaacagtgttaagtatccagtagacacagatgaatatttgttgaaggaatgaataaatgaatgaatgaacgaatgaatgaatataaaactttaaccaaaatattaagagtggttatctctaggtcctgtgataaaaggtcttctattttcctttcttttgtattgtgttagattttttttttacaatgaccatacattctttttatcaggaagaacattcttttaatttttgaaaccatcctcacctttatcagttacctatgacttccaagtacccctatttggctgaattcagagcaaagcaattgctttgctactgaaaatccatatttaggcaggtatatcagaatgataacagggagatatgttgtctcttggagagctggaggcagaaaaggtgaactaggagtgaaggtcaacagcaactgtgagaaagaaagacttgtgccttggaagaaagttgagctgagattttctttctttctttctttcctttttttttttttgagatggagtctcgctctgttgcccaggctggagtgcagtggcgcgatctcggctccctgcaagctccgcctcccgggttcacgccattcttcctgtgtcagcctcccgagtggttgggactacaggcgcccgccaccccgcccggctaattttttttttctatttttagtagagatgggttttcacagagttagccaggatggtctcgatctcctgacctcgtgatcctcccgcctcggcctcccaaagtgctgggattacaggcgtgagccaccgcgcccggccaaacagacattttcaaagcagaacaacatagaacaagaagctgagggccgcttgcaagcctgaccttggggagaagagcctgtggaacacttagagcacagtaaattttgcaatctaaattcttgattctcagttgtgtattgatacaggagttaataaaggagccaagctacgactcccagattgtgctgtttggtatagaaatgcctaattccctttggtggttgcagtggaaaatgaaggcagtcttctgtatgaagaagtccctggttttctatttttctctgaggctgtaagaaaaacaagttggattatgttttttgaataattgattggatattctttgggattccacgtatgtgtttgcctaatctctctctatcctcccctccactccccctcattacccacccactccccatcaacagaaaagacttagatttctccagtatgggaggttagtctcctgctagcatttctcctgtactgtaccatgcaaaatgagtgctcatttccttcctggccttgagttacaaaagtccctctgctattgcccaagtcttggaaagtgcaggctccaggaaaagggtggtggtagatagagttgccagataaaatacaggaaagccagttaaatctgaattttggataaccaatggattttttttgtataagtatatcccaaatattgcatgggacatacttataccaaaaaaagtcattgtttatctgaaattaaaatttaactggatgtcttttttttttctaaatctggcaatcctagatggagaaaaaaaatccctcttgtgatacaagggttttctcagtgcttttcatctaaaacttaccagatgtttcttagatggcctttcagtttacaaaaggggaaaataactaactgattaagtcaaggttagactgcgaatcagtgctagggctgaaaatttaagttttcaagttttccagcacatgatctaattcagcaaacttttatcaataatttattggctgtaaggaaacaggattagaatgatcacaaaggtacatattcccatgaaaagtaaatttttaaaagattctaaaggtgacaagcattaaggttttactttcctccatggtcatgactgggcttagcctctaaagaagtgtttttcacagtgtagtctttattctacctgcatcagtatcatctggaaagcagtctgtagatacagacagaaagtgaaggtaatgggtcctttgaaagtttgagttcctggtctttgtcttgtaggcaccacaatcacttcctccatttccacagcctttagttccactaacagcttgtatctggagggtctcaatgctagagagctttctggttattttagtttttgtttctgccattacatattataaaaggtaatttattaaaaggcaaaattgaagagggatttgatatcccccccagcacagccaaataaaggcatccaaaataagcattagatgtaaaagaaaaaatgattgacctggcctctattaaatcaccaaatttaactggatcttggaatctgaagaattctctatcacctatatctcttgcattggggccttgccattccacaaaatttattctctacttttcctgggcctgactccaagagaactaatcatatcttaataatttggtacagagtcacagtgtaattgctccaggtcagtattgtatcctatcagactggagtacagaaatgattatcaaacattaaaaagaatgaggtcaagaggtacaacctgactttcaaaacatccttaggatgtatgtatagccagaatgacttttttagttgaggaattatgatgatctctaataggacaaagcaaatgtattcagtcagtctgtcatttcagatttatagcaaacaatctcacatttggtcaattcctcaatcgtatgctaataaaaatgatataaatagtttggtaactcaccctgtggtactaaaatgcaagtaacccaagatgggttggctatgttgttctcatctccctttatcaccagagacttgattcttcttagctggcattatatgctgccagttgatacttgcctaaatatttccttcgtactcagaacattatagttactttttcaagcttcaaatatttccgactaattctagaaatacgtgaggtatgcctgaaacgctgacagctgtagcttacacccaaaatagtcaggcctgctcaaggagatgcattgagcaaacagaaccaggagtttgaaggtgacagctgaacaggcatcaataggaaattgccaggtgctcagctgatccagctagggatgggaacagacagattccatttctagaaatagcacagaggatgccaacaggtcataggatataagctattgcacaaatcttcccttccatcttctagggagcttggagggtatcttaggaaccttaaacttgctgaaaaaaattaacatgtctaatgaataatttttgatattgacttgttgagcccctattagtttcaagttactttcctaggcactgttaggggcagggatacaaagaagtttagacacaggctctactcacacagagttttcacaccagttgaggaaacaagacccatatggcaaagtcctgtcttataaggggttagattcttgatgagaaaaaaaaatcatttatagacaaaacgcacctcgaaaattcctttgagaggttcaatattagagacagacataccatttttcaataagtcaaacacagttgttttttttcccctacaaccttgtaccagatcactttttctttaattgagaaccaagccaattggcttgcacttagaggctgtgttgaattttttaaagcgcacatatttaagcatgagaatctcaccatgagaaacccacaggaactgacaccatctgaaggaacatcagattcacgtctctcaactcaatttaactccagggcaaaacttgttgagtagaataatagttaggattgcccacataattttcaattgcttacatgatcttgctctctgtctctctctctctctctctcaatttcttctgtatatcagccaactcatataagaatggtgtacttgtgatgtgcctctccatacccacgtaacaagacaggagaagctatgcgaaggcgagcttcaccacttactgactgtatgacgttggcccagtgaaccctctgagccttcatttcctcactaataaaataaggataataattgcatcttccttgcaggattgttctgtggattaaatgcagtgatatttgcaaaatgcttagtctaatgcctggtagcataaaagcctcaatattaactattacagcaagtggtttatatgtgatgtgtcaaatgaaagagacatgccttatgtgttataacgtacataactgagtagtgtattggcagggaggggttcatgggtgagatcacttttgaacttggtgagatatgggtaatactggagagctggaggcaggaagggagtgatggtggaagcagggagaaagccaagacatggatgagtcaggatgtctagagacctgaaatacatgggggtgggcagtaaagcctgtggaagggaataataaaatatgctgttggaggaggaagccagggccatgtgattgaaggccttgaatgccaggatgtggtgctggaagcagtgaagaattgtttgagattttttactcaagggtgatgggatgataaaacagttagtatactttcaaattcagctcatctgtcaaatccagcttacagccacttccccctactgcatctcactcttccttttccaaacattgttgacaccgattgctccccttccccctaataattttgcccttaatctaccaccttatctcaaggctaaatgttttctctgagttgtgcgtgtggggggagagagagagaaatatttttctccaaagatagggtcctgcctttcacttcctctgtctgccacacagagtttagcacattgtggactctgaaggaataatttatgagttaactcaatgattgattatgggcatgcctaattggagcaccaaaagcaacgtgtcccttagacaggatgagtactggctctgtgaggaatgtagtaaaacgaaaggtggacagggttataggtcataggctcattcctgaagccccagaatcaagttttttgaacattttcctaaatgtctttgcctaaagacatttgttaaccaggaatctgccaagccaaacaaaggctggctggctggctggctgggctaactagtgtccttaccaggaaatgcaggaaatggaggactgtccagaaggagatgccccaaatgcagccctgtggggaagaccagcttcctcagagcccagagaaggaagagaaacagcctctatctttaatcacagctattcaagaaacaggctctgctgagagcagcagtctctaggggggaaaaggacagtctttgcaaaggaaactttttttctaacctgaggtcaagaccaagtagttaaactttgaagggactgggaaggatagcctgggtatgtaatgaatggaaagagcctattacaccctggttcagaagaaccacaactccatgcctgtcaccatccgtcttcccaaatgctcatcaaatgaaataacccatctgtgacaaatcttcatttgtccaatgtggaagtgcaaagcttttctaatatacatctgcatgttatcctggtttgcaaaagcctccaagcacatcaacaaaagaagctgcttgaaatggattctggttaggacttgtcccttgctcatgttcaaagtgatgtcgttgctgacaattcagaactctcccacttgccaccttctccaggctcccaggctgttttctgaattcccagaagaaactgtttccatggctcaaaatgaccccttcttaggcctctaccaatcagagtctcatccctcagtgccccccatctcatctagctgctagagagaacgcattcttatttaactaatgcacactaaggtgtaagtgaggtcatacacgaactagccaggtgtgtttacatttccagaagggccgtcctaaggaacagaattctaaacagtcaaatttccagagttatttcggcatgttgtgtgatgagacaagccttattgggccaactcaaatataccacatgggtaaccgcctcagccacgtctgatgccgttcctttctcttggaatattctggcctctcctgcttctctctccaaatcttatttttccttcaaggctcagctcaagtcttacccatgaagcttgcccagagcacacctggcttgaattcctgccctgctcggaagtcattgctcctcatttgttccatctgggttggtttggtttcctcgaacagatcctgagctctgtgagagcaggaatcatgttttaaacttcttgccactcttccacaactcctggcatgatgctggcctcagaggatatgtacaagaaatttttatagtaacagccatagcttctccacatgtatcagatttgagtcacagcagccctgtaaggtaggtggtattacccccattttacagaggaacttgtgaaaaaaaaaaaaagaaaaaagaaacactgctcaaaagaaagaagttaaagtcttgtctcctttctatttctggagattctcaatatatcagtcaatatgatatatacatatatatatatatatatatatatatatatatatatatatatatatttttttttttttttttttttttttttttttttttgagacggaatcttgctctgtcgcccaggctggagtgcagtggcgcgatttcggctcactgcaatctccgcctcccggattcaagcaagtctcctccctcagcctcctgaatagctgggactaaaggtgtgtgccaccattgccaccatgcccagctaattttttgtatttttagtagagacggggtttcaccatgttagccaggatggtttcggatctcctgacctcgtgatccacccgcctcagcctcccaaagtgctgggattacaggtatgagccatcaatatgatatttttgagtgtgacctctgtgccctgcactattggaaatataaaaaaggtgtagacctggagccctgtcttcaagtcagccatggaacagtgacttccaaacctggttgatcaccaaaaatacctcaggagcttgttaacacagagacttccaggtcatccccagagattctgactcagcaggtctgggatattgtcttggtattttctcaaagccacctgagggattctaataatcagccatgtttgaaaaccactgccccagtgatccatatcttctcatatatgtgaacaagtcaggtgtttctggaagagtgggaggcacagtactcttgggactgggaacacacaaacttcatattttaattatatgtttattttagtgtgtattagaaagaccataaccattccacaaaactatgatttcccagatatgatacttttctttcattaaaagtgtatttaattctgacacatgctacaacatggatgaaccttgaggacattatgctaagtgaaatataccagacacaaaatactgaaggatctcactcatatgagatacctagagtagtcaaatttatagagacagtagagtggtggttgtcaggggctgcagggagggagaaatggggagttagtgtttatgaagacagagtttcagttggggaaaataaaaagagttctggagatagatggtggtgatggttgcacaacattgtgatgtaccaaatgccactgaattgtacacttaaaatgtttaaaatggtaaattttatgttatgtatattttaccacaataaaatgtactttaaaaagcaagatagagaagtttaaagttggtaaaagtagagacggactgcagatatggcaatcaggaaagtgctgtgcaagtgactggtgtttgagaaatgattgtagtttgactccctcattttacttaggagggcaccaaggctcagagaagggcagggacttgcccaacatcacacattgagtcagtggcagggccagtactgatatccaggtctcccaactctgtcagtattttcaaatttatatcatctgattcattgctcaaatatcacggtgtcggcaacagacacaggagacacccgtgggtgctagagaagttggggagggcttgatggaggaagtaggacttgatgaaggcccttaaagatggaaggatttgtaagtcagaggagatgaaaacgggcatgaacacaaaactctatcagcaaaaatgaatttggtttctggtttgtatggagatagtgaaaatggaaccctaactggagcagttatgttttgaagtaatagaagcctctcgaacaatacattaatttggacttgatatagtaaacaataggcagcccttgtagaattttgagcacaggcgtgacatggtgaaagcaggcttgtagaaaggttaatctagcagtgaccaacaggatgcatataatgaaaccagaccagtgagtgggctcttctaggaatccagccatggtatgacagggaccagaactgggatggtgggaataagaataaagaggcaaaggtaaatcagtgactcattcaaaggcaagtcaaaggcagaacagccagaacttagtcattcatgaaaggacagattcaagattcttaagcctggacgatagagtcatagtagtgcccttaactgaaatgaaaaacaaaggaagaagaaataatgtggggcaaaggtgaaacatttggttttggacataaagagttggaggtggtaaagaaacatccaagtaaaggtagtttccaagcagcttgaaatatgagattggcccttgggttacaggaaagaggccgttaaactctcattttaaatatggatactttacacaaggatggtgttctagtgacatattcatttttgtttagcattaatttgaaagacatattgttttcataaagaaattgtggtgtaagactttgaacgcaagagaacaagcatttaaatgccttaaaagccagaaaacatcaaggaaagggtggggattggcccaagtgagtaattataaattttctcttctggaaagaaaaaagagaaaaaccatggtgtaatttccagttgtcttttcttggagctttaatgcatagaaggatttagtgtccttgtcacccaatacaacctttcaaagaactgctggatgagtatttagtaatgaacctttgggaacaccttgtatggaatccagctcttctgcaattaatgcaggatggcagctgcctgaatgattcatatcaggacatcatgtaataccacataatttgacaaagtgagaacgggagagtggacaatatttgctctgttgtctgttacatacttgctcagtgaatgaaaggctatacctccttaagcataactgacaaaactcttggacttgctaacccaaaaaattcatctctgatttctatgagtcaaactacaataaactgtctgaattggcgaaaacagcaggtttcacagaggttctggacatttttacagagagaaggactgtgggagccttttcttttaattctttcttggagtctgagccggtcatcaggaaaacttgtgaagtttctcttttagcccttccaccattcttcctgtcttctctcttctcacagcacttttgatagtctacaggctctaagttcccagagctagcacagctccaggtccccactgtgaggcgtcactaagactcataataacgattgtgtattgagaattgacaatgtgtcagacgttgtgctaggtgctatatatatatatatatatatatatatatatatatatatatatatatatatatgttatctcagtcctaaaacaaacttatgaggtaagtactattattcccttcattgtacagattagaaaagtgacgtttaaagaggttaagtagattccactaaggcacaaacccgagtctggcactctttccaccacatcaaccttcatcataaagtgataggaaagacaggggtataacctagctagccaaaagcacccagatcaaccctagcaaccagcagactctcacatcatttttttgagcagtgaagttcctagaggcccttacatctgccccctaaggcagactccactgatggcctaaagcaggggtgtccaatcttttggcttccctgggccacattgaaagaggaaaaattgtcttgagccacatataaaatacactaacgctaatgatagctgatgagcttaaaaaaaatcacacacacaaaaactcgtaaggttttaaaaaagtttacaaattgtgttgggccccattcaaagccatcctgggccacatgtggcccacgaactgtgagttggacaagcttggcctaaaggaaactagaaagatgttttctacccttaacatgggcaaggggagagttttgttttggcaggaagtttacagttactctttagatgcttttgaattaagaaattgtaacacacatttttttcttgggcatttccaatgattttgaatttgcactttgattctatctagccctgccatgactgatctgtgacagagccatgatgctaatatccctttcataatatctttccactaaaacattgatcttaagagtggcacaggatttgaggggcaatgagaagctttatgatttgcatttaccccttgttagattgcaagtctcttgaaagagtagactatcatctcttcttgcattaccacccaattctgtgtcgggattaattcatcccattggtttccaagatgaaggctaagaaccatgattctttgtcatattggaagaagaaacaggacaagagacaagcagaaattggggctctagaagggagcaaccaagagaagcctgggcttcttcccaaatttatcaagcctcggcgctggccctgaacacatggcagtctgtacaggtggccaatgcagagacttaaactaagacccattgccttctgctatgattcacaagaggttgaaggaggatctttaaaaagttacaataacataagtgctgtcctgccttaacaaagctaatcactgctgacctaccctaagcaggactgggtttcaaggggtttttccattggtggacaagactcagactgagcacgtcacactctctcacctagtattgcccgtaccaaacaagatggctagctgagatgaaggagggtttctagccagggaaacatattttctttgtttatttacttttcatgaaactatcccacagaagagtcaaaccagcaattctgccctctttagtataccctgggtttgtcattataccctgcaagagatactcttgatcaccaactttcccatcttcaaaccatagaatgacagaactgaaagagaattccaaacgcatctcttctcacacttagttgcatggatggggaacagagaggcctagagaaggagacggattttcttaaagtcatgcagtgacttagttatgggctagaacccagatttcctgattcctggatgagtactcttccaccccaccacaaggtgactccatcaatagccgacatccgattaaggacttcttggcttacgtgtgtgtcaggttctaaagtattccttcattggcttttcggcctcacttgataatccaaggctgtgtggatagtgcctaagtgtcatcctagattgttctccccagatcagttgcaatccaggccaggatggaacagtgccacaaaatcaatcctccctggcctctgcactgtgagtaaacgaaaatgaatgtctctgtcttctgtctggggctttcggattgctgagcagatgtctgtctcaaaatgactccttagatactggacaagaaaaaatatcagttacacaagccccaataagggaacacaagcttttagggtgtgaaaaagctattgttgcctagttcctgctccccgacaagagcaaatgcacaaaatattgaattttcctttttaaagaagatgtacatagagtccccgacttgaatagccttttaagccttgcgtttcttagaaaattggcttttaaacccaagcttgagcttctctgaggagctcttaacctgttcttccatgaggcattagattctggttaccattttttccattcacatgaagtgagcactatttcctaagtactaaccaaaaaaaaaaaaaaaaaaaaaaaaagggacgccattttgtccagcctgctgtattccatatatttccatgttttacctccccttattcaacagactgtgacccagtgtgggcactatttttggagctaacctaagcagtagaactgtggcattgggatgaggaatttgagaagggattcctatgtatctggtgctaggctcagctcttgtttcactgcaagcctcagcccagtaaaagttatgatcttgtgttgctacctaatgctgcagatgtctagttcctgtttgatccactttcaacaactcaaatatagcaggggacacaagttggagcatgttcctcaggaagggaacatgacacacagccactcactcagcagggctaaagctactcctctgtagagactgacagctgctctgctgaggccctctggagcagctagtcagtctcccaagacagggaaaagccatttattctcctttaccaccttttgccatgaatagagaaaatcgggataagactgtctttcttctgcatagtccaagtcagggataaccttgtgtacactttatgggatttgagggatatgcctagggccagctttaggcgtagctgaaatagatgaccatgtccacattttaatgcaagggctgtccaataaggctctaattatctcccccctccagccattatgctggcagaaatcctagaccagtcatgtcaatcatggagactaccatttctaccatttccttctaagggaaactgcacagtcccttgctgaagaaaatagccctaaattattacttgagaatgaagtggtaacttcttagattatggatgagtacctgacccaagctgatggatgacttttgtatgaagtggcctagcaagaaaaaaaactgtacttagtaggacaatgggaagtagctaggacagatgacctgtctttcgaggatgtaagtatgaaaatactgagattttcagtttgtgggcagcagaaatgtaaatgaaaagacactaaataaaaacctagagtgttttttttttttttttttttttagtggcagagcactcagtaacattcaggatattgaggagatggtaagattcaatccctagaactctcttccttcctgaatgatgccaattcctgagtttctactaggagttttagaaggacattcatttgccttcatatagttgggggagaggctgaactatgcaaaaggtagtttttctattgagggttatatggagaaatttttagcaccaggtgggctcccttcctttggaatttgattgagactttggtaagcctaccaatctctttcacatcctgtagaagagtcccattctcagtctccttctcccatttcacccctcctcccaaaatgtagtcccagattgatcatcacttgatgtggccagcttcccattaggaccacaaaagatcaccccctctctttctgactgggcgttccaagccagaccagtctagctagagaatgtgcaagggacttctgataccttgcctgtagtggacatgccaatttaactttttctttcagacctagtctaacatgattgcagatgcccagctcaattttcaggccttatgcatggtacccacacagactgatgttggcacaaagtgaggttgggcacagagccagtattgactttgtggcagctccggaagcagacagcctttcatggaagtgtacatcattccaagtctcttgtcacaatgctagtgtggatggtttcacagtatttttcaagccacatagacactccatgtttgggctcagtgtcagggacaacactctggaagaaccacatccctgactttaccaaaagccatccccatcatctgttttcaatctgggccgaattagcctgtgatgggaagcagagaaagataaatggttcaaggccactgtttgcaaacccctggcaatctatgatggaaaagatttgtgacactcagatctttgtgccatcacacagtgagagcagaccagagtctcttctagtcttcactgagtagggccatctgaaccagtttgtggaattcacctctctatttttgttgtttatgttggagataagtaggcccacaataacagagaaaagataccctaactgacatctctaggatctctgtagatggaggcagaaatggccgtggaaagcctgagatgattccaaggcccactagattaagccaaatctcattttattgctcaacccacacaccccaaatcaatcaattgcagcttcaatcacaggagaaaatgaaaactttaaagctatctacttcttgatttttctttgtgtactgagacttcacagaaaattctggagatggagggaaggatgaagaaagtattgaaattgaacaaataaatcacacacaaaataatattgcacatatttcctgggcttgtctctaccacttataaagtgaacagggatgaaatgacatcttggtttcacagttgaagagtccatatgctcttttactttatctccacttactgagtttggcttttaaggggcacttctcctaggccatctgattagctgacatcctctagtcaagagcagatagaggccgggcatggtggctcatgcctgtaatctcagcactttgggaggccgaggggggcagatcacctgaattcaggagtttgagaccaccctggccaaaatggtgaaacctcatctccactaaaaatacaaaaattagctgggcgtggtggtgggcacctgtaattacatctactaaggaggctgagacaggagaatcacttgaactcaggaggcggagggaggttgcagtgagccgagatcgtgccactgcactccagccagggtgacagagcgagactccatgtcaaaaaagaaaaaaaaaaagcagatagagaggtacttgagacacccatggcaagaccaggatccaataactgtgaagaaaagagaaggagtcatttggccaaaggacccttcctttccccttgagcccctcagaacacacctaagcttgcttgtctccctggctggagcagaagccagggctccttgccccatccagctgccctgtgaagagcataatttgtcaaagttcctattcttcaaagttcctgctaccagacaaactaaatccggtttaattatagaagcacagaacatctgagtcagaaagggccttaaaaattactttgcccagaagaatgccaaggcataaatacagaaggaatcatagaattaaaatatcaccatttcgcaaccatcatcttaataatggatttagacaatgatcatcaacgtatgctgaaactatagggtgcaagtctacgttagtttgatttcttggttatggtggtatcggctcaatttttccactataaaactatctttttcccctttgaaattacaaccctaacaacaataataaataagcctacaatggagcaaaattacataatgtgtcttctgatgtgactcaatatgaggacacaacatcattttaaaacaaaaagctggagaaaaagcatcttgtcacacaaattgggaaactgatacacaacaaggagaaggaactgagtctgaaactgggattagaatatttttccatggtgtcttggtgcaccatctagttccaaccataatgatgttggtgatgatgataccttcatgttttttcaatcaatttttttttcagtttctactatgtgccagatagtgtgcttggcactcaagagtcatcagtgaattaagcaaaagatctctgccttcatggggcttatatttattttcatgctttttcatctttaccttcttcatcctcatcctcatcattaccatttcaccttttttaaaaatttgtgctcctttgcacaaagactcctaaatagctatatctctaggacctggcacagcatagctttttaataaatagttgttatcttcaattaaggaatgtgtatgtgcacatgtatgtatctgtgtgtgtgtgcatgtcgtgactgtgtatataatgccatttcacttctacactgtagctcagtctatcccccactgcttgaaatagcatctccacttctctcacattatccttcaaggcagcctcatttccttagtgatgacttcccaggaggaccccctcctcttaacgaccaaagtgtttaccactcatttaaatctcatcatacacagtatgtgacagcttggggactgtagtttattcatttaactctgttaagggccactaattaatatgggtaggtaaaatgatttccagtttcccaggggccctgtgaaaaccacgatgccctaacaaaagagcagctattacaattttaggccctgagaagacagatgaggccccttctctgatgagcaccttggtcatgcagaatcttcctggcctggtcacatgagcctgattgcaattctgcccccaatctgccggtatgattctggtcaagtcttagccccttgaaattcactggactcacctgtacaatgaagcagttgttctctgggcacttgggtcctttgcaattttctatctattaggcttcattcttcctgacttcaggaagagaggatatggccaggatgcttgagaaagtacagtgccttctcaaatggccccagcactaccatgtctgccctgctctaattaaaagtgcagtgcacagacacttgaatattggccttaattaaggcacccaaatgaaaagcctagaattgcagcgaatgcaccacatatagaactgattttccaaacccttagctgggtaatgttctcaagaggctacacacaagtgacgaagggatcagggaaggaaggtgtttagtttagtttagtttagtttagtttagtttagtttagtttagtttagtttagtttagttcagtttagtttagttcagtttagtttaggaatacttgctcatacagaagccctttcaaaggcaaagaaatggccagtatttcaggcaggaccctcttcttttccctctattcactgcttaacagctccagggcacgctggcatgtgatgtgacagccagtgtgatagagtagctatgatggtgtgctctggcatcagggatacctgggtcttagtcttagctctgtcatgcgctggctgcatgactttagccaggtcacttaacctctgatccttagtttcctcatctgtaaaagggaataataatgatactacttcttagggtcgttgtgacaattaaacaaagggatgcttagaacagtgcctggctcttagttggtgctctgtgagtgttaggagaaaaatgtccaaattgcaatattgggacacaagagtacccatgtccttctgaagattcagggtggtagcatgtttgaaactggagctgtcctacaaaattcagtctctgcctaggaagcagtttgcactctgctctttgcctgaaaactctgctcagtggcttgatcaagtgggaatataccactccatggcggaaagaacagagacataaactctaagctcagagagcagctaattcaatcaccctcttgctcaccttcacccgccaacaccaaacggacccagaaactccaaaaaaggaagtgaatctctgaaggtcacacaataaactagtggtggacagttctacctcttgatctttttactgcttcttttatgaataagagttgagaaacaaaatgtgtgcagtatagaacagattcaaaaacaaactccatgaatctaggagacttaagctagtctctgtacaccagggtttctcaactttagcactattgacattttgagccagatcattacaaattattaccacacattgcactgtagaatgtgtagcagcatccctggcctgcttgctcagttgtgtgacaacgaaaaatgtcttcagacattgccaaatgtctgctctaggggtaaggtggggtggcagaacttcatgttgagagcacagctgaataggagcagcactgtaaatgtagcttgctcctcagagttcttttcagcactcttctccactatattgtctccaatggtgatatcatccaaccccgtggctgatggcttccagatgtggagctctagacttgacctctccagcccactcctgtcttatatatccacggcctactcgacatccctcttgcacatgttataggcatctcagacaataccgaactcctgattcttgagcctaccctttctccaactcattcttgccttcattcattcattcttgcattagacaatattgcacacctagtgtattcatttcctgtggctgctgttacaaactaccacaaacttggtgtggtctaaactacagaaaatgttttctttcatagttctggaagccagaagtcccaaatcaaggtgtcagcaaggccttgcctcctccaaagattctaggggagaatctttccttgcctcttccaacttctgctggctccaggtactccttggcttgtggctgcatcactctgatctctgcattggtcatcacatggtcttttcctcttctctccctgtggttctcctctgtcttttataaggacactcatcatttgacttagaggccacctatataatccacaatgacttcatcttgagatccttaattacatctgcaaaaatccttcttccaaaaaagtcatgttcacaggttcctgcggttaggacacagatgtatctttttaggggccatcattcaacccaccactcctactatgcaccaggaatgttatagatgctggggatacagtggggaacaaagcaaagtccttgatctcgtggaaattacattatactgttagaagatagatagacaataaatggataactatataatatagaatgtcaggtagtgataagtgctagagagaaaaagaaaacagggtaagaagatagaaaatgatggggtatgctacttttgatagggcgctcagggaaatcctcttggaagaggtgatgttcaggtagagaaccgaagcactggaaccagacatgggaaggtcagggaaaggtgttagaggcagagggaacagaaagtgcaaaggtctttagaaaggattattcttgacatgtttgagaaaaagcaaggaggccagagtgggtgttgcacagacagtgaccagaagagtggcaggaaatgagtttggagaggttggtaggaaccagagcacgcagggtgttgtgggccatggaaagaactttggttttattccaagtgtgataagaaaccattagaccgagtctacagatgaggggagtgacatgacctgatttgcattttcaaaatatcagcctggctgtgatgtggagaaggaggcatagcagcagggcaagtgtataggcagtgagacgagcttgtggaaagggagaggcactgtctccatccatccccttgctcaaggagtcattcccgatttctctcttacccttatcccccacatctaatccactggaaaaatcctctcagcttcatattcaaaatatatccagaatttgaccatttctcatcacctccatcactacccctcagtcttagccactgttatctcttgcctggtccactatgatagcctcccaactggtctccctgcttcaacccttgcctcctcagtctatttgtgacacaagagccaaatcgaactttttaaagcataagtcagaacatgtcaccccccgggcttaaaacctgcgatggttttccagtgcacttaaaataaaatccaaacactctgccatggccgccattatgtgactctcacctatcctgcagccccattccctaccactctccttactcactacgttccagccactctggccttctttccttaaacccttccagtttgttcctacctcaaggactttgcaccagctgttcctctaggtggtaatatggttttttccagcggctgtcacctcctccaggaggcctccctgattaccctcatgaaagtaggatcctgattgtcaccctgttttcttttattttcttcagagcatgtattactctctgaaattatatcaggtatttgtttgatttattatgtgtttatatggtggcttatttactacttgtcttttcttactagaaggtaagcttcctgaatcagggctcatgtctgacttgtttgctgctatgacctcagcagctagtacagtgcctggcacacagtagcccctcagttaatatctgttgagtgaatgaacctctctcccagtgcacaactggacaggagcttaaggactatccagcgagtggacgtcggaatcacccagagggcttttaaaacaatccatatttccagggccccttccaagcctactgcatcaaaatctcctggggcgggcccacaaatctacattttgaacaagttcagtttgtaacaaacacttatgtagcacttactgctactattctaagtattttacatatattaactcattttatccttttaatagtaattttagtattacagttttactgccaaggaaacgaaggcacagggacatttagtaactttgcccaaggccacccaggcaggaagtagtagagtcagaattcaaacccagtcagtatgtcctcttaaccactactctgtgctgactctgcacaagaagttctgtgatcagtgctgtttgggacccatacataaaattggctccaataaggacactgagacccagactagacaatggacctgattaaagccacaatcagaaatgagataggttttgcgtctttccatctgatgagcattccattctgtccagtcattctgtgctctgtaaagggcagggccggggagtatgctgcctacataaaagttaagtcacaagaagttgtctagaaatgtttttgctgtcagcactggttgtcagggaatgcaggaacacatcctggtattgggatctcttatcatctctgggacaatacaagcttaaagtgggagaccctcttccctcaggagacagttagcaaagccacgggcgacgaagcctgctgctgctggcctagttgaggatggaggtgtaagagaagcccccataatgtcagcggagggagcagtatgtgcggcggagcttatctgctccggtcacaaaaagtgcaccaggcctcggcaggcagcctccactcccctattcccgccagcccccactgagagaaccaggggatggcccagccagatgacatgcctcagttactctccaatgaggccccgggccaaacaggcttttcaatttccagatgctttttaattaaaataaaggccactctgtaacctaacattgaatagacaaagtttccttagtagaatgactgtacgagttcaccctttttccattacttttcattgagcaactgaacgtttctaaccaataaattatgacttgagtcacatgacagcaaggggcatggaagggttaagtgacttatggaaggtcactctgctaaagaaagactcctttgttctagcctcccctcttgctcctgcctctgcgagcccgtattctaccttttggggagacggaaagagggctactctagcctcgctcagaacagcagagggttgagcaatggtgttgtgacctggtccatctgggaattcagactcttcatctctgcttcaaaatggatctcaagagctcagattttctgtattggttgcccacaccatgagttctaactctgcctccatcctttggggacataaatggcaggagggaaaaaaggccactttctttttttttttttttgagatggagtttcgctcttgttgcccgggctggagtgcaatggcacaaacttggctcaccacaaactctgcctcctggattcaagcgattctcctgccttagcctcccgagtagctgggattacaggcatgcaccaccaggcccggctaattttgtatttttagcagagacgggatttctccatgttggtcaggctggtcttgaactcccgacctcaggtgatccacccgcctcggcctcccgaaatgctgggattacaggcgtgagccaccacgcccggccaggccactttatttctatccaggtcacgtggttagagatgtttggggaggcctgtggggggacaaagcaatctcaccaacttctgtcttggacttacctggtctagaatactagcacagaaaaggagcaagaggcctgacgacaggtttaggctctgcccaggtgtaatagcttactttttcttcttaattatgagccaactcagcctttagcagagttcagagacaatgaggctgtctatgggctcagaacaaagcccactgatcctagactccagagttcgatgcattaagtgacgactgattgagctcccctgcctcacatggatcactgttcttgttcaccacatactatgattaggacaactgaggtcccaaaggttacatttgtccaaagagcctcagctaagaattgaagagaataaagaacgagtgttttctcaatgagttttctcttcccaaactcctgtcctgtgttctttttgtgaaagcagagcttaggccgagttctttcttccctgttctgctgaaagattgggtctgatctgtattgccagctgtaaagacaggaagaggaaggagtgagaaaccaatgagaacccatttcaagttttccttgaatactccaaaatagtttcttccacatcctggaagtaccaaagcagttagtgtggtctatcttgggccacatctacatgaaaccaacatagcccataggaaagtggaggacccagccaaccactgtttgagaggctgttgatgtttgttttctacagttctaaattacctacgtctgtgcaccacagatgcttgtgggtcacagtgcatgtgattgaggttatgtatgggttgaatgctgtaggaaccaggtttattttgtcctgggtcctttctcactttggccttcttttattgcctgtgtgaacttttcttatttggatctactgaagacatagaaacatccctgcccttaccccaacccttccatttcattcctgagtgaccttttggctggaggctctcttggcattgcaaagattaagagtgtctccacaggtctgtttcaggattcccaagagaatttgaggcataaggctgagaaaatgagttttaagattcagtgcttggaatatttttcctcaacatgtcatcctgaatctagaatttctgaagaagatccatgatatcagctaatttgggcaaccttggtatcttcctttaccattcaacttgtgaagtgtcataaaagggccatatcctaaatggctcccaagtgggctgttgggccaagattttggtgttcaagtaggccatcttgtgtttcactccgtagggaattgtgatcatacccaacagatgtgtagcttcaaaaaagcaaagggtggtaggctttagaaatatccatctgttgaacatttttcctttcatctgcaggatagataaagaccgtgtgaacggtcctacccagccccacacaagattatagccacatttcttctcatgaacagaagagtgaaggcaagtgagggacatttgaaaaatggctggcagtacctaggtcaggttgttggaagctttttgggctctcattctgggattaagttatgttggaaagcaaggccagcccctttcctccctcaacagatggagatcaaaagacagtgtcagcctaaccatccacaaatctctccagtgtttgacactcactatcaacaaattccatctctctgtgagggaggcagcaatctgaaacagccttattaggccacagggcttggggactggggtggtctctgcatcctatggccacttttcatttggaatcatttggtctactaaacctctccatttattaaaaaaaaaaaaattgagactatgatgagactttcacatgacagagtttctaggctgaaaagaaatggccacagaatgatgggccattttcttcctcacatcctgtcacacaaatacactcaaatttcccttttccctgtctcccctctctctcccttctgtctcttccttccttcctccctccctccttcccttcccttccccttccctccttccttccttctctccctccttccttccttcttcccttcctccattcctccctccctccttccctccctctctcctttcctccattctttcctttccttctcctccctccctctttcctcttcttccttctctcctcccctgtcttccttctttcctttctctttttctttcattttaaaaatactttagcctgcagaggctcacccagtttaatttcagcaagttcacaagcctgagatgtttctctctttctcaccttttcccctgttagcacttactggattctccaaaatggctattacagtttaagcagacacagagggggaaaatccatatttttgtgacttacataaggagtttgagccttgacaaagtactcagtaagtcttgagtttgcctctaatagtatatagctgaaggagtctctgaaatgacaggatttatggaggtgcctagaagtacattcaataaggaggaaaaacaccagatccattctgaaatcttctcacccaccagccggttgcctattacagggcattgttagtgcagcaacttatgtatagtaaataatcagcccctaacttgttcaatagtatattgtggattttttttcaaatggagcccccttttggggtaacatttatgacttatgaaagaatcctttgctctgtttcatcagaatcatcagttcttattgaggttcatattgatcaagggtatttttcttcagagagtggggatgtacctccaagcagctaattagattagtagcaccaacattaccatcaaagaggaagataactgagtattgcctgattttagtacagctaccacaggatgctccagagacactacttaacgtcaaaatagaagggaagagagagcaagagagagtatacaaggaagtacacaagagaactcaggcttcatggacttctgagcacacagctagctagggtattgggaccacccagagataccccgtcagcccctgcattccccacaaaggatgttatgataagcccttggaatttgtcaggggaccctgcgaggttatctaatgatcctggaatcccctgtacagttcccacaccaaatagctatacttcctctccttggactattccaatagtagggtcgtcaccaccagagatggtttcacactcttgaatggctctgaaaaggattttttttcatttattcaggctctcagtttcatttattgagcttatactatatgacaggcagtgtactttgtactggggatacagcagtggatgaaacaaatgggttccctgccctcctggggtttccattctagtgaggagatagataataaaggaacagaactttctccacccagctctatcactctgtatgcctttgcccatgggtttgtggtgcccaaaatgtaacccaatgacttgggagggttttgcttgatttatgaggtcagggcagaactcctttattccgaagactagactcttatgaatgcaacttacaacaatttttgctttttgtttcactggtgatatggtttggatttgtgtctctgtccaaatctcgtgtcagattggaagagggtcctagttggaggtgattggatcacgaggtggatttctcccttgctgttgtcctgatactgagtgagttctcacgaggtctgatggtttaaaagtgtgtggcactttccctgttgctctctctctctctctctctctctcctgttctaccatggtaagacgtgcttgcttcctcttcaccttccgccatgactgtacgtttcctgaggcctcccagtcatgcttcctgttaagcctgtggaactatgagtcaattaaaccccttttcttcataaattacccagtcttaggtagttgtttatagcagtgtgaaaacggactaatacaactggtcgcatcatacattgacttacagtgacctgactgtcaacagacactcctaagccttcccccctgttccccacttttaaacatgttttaccattaggtcagttttctcctgttttatattagtgcaattgatttttttggaccaaattataacattttacatttatttctgttaaatattattttgctaaaaatactctgtcatgccagtctattgatctagtttgtgatttaggaggacagaaagtcctttgcatttactcaggggtctgtttataaaacttataacactgggctatcacagagagaaacttggtcttagccaaaagttgaaggcctgacacccaagatgtcataggagtttcacctcatggggttaaaaatttttttaacaaatgaagaagcaaggcaatcacattatgctttggctcagtaaaataatgcaaggaactcccaagcatgttacagataacagccttctcagaaagatccccaactgctcaccatatggttgaattggggctgggaacttgaaacctgcagggtctttgttaggttagaatgggggaagggagtttgcagagaccaaatcctcaaggcaatgggtcatgattggcaaaggtgcccgtgactgcttgctcttggtatgagttgcatgagctaaggcatctccttgtcttatttgcatggcagggctggaggctacactgtgacttggcattcatgggacaacaaaatgaccagtcattctgtgttccatggaggccagtcagagcaggttccttggtggtgtgctcagggactgggatccagtggcttgtgaactcagccagctaggcaggctggcaagatgggcaagcaccccaaacctcacccactcccattcccacccccacccagctccacattcttgaggttttagttcaccagacctgaatgagagactgactgcctgactgctaattattcctggaaatggcatgatatgaagtctgcaaacattttctgcaaacattgacccacaagaggcaagctgttgagttctggaagctaggaggcaggaggtgggagggggcttgggaggcattcctcaggcatgaggcagttgggtccctttgcctgctggatttctgctgtaaggtcagcaggaaacagatgcatggaggacagtccccagggtggcatgggaccacccaggggtgttgggcttttcaggtgaacatagaaggctgggctgggagctcccaggtagcaagagccagattgttggtgcctttctgttgtcaaaaaaaaaagtttcagctgccacccagccaaactttgcttgcacacatgttttccagagacagagacaaaaatgtgtttctcagggtgggggtggggtggggagactggagtgacagttacattagccgtatgcagagccatcctcatcacctcggcatttcctggagatggttgcagcctcctgtgaaccccagccaaggttctttcgagatccagggcaagccccatggccaagagcagactggcctgactcagagggagaaacaggagacttcggggagagtagccgggctgtgtacggcccctccaccgccaagcccaccacccgcttcagccttgtcttccgctactgcggacctccagctccagaaacaccaagctgccccagcatcccgctcacaccaggcagttctcagccactctaccactgctcatgcccctttccccatcccaagtgctctttccccactgcttccctctcctaactcctacccattctgcaaggctcccctccgggatcacctcatttggaaagccttcctgtattccgtctgtctgagtttggccttctcctctgtgctcccccaccaagtgttgtgttttctccaaccacagcatttctcactctagagaataagagctcacacccatctccagcttacaatgcgcaagtcactgttctaccttctttacacatattaacatcagtatcttgattttattgatgagggccctgggaaattcagaggttaagtaacttgcccaacatcacacggctagggaatgatgaaatcaggatttgaacccaagctttctggctccaaaatatatcccactggaaagtgaactctttgagggcaggtgagtcaaatcatccctgaattctcagagtgggcactccagagatgtgggcggacttaattgaaccacatgaaactaggaagaccatagggaagatcctggaaagatgggatgggccagaaaaagaggtaacccctaataactcacacacctctccctcctgcccttgtggatgggtattcaggcctaacagatcctgctgtgggtgatttccaggaaccacaaaggccagaacaatgccgaaggccccacgttgggaggcagcctctgggaggccattttcaaaggccagacccattttcgctgggcctgcctgctctgttgccacccagtgtagccactacttctcatttggttttggttaaagaccacaatgtacttgctcactgggggaggtgggtagggtgggagagggcttggctcctctttgtgtggagtgttcacacttagcccatcctgccccaatctcagggaaatttggggaggccagaaggaagtctttcccggtcctagaattttctgtcttcagccttgaaacctttgtgtgaaagcttcacctgtgtggaattcctatagacaagtgtgagctggccattatggccggatttagacccatcactagtccttcccagggcccttagaggcccttttgaggaaaaaagcagacatcccttaaaaaaataaaactagaacatgatgcccaggatccagaatactgaattataagtctgagcatccaactctagacagagtgactctgggtgtgggtgctggagtaagactgaatggactgacatcttagccctaccatttcatagatgtgtgactttaggtttagagttgtgcaaccatcatcactagttccagaatattgtcattactccagaaagaaactgtacccattaaacagtccttcccattctctccccactccatcctctggcagttcctaatctctttctgtctgtatggatttgcctattctggatatctcatataaatggaatcgtgtatatgtgatctttgtgtctggcttctttcacttagcatcatgttttcaaggttcatccatgttgtagtatgcattagtccttcattcctgtttatggctgaataatatgactataccacattttgtttatccatttgtctgttgatgggcatttgggttgtttccactttatggctattgagaatactgctgctatgaacattcgtgtacaagtgtttatgtggatctatgttcaattctcctggatgtgtatgtacctaggagtggaattgctggatcatagggtaactccacagttaactttttttttttttttgagacaaggtcttgttctgtcacttaggctagagtgcagtggtggggccttggctcactgcagcctcaaactcctagtctccagagtccttctgcttcagcctcctgagtagctgggactacaggcatgcaccaccacacccagctatttaaaaaaattttttttttatagagatgggggtctccctgcatagcccaggcggatctcaaactcctgccttcaagtaatcttactgccttgacctctcaaagtgctgggattacaggtgtgagccactgtgcctggtccatgtttaactttttgaggaactgccaaactgtttttcaaagcagctgcatattacaaccccatcagcaatgcataagggttctgatttctccacattctcaccgtcagttgttattttgcattgtattttttattacagccatcctaataggtgtgaggtagtacctcactgtagcttggaattgcattaccctaattattgatgtcgagcatatttttatgtgctccattggccattcatgtatcttctttggaagacagtctgttcagatcctttgatcatttttaattgggttatttgtctttttgctttatggagtcttaagtgttttgcatgtaatctagatacaagtctcttatgagatatgtaatttccaaaatttttctctcattccatgggtggtctcttcacttttttggttgtgtgctttgaagcagaaagccttttaattttcatgaagtctccatttcatcaaagaaaaaatagatgtactttttccatggttgcttgtgcttttggtgtcaaatctaagatttacacgtatgtttatttctaagagctttatagtttgggctcttgcattttgacctttgatatacttttatttaatttttgcacatggtgtaagataaaggtccagttccattcttttgcatgtggatatccagttgtcccagcaccatttgtttaaaagactatcctttcccctattgaattgtcttgatgcccttgttgaaagtaaattgaccataaacgtgagggtttatttctggtccacaacatttttaactgacagaaaagaatgatcagatatggagggcctacaatagtcccaatatctcagcctagcacacccagaagcctcttatccctccatccactcagtagagaaaggatcattgcccagggaaatggtggtcaccaacattaggtctaatgactcaacctggaaggagatcatgtggaaaagttacacgtatttgcagaaccaaccttcctttctctggaaagttaggcttcagtgtagacctccattcctctttctgagcatgccgtcatgagtttaagaaaagtcttttctcctttccccttagctgggaagttcatcccatgttcaccctcctaagactgcccactctcggtttaagctatagttagagcccagaatttcagaaatcagagaggtttggtttcattttttttttctcgaaggaaaaatgctcttgcttgcatcttctttgccggtcacacagcttcacactttgggcagtcccccagcaagttggcaatggacttattctggacacgtccttcctgcttttgctgggaagtgagcacctcacagttgcagcagactgcccaggacagaaagggaacatgacctcccactagctttggccctacctagcaactgacgatcctgactcgtgccttcaggagattcttgacctcttgactataaggtttcctgagttagggaaggcagaatggcagagtgcaaaggagacgagctttgataccagacagcctgggtttgagtccccgattctgcgtttgcttgctatggcagacacagagatgcactgcttagatcccctgtcaagaaagaacccgttgaccagctgaaaggagtgtggttacttgacagtctccagctgttagctccttcagggtctgcctcagcttttgagccaaggtcatgctgttcttgaggtggcccctagccaatgactgatgaaggaggtgatacaaggcccatttccaccacccagaagactcctctaaaaggcagtatttgctccagagctccctgttgggcacagactttgacaggtctgcatcatgctctgggctcctcttgcctggtcctgctttctccccttttctttcacaggtatttcccgctaaacctcttgcactcccacctgtcagagcatctgcttcacagagaactcaacctgtcgtctctcagcttgtgtcttctcccctgtgacaggggaataatggcatcatcccacagggttggtaaaaagattagaactaagtaaaatacctgccacaaaggaggcattccatcaaagggagctgttactactagggaatctatcatttccatggctatatcctaacttttaaatgaaatagaagtacccattataatccaaacctagaaatagtctcaatgcccatcaacagaagaatggataaatacattgtgctgggtccatacaatggaattctaatcagcaataaaatgggtaaatctcatcagcattagattgagctaaagaaaccagacacacaaaaaatacatgttgtatgatgccatttctctgaagtgcaagaatagacagaactaatgagtgatgataaaggccagtgactcagtggtgacccttaggggataatgaccaggggcatgagggaaccttctaagaagctggaaatgttctctatcttgatctagattctggttatatcactcacacacacacaaacacacatacacacaaacacacacacacacaaacacactcacatacacacacacacacacacacacactccaaaatcacaaagcttgcaattaaggttaatacactttatgcacctacctatgtatgttatggctgcatttttacaaatggaaatatagcggggagttttttatttttaattagcatatgtacaagttaagttttttaaatttagaaaatccagaaaaatagaaagaaaaaaatctcctatggccccatctcccaaagatacccagtagagacattttagatattgcattgcattctctagccctcttggctctacttctctatggtcctgctctggctcatggagaaaggaagttccaccaccatttccaccttcttggaaatagtgcttctcacctctctttcactccttccctcagataaaacctgaagcttaatagtgccaaaatgtcaacgtcctcatctgcacatcaccttgcactgcatcttctgggcctctggctccctttctggacagccaggtcaggaagccaggttcactgtgtcttctgcttttgcaggagttgacatgctaactcaggccccaaaggactttctgatgggaatgtacctgatgctccccaaagctgaagtggtgcaggctcagagcagtcagagcagccaagctttttgcctggcagttgtgtgaattatgagagaaaggcatcttccagcttgcttagatgaccacaagctgtcaaagtgaccctgtaggaaatgtctcaaggcagaatataatcaaaaccaggcatgtaaaaaactggggctttctttctagactgctggttctcaaagtgtggctcccagaccaacagcatcagcattagcatctccggggaactgattagaaatgcaaattggggcccccaccagggacctagtgaaagaaactctgggagtgggacccagtcatctgtgttttaacaggccctccaggtgattctgaggcacccttaagtttgagagcctctgttctagaggtttctaaattccactgccagagaaagcaaggatgcattcacatgtgctctgctcatgtgcataaccagtgtcctgtgtccttggtatgacttagaggcacacgccaggtccatataacttcaaagtctcttgttctttatatcctgaacccaaggaaacacatttcttttctttttttttttctgttagcagagcaaagatgaaatatagcccaatgttccctcaacaaaaagatttattaatttgtactaatgactgtttagagaaaaacataaaaaccaatgtccttgttgaatgctccttgatggcaaaatgtggatgttatctgtaaaatcaacaaatttgtcaccaaagtgaaatgttatcttttcctgaagactttcccaggcagctgaaggcctcaaggactagacagcctcccccatcaccatgatcaaatgaagagggttagaacttgcagccgtaactcaaatgccttaagatggctcagatgtgtgtttgttttcaggttaggaactttgctcagaacccctgaagaaaaggaaccatgaacctattcaaagactcaaagaatcctctcagacctatgccccttcttaccagtgtgttctggtaaatgcttaacaatctgcacgtgtgcacacgtgcacgcgcgtgcgcgcacacacacacacacatatctttattttaaatgtgtggcacgtgatccaaaaataataaaatatacaatattcattcttgtaaatttcatacagctaattaacattcatactcatgccttagttgatttttacctaactcttgtatccatatccaacctaaggtggcaattaacaaacaagcatggttctgacataagtattggttgatacattggtttacatttatgaataagacaaaagcaaaacaacaaaatgcatgtcaaaatttctctgattcacatagtgacataaatgacttctttactaaatcagataatcatctttaaatactggaaggatatttcctcaaattttttgtgctgtttacaatgtaacagctactgagacaacacaatttttaagtttcagctgcactattaacatttcctccatctttcttaagcctagatcaggggtcgtcaaacatattttgttaaagagccagatagtaaatattttaggctttttgtttgtttgtttgagacaggatctcgctctgtcaccaaggctggagtgtagtggcatgatctcggctcattgcaaactctgcctcccaagttcaagcaattctcctgcctcagcctcccaagtagttgggactacagtcgtgcaccactatgcctggatactttttattattttgtagagatgaggttttatcatgttgagcaggctagtctcgaactcctgggctcgagcaatccacctgcttcagcttcccaaagtgctgagattacaggcatgagccactgcgcctggctaagcatttcaggctttgtagccacatagtcattttttttacaaccctttaaaaatgtaaaaatcatcctttgcttgtgggctacacaaaaacagactgtggggaaagttctcaactcttggtcaagacaatcaacacaacaatagattaagcactgctttgtagcatttgctagtttccctgacataaatagtcctaccatggccaacttcaggctacacaacttgatgtcacagaatgtggagttgggaagagatgtccagtggcagaacattatatagtatttccagtatactgatataaaagatataagtaacctcaagagcatggataatagcaaagtgtagtcaaataattagaaagggatgagtttcgcatatgtattagctttgtgggtttttttggttttgttttttgagacagggtctcattctgtcacccaggctggagtgcagtggcatgatcatagctcactgcagccttgacctcctgggctcaaacgatcctcctgcctcagctgggaccacaggtgtgtggcaccacacccagctaattttttaaaaattatgttttgtagagatatggtctccctatgttgcccaggctggtctggaactcctcagcttgagtgatcctcccacctcagcctcctaaagtgttgggattacaggcatgagccaccacacctagccaagctttgtttttcatataatttattttattgcaaggttatataatttaatttctaataatggctgaatttaacaactcagctctcaaaattaatttgtctcttgtaagttggtatgagcacaccattgtgaccataacaaatttcaacctgtctttttttgttggggagtaggtaaaaagagaatcttcactcaatttggtccattattccttgtaacaaaagaatttactacagggtttctttgaagctgggagtttccctggctcttctaaaataggaaatgattttagatgttatttttacgtattttcaaaaagaggtctgtctctattctcaactgcttcctgaccaccttttgcttccaaataatgaaaactatttaaaggaaaaaggaactactgtagtgtggttttaagaaaagcacatactttgctctttcagaagtagttacacaatacttctgcccataaactggggaagagttaaaatagctttccaaggctcctcccagggctgtgattttcctctcatctgctcaggtaatgccactcatggtgctcattcatttattcagctatttgagcatctaccaactgcccgccagtgtgctgagccccagggacacagcagaacgcgagagagacatggcccctgctgaataagtaattacgcagatcattatttacttatactttacattagtaccttaaaggagagcatataacatagcggcctgatctattctgggagattcaggatgtggcatttaacctgacacctgaagaatgagtagaaagccatgccaaggaagaggcaaaaagaagtagaacacccttccttccaggtgatggggacatcctataggatgcttgcccaaagcacaggtacacatacaatacatacacagatacacagcatctctttggtattaaaatttaatggggggagaaattagaaaaaaaaaagacgtctaaaaaggctcctgggatgaaggggatgataatttttttaaaacaacattgagaaacattggtttatataaacaacttggtgctcttgagctattatcacagcagtggcagagctaagaggctgactcctctcatgaggactagctacagacctgcaggctccagaggctgatactaagacaggaagttagaggactcatggtttcccacaactccagaaaatatcctctgttatctttcaaatactgcctcttctcattctctctcttccctccttctggaactccaactggacacttactggaacttctcattctgtcctccatgtagcttagctttcctttcttatttttcatctctttattcctctgctctgcatctggataatttcctcagctctatcttctggttcactcattctctcatcaactgtgtttagtttgttgtttaatccctctgttgagtgttcttttttccattgcaatgcctatatttcggttcttttttgcattcacctgtatttttcaaactattctattcttgccttctagtttctattcctttttaaaacctctttcggccaggcatggtggctcacgcctgtaatcccagcactttgggaggctgaggcgggtggatcacccgaggtcaggagttcaagaccagcctggccaacatgatgaaatcctatctctactaaaaaatacaaaaattagctgggcatgatggcaggcacctgtaatcccagctactcaggaggctgaggcagaagaatcgcttgaacccaggaggcggaggttgcagtgagctgagatcgcaccattgcactccagcctgggtgatagagcaatactctgtctcaaaaaaaaaaaaaaaatctttgaacattttcagcatacttattttaaaatcccttttagattttcttattagctgtggttcttaaggtatgaattcttccattggttgcactggtcttatggtggtttatttcctcacggacttagtaagttctagctatgcattcatcctgagtcatagatacaaacacagattcatgtgctatataccacctgggtttgaattctggctctgccacttagtacctgtgtgaccttaggtaagttatttaatctctctgttcttcagtttcagtatctggaaatcagggctgttctacaaatgagttattaggttggtggaaaatgattgcagtttttgccactaatttcaacggcaaaaaccgcaattacttttgcatcaacctaaataatataagccaagcacttaggacagcatctggcacataattaagcacttggctagtgtaattactgttatttggcaggaattgttttaccttggagtcttatgtactttgggttatgtgactgcctactctcagctcaaagtggccagtacacttctgaactgtgttttttcccccatccccacttatgggccagcacttaccactactgactttccataggagctcagattccactcccgttcccaccctgccattcaaacccttcgcccaggatatgtgaccacctttggttcttctgtgggctgtgtagttgctgctgtggctttgagctccctcttcatttctggcactagaatatgtttatttttgcttttgctctctacaacatatttaaatttttgaaaaaacaatgtgttttgagcaggggaggagcttcctgcaacagctcaggcaaccatactgaccagtaatccctaaaaattctttcttttttttttaaattttaagttccggggtacatgtgcaggatgtgcaggtttgttatgtaagtaaacatgtgccatggtggtttgctgcatcgatcaacccatcacctacatattaagcccagcatgcatcagctatttttcctgatgctttccacccgccacagccccccaagaggccacagtgtgtgttttcccctccctgggtccatgtgttctcattctccctgagcattcttcctgaagaggcttacctctcatttggcagtgggctccttgagagaactggggacaaaggctggattcctggtgggaagggacatatattatttgtttttgtattccctatgcctgatatgtgtttactgagtaaagacacgaaagactgccttggcaacagcaagcactacaagtggccagctcactgcttgatttctctaagaattaccaccaccatgttgtaaccctcctccccgcccttcttcctgtgaatgagttctgtcaaggtgacatggcttctaacacatgacagtaggtatcattcaatcactgatgatctcaagggtgagtagctttcttttactctgtaaacaaaatgccaaactgggaaatgctgcagaggccacatattattctgactttcagagtgttgtttcgaaagcaccagagtaaaatgttaagcaggtagctgatgcaatctggcaaagtcagtatatagctctatttatataaagacacacacatatatcagaccatcagaaggatttgtataaagagtgactctcctatgaaggtaaaggccacccctcttcagttccagtgactgagatacatttttccaatcctgggggcaaatacagacacagcaagttccttcttccctttggaaatttggcaggtaagtcaagtctgtctctgttgccacattctctcgagattttatgactgtgcacatggcctgtgtgaaagcttcgcttaggtcaccttatgccttggcagccagcatggtgtatgacgattcaggaagaccctggtgtttcccagatggggccagatctggccatgcaattattgccctccagctgggaaatgtgacatgggggtgatgaagtggctgctgagaaggaggcagttagactctgaatttggtctgttctttatttaaatctaaagattgaacacacacacacatagatctaaaatcaatatcatacattcacacacacacacactcacacatgcaccactccccaactgcacagggtattttttagggattcatgtgggattcccctacacatatttcccagtctaactgcctattctttcccctgtttacttgccatctcatcattctctcttcctttactctcctacttatctttatcattgcttttagctgtgtgttcctattaacccagatgatcagtttcagactctttgagaaagagacagggaccctaaatccattgtgagctgctttgtctcattctctcccatgaccacagagaggcatgtctctggaccttgattctgagaggaaacagattcacagaaactacaccaccactggtagcacaatgttactctcagggtggacattctcatttataaaaagagtagtagaataaattgcattctaatcccagcagctctaataacttgtccttctttctatcaatatactgatcactgttactacagaggcagcagggaacaaatatgggctctgtatttaaacaaacttgggttcaagttccagcttcagcagttaatagctgagtgacactgggcaagttgcttatcctctctgatcttctgtttctttatctgcttaattggcatcaaatagaatatacagacagtccccaacttgcaatggtttggcttgcaattttttgacattatgacgggcttattagggtactgaatgcatttttgatttatgatatttttgatttgtgatggttttatcgggacatagccccatcataagtcaaggagcatccgtatgttcaaggtgctggatacataattggtgctctataaataggtggaattactatgattatttggatgatggtcgcaacccttggtccttcctgtctcactggagttagagacaatcagagttaaaggaggactctaaagatgaacaaagcatcttctcacggtcaagtgacagctcggagctgctggatgctcagcatagcactagctctctaacaggctctaggagaaacaatgggtagatctactcctgctctcaaggggccctggccatccaaatgagcagataagatgaaaatgtctacaaatgttaaaaaagaaaaaaaaaaggctgggcatggtggttcatttctgtaatcccaacacttcgggaagctgaggcaggaggattacttaagcccaggagttcaagaccagcctgagcaatgtagggagacaccgtctctacaaaaactaaaaataaaatatccaggcttggtggggcacacctgtggtcctagctactcaggaggctgagatgggaggatcacttgagcccaggagatcgaagctgcagtgagccatcatcactccactgcactccagcctgggggacagagcacaaccgcatctcaaaaaagaaaagaaaaaaagaggaaaatgtaaatatgagtgggcaataagactagtatctgctaaattcttccctatagaccacaagtgctatggaaattcagagagggggtgctgctgtgaataagaagtcctcctggaggaggcaaggcttcagctgagacttaaagaaaggatgaggcttggagtgacccctagaaaaggtgggagctctgtgggcaaatgctggtcaaacttgagaggtaggcacaactgttatttccaatttacagataagaaaatggaaggccagataagcctagtgacttctctaaggccactcagcaagtaatggcagcactaggatttaggtagagatcggtctctgtctggtgttgaaggctacattcaaagctggctctgactgaagaaagatgagaaataggaaatagccattgatggttttccagataggagtgacgtagaaaaggcagtgtgttttctatattcacagtgcagcaggtgttcaggggacgattctggcactagaggggtcaattaggaggcagttgcaatactttagggctgaggtattgaaggcctgatccagggtaggggcatggtgggactagagaaggcattaagccattaggcatgtcaaagggcaaattcacagacttgggaactggctgaataaggagaaagaaggacagcgggatgattaaagaatctgatatgggaaccagaagactgggcaatgctgctactaggcatattgggatagcatactcattttaaggttgctgtttatataaaacagagcctggtttcttttattattattgctattaaatctttttatttttttaaaaacacacataccataagaaaacagacaaattcagaatatgagatattctacaagacaactagcctgaactcttcaaaaattcagtgtcacacacaaaaattaggagcatgcactgttctagattaaacgacactaaagggacataagtagatgcaatacacaaaccttggttttggattctggattttacaaagctatgaaagacatttggggaatattggggcaatttgaatatggattggaaattagattatattaggaattattgtttattttcttagctgtgataatatattgtggttaggagggagaatcttcttattctttaaagagtcattctgaagaatttagtgggaatgtgttatgatgcctgtgaccttcaaatatatgtgtgtgtgtgtgtgtgtgtgtgtgtgtgtgtaaatagattgactgatagaaacagaactacacagcaactatgttgaaatgttaattgtggaatcttggtggttatatgtatgttcattgttctacttctttgatctatttgtacgtttgaattttttcaaaataaaattcaggaaaaaataatgcatgaacattgtaaaaaacaacaacaacaacagtaaaaaagggtatggggggaacctttctgccccagacacccaatactccttcccagaagtaaccactggtcacatttcttgaaatgttatctgcattttacaagcctatgtatgtgtttgtaaattctgttaataaatagataggttcatgctatgcatctttttgttagctacaagtagactctcttatctattcaactgggagagtagttagttaattaaaaatcagtaaaagtggaagtgcttggacccactagggagtggtgaccaagtgcatccagaatactgtgggtatcaatcagtgcattttacacaggaaatggagagcatcctttaattgtgagagttggccccacagacgtcagctaagcgagcttccactgtaatggcagcagcctgcttttttgtttcacttcaggagccttcttggaggtgttaagaaggcctaggtctgccaacatggcctctgagccactggtagaaccttcaggaatgagagaggtgagccattgggcttggggagaggtgaagtcagcaagtgcatgaggggcctgggctaggactcttctcatctgaaccccacaggcacaccctgactgttccatataaccacgtgtagatctgtctcattctttcagtacagttatgtctcattctttcagtacagtttttaggatgaattgcttttaggatgagtatggttttaatcatattgtgctttgggagatggtggaacatctgggtagaaaaaacattgcctaggcttcctgaacttgcctgatcgtaagaatcatttgggtatttgtctaacaagctttccagctagggcagtgctgccatacgcagttggagaaccaggtctagggctccagcgacaggactgcactgacagatggaagctccactaatggtgctagttaaaggcctgagaatagacagagcaggcaagatgcctgagaaatgctgaagtccaaggatggagcccactaattcccatacaagcttcctcccccaacccctcccctccagagatgattgcctcctcttgcaatcgttggggtcacatttccaaagcatgtgcagctttgaatatgaaaaccctccctaactggcagcacctgggcaaattcaaatcacatacttggacataagactcctccttgcaaatgggaaggatgattggaaaaatgtgattccagaaaccagatctggactgaactgaaattgcctgaaaaatgaaagcactggcacaattaacaaaaagggactggattcctttatttattttatttatttgcagctaaatcctacacagcttgcagaccttgggagacagccatccttttatcattcctgatatggacttgaatttctaagaaatgacttttttaatggtctgtggaattgaactcctactagaagcggccctaggactcccagtcacaatgttttaagaacaatcctgagacaagagcaggagctctgaggggccttgtgtgcccacagacccatgaagccatatgctgacctcatattggtctcttcaggtgtcctagaaaacccagctctgcatctaactcaccctctgcattgggacaaggtagagcaaggcccaatgtcattttagggacccacaatggcagaggactgcattggcttgtcacactgcctgaaatgttcacatttcagtgtgaagcactgacgtcccctgtcttctctaaatcaaagtgtctcagaggtaaagacaggatctctaatttttttaagacaagcagcttttcacttaaggttaaaaaccaaatggagaagggtgggtagtgatgtgtctggtttttgttgtaagcctggagggtgagcaggtggttaggagagggaagggtgtcaagaagacccaggcctgccaacatggcccctgagccactggtagaaccttcaggaatgagagagatgagccatcaggcctgaggagagggcctggggagagtgtatgaggggcctgggccaggactcttctcatatatggccccacaggcacacctggactgtaatgattgtggaatcgggaagccatcaccacagtttccaattccttaccactattattaccatgactgtgctgagtgcatgtgctttgaattttcagtgagcctgctagcccagggacacttccacctgcgctgttatgcagtgacacagactgatggaccacagtagcagagagcagccgcggacctcacatctgggggatcaggcctcaaggattttgcatgacagtttattccagctctgccatgtctcttaagaaatccacagttttgattttctgtaactgcccccacccccgcccatgcttttaaaaacacatattatgtgccagatgctagagtaagcatattggatatatcatttatttaatcctcaccacagcactgtgaggtagatgttattgttaaccaattttacagatgtggaaactgaggcacagagagattaagtaacttggccagcactgctctgctccagcagaatttctggaagtcagctggccagctagactctttcagattacttttcctcacccaagcccacttctgaattttctctccctattgattcaacccctgtggtgacaggtttatcttcaaatgaggtttcctaggatagccctgctatggagtcaacctgaccaagggccagctgcaccactcacctgggagcagttgcctgtagaaccagagaacagaaataacaaacttcactagggttggccgcaaaccacaagatcctctagaaggaccccaaaatgtccgtgaagaccaatagtcagattactgaccatgccgccagagaagaaaagggcagcctaccaactatccatcctatttgagccacgtgacttgccaacgtgggtgttttctgaggaaaaccttcagttcacccagcaattccagcctaagctcttttccgagtctgcctgaactaactagatatttgcctctgggtcactgtaacccaaaaaggcttaattaaaatcaggaaataggctcaagttcctctgctgcaatactataaactttagataggccaaagtaggctgcaaggacacacagggataaaaggtactttggatacagcacagtcgtctgggatactcatacacacacccacatgataccctcctccccccgtagaaattaagaaatgagaaaaggaaagtatttggctctaggtgagcttcctttgtaaaggctggagacaatgcatttgtctactgaacacattttgtctgggtatgggggaagcaatctctccagcctgagggtctcaggcaggacttggcctggtgggtgactggggccaagtgggggatgactggcaggccgagggcatgaggaggacagaggaagaaaggggggaaaaaggtgagggggtgagagactagaaagtgaagggaacaggcacagaagggagagaagagggacgccagagatgtttggagtagggacagttgggagaacccatggcgctgacagctccgcatcttgataaagtcatttcctgtttatcagacatcattagggcattagagttctcataccaaagatttatccaagagtagacatttggcccctttgggtatcaatccttttggaactcagtttcatttttttgttgtttttatttgtttatttgtttgtttttactgtgaatataccttatttagtcatttttgtttacaagtgaaactctgggaattcaaaattaacttcgttacctatgagcttcttaaagacaccagaaaagtttcaaccttgtgtgccacattgttctgctgtgctttgtccaaatgaacttttgcgaggcagctgccatccagtttcaagtggattctcttgcccacaatttcacttggaaagaccaagtcctcaagatcgcatggtacgcagctatcagagtacagctcctgtgatgcttttgcttattttttgtatggctttttcaagttggcttaggcagaattctcctctgagcaataaagacaacatgcttctcactgaactttttctccaattcacatactagccagacttggattttctgggaagatttcagtcgagaaacaggaacaaagattatgatagctttctgactaccaccaacttcagtttccttggctgctgtgatattcagctccctgagctgagccttgaggtccacgttcatctttggctccagaagagcctgggagatgccgaacttgaacttgtctggcttcttgccgttgggcttcgtgatcctagtgttcaaactgaacgtggccttctccttgctgagtgctggcttaggaagaagcccaagtctcacagtttgggatagatagcttttgaaatgtattcacactccactgctttctgaaactaaacatcctgagtcttttttctggaaacagtggtaaaagaggcaaggagtttgcttgtgaatattggtttcattctttaaatagatatttgtttattcagggccttctgtgcactaagcactgtgttgggtgctgtggacacgacagacctggagccttcttatggaacttgttctgcctataatttggcccattttgagggggtcagagaatgaacacttccacttcctaaactgtgctgggctgtgatgcagtgaggtctttgagggtctcgggaataagtcgggttgtttacccttgtaataaaaggctccagattgtggtgccgagacttcccagtgtcagctgtctctccgtgctgctgtcaccgtgttgtttctgtaggagcagaaagatgtgatctctttcctaacccatcataagggtcatggccgacactcctataacaaaagacagttaacaagagaaaagcatttaacaaatttatttaatcaaagttttacatgacatgggaaatttcagaaatgaagacccaaagacccagggaaaattgagtatttttatgcttagattctataaagaatgtttagaaatgtgattggataaagggtatgatctaatggtaatagactgaaggcagagggtacccagtaaggcctgtctgtttagattcttcttggcttttctgtgtagcattccttcctccagggtatagggcaggaactctctggcatgagggtctacaaggaagaagtgacctttctagattgtatgggttgccttgggggagagaggttctagtttctgtgattccccccggggcgggagacaggagggtaggagaaggtcagagagagactttgcttctgaggtggcttctgagaccttccagtctcctttagttcaaagtactcagcatgccaaagcgccatcgtttgggttaccattttctgaggcccagcacttcttatctgccatgttatttaacacatgtttgcctaggctagggccttacagtggcttttctctcccacggagtataaagtggatgtgttttgtgataatggttggccatttggatgtatttcctcttcattccacatggttgaggttgctggaagtatagcttccaaggaagtggtgacttacattatagtatagtcagtggcgtgctggcctccctcagttgagcagggaggggaatgctggtttatagtgtttgctgatttccatggtgtaaatgctcccaccatggccaatttcaagctcccgacatgacatcactgaacaaggagtccggaatacatgtgcaacagcaaggcatcatagcgtatttccaccatacagatacaatagatgtaaataacctcaaaagcataggtaacagtaagtgtagtaaaataattaggaagtgatgagttttgagtattcattagctttgtcttttttttttttttttttgagatggagtctcccactgtcacctgggctggagtgcagtggcgctatctctgctcactgcaacctccacccaggttcaagtgattctcctgcctcaacctcctgagtagctgggattacaggcacccgccaccacgccctgctaattttttgtatttttagtagagatggggcttcactatgttggccaggctggtctcaaactcctgacctcatgatccacctaccttggcctcccaaagttctgggattacagacgtgagccactgcgcccggcctgctttgtctttaatataacctaattgtaagtttagatcatttcacttttaacaatggctatatttaacaaactggcccacaaaattcatgttgaaccatcgattctcactatctgggtgagtgtggtcctgcctcacttttctcttagcttaagcagtagagagtctgagtaaactgggtcccaaggctcttgcccccactttaaccagagcagccccacttgtattcatttcgtacataatggggttctgtgtttgaggagagggttccaatgttttttattttttaaccttttttttttagatggagtctcgctctgtcacccgggctggagtgccatggcacaatctcggctcactgcaacctctgcctcctgggttcaagcgattctcatgcctcagcctcctgagtagctgggactacagacatgtgccaccatgctaggctgatttttgtatttttagtagagacggggtttcgccatgttggccaggctggtcttgaactcctgacctcaagtgatccacccacctcggcctccccaagtgctgagattacaggtgtgagcacccagcctccacgttttttaaatgtttttttaaaaggcattggtatagatggtctatgaggttccttccgtttatggtatcttaagttagccatgtcttccattttccctttcattcccttgtcccctcttgtcactcaggcatcctattcctgctattcccagagatcattttgtcccatcccaggctctccatcttcactgaagagatagctgttatcagctgatagggttttaggtgatattcctcccaggcgtattttactcttcaacacatgactccagaagacacataaggtctttcaaataaaaggaatgaatttttaaaagctgaaattccaggcagggtgctgggggtgaggggtggggtgctatctgtactcagtgcccttaaaatcataacactgaacagtcagacctgattctactttgcagtatccttcaaaaatctcttgatttcgatgggttgctaggttacccccaaaaaactgcccaagggtgtatctctatttttctttacacaacacagttttcctgcagtgaaaactgaaaccttattctagcagatgtttggttcgtcttcccctgaatgcaaagttttcatccatggaaatgatagagaggctgcaaaggttatggatatgacacaatcctttctgaaggcaaattcaccctctttagcatgccagaaaaattatttttccaggaaaactaaacactaagcacatgcttggatgttcctttcaagcaagagaggagccctttctatcccattaaggtcaggcaattgcccaaatgatttgcttcactgcctatcataacggggagtgtgggatggaaccagcaggtgtttactctcatctctctccatccagcaggctagccaagcaaagttcataggcacaggcaccctctgaagcctggagtcagagaggctgaggctgggggacactcgggacccctccaacacacacacacacacacacacacacacacacacacacacagatgcatgcatgcccacacatagaagaccacaacattccctcagttcaacacagcagctcatgagagtcagtattatggaagcaaaagtagagcagagcagtggaataagatgcatggaacctggtggcccagaaggccacgggatggggcacaataatgagcttctcggccagctgcccagtctgctgggtgcatactgttcaaatgtagataggatagccagtggcccaggagctgtgggggacaagagggctgctatttcctgcctacacggctaccttcggaggcctggggtactttccatagctttgcttctcaggttctgtccccacttctgacaccagcagcaacctccctttggccccattttgctgaggacatggctcactatctgaaagcttcaactgtaaggaggtacgtatgcatgcccaacacacaaaacagacccaaagccaaactctgtccagttgaggccagcttaggcaataaatcttgctcaattccctggtcagaatacctctggctacctctgcaagcccggtctagtcttgatccagggccgtttggccaaggtccctgcacagtcggcactctttcctcttccctgtccaagctgagctcactctcccctggctttccccaaagtccttcactttcagaattggaatcttttgaaccaaaactttctttcttacaaaaatatcttctctaactctcacctctagccttccattctagatttctaggttctcttgtgtcttctaacacttgaattctgagggaatttggtctctccaggggaagcagagaggcactccttatttatccaataacattcagtggctaattatcatttatagaccatcgtggaagtcatcaatctcagagtgtgcttttcccgtatcacttgctcctgatgttggagagagattcgaaatctaaatgtaagtcaccagcaaaatactgtcttttcaatgcaccaaaaggagggaaagttagcttatcttgtagaatccttcaaagtactgtgaactagctgagtaagggtaattagaaaacggaaaagggaagtcaaggacaaactcccatgtagttggagaagtctcacaataaagtaaaatttcccaagaattgccggaaagcaagtcttacaaccactgggaaatgatgagtccaagaatttcagaagagcctccacccttcacctggccttgaaatcaccaaagagctcctactgctccactccaggctcaagaagcaagctgcttttcattgctactcttcaaaatgtgctcatatccattatctcatttgattctcaccatgaccctgtgaggtaggtaggacagatattagttttccccggctcacttctggaagattcccaggagtcagattttgcacaattgtaagttgacaggtttggctctatttgcacatgctaacaaaatctggcctggtccaaccgtatgtaaagggaagatttgtcatgcaacattgacctaagctatgcagagagaagcctgatcatcggggaaggggactaggggaaatttcttgggaaatgtaataattctactcctcctttcccttcctgggcctaaaaactcacgcttgaatgggaaggcttgcattatcctcaagctactcaaaaagtttcttgaagactggataccaaggccaaattcctatatatttagctatatttgatcaaccttaccaattaatcaactgtacatcgtgggcccagctcttgcagggaggaagagacagagaagtaggagatcagagtcaatggatcctgacctccaaaagcttacagttttgctgggagctaaacttgtacacactacacaacaatgcgtagcagccaaacaaaaggaagagaaggtcagagagggttgaggcagccaggggagacatcccagaaagtcagaacagaggggtggttaggagcatgacctctgaggttgggcagtaaacatggctttgaattccagatctaccattatcagcaatgtgaaccttgagcaaatcactatacgtgatccataaaatggggtgaaaatgaataagtactttaaaagttgctgagaagattaaatgagcacagtatggtatccattatctcacttgagaaaataaaatttggtgctgtttaagctaaccattaaaaatggggaagatttggagacactcagggggagagacaggacaatacgaggcgctgaattaaacaaaggtactgaattaaaaaggaaaggaggtggatgaggatattgagaatactggtattgctaaagcagagagtacatacatataaagggagtaggagacaataaactgtgttagattgggtgcagcaagatggcaaaaggctaccaactggaggagtttagactggatatgataggaagggagaagccaccagagatttttaagcaagagagtgacttgacgatagtagtcttcgaataggattggcctatggagcacttgatgacttggagagggactggaggatatccattgtttgaggcatgagttgacatgcgcctggactagagacatgagagtgagaatagaaaacatttgaaaagtattttgtaggaaaaactaaccagatagagtaggtaattggatatgggagatgaacaagaaggaagagtccaagagtcttccaaagtttttagtctaggtgacttcaaaagtggtggtgccattgttcttgcttataagtgggacctgaacaatgaaaacacatggacacacggagaggaacaacgtacactggggcctgtctcgggggcagggggaggagagcatcaggataaacagctaatgcatgcagggcttaatacctaggtgataggttaataggtgcagcaaaccaccatggcacacgtttacctatgtaacaaacctgcacatcctgcacatgtatcccagaactttaaattaaattttaaaaaagaaagtcgtggtaccattgacagaaaaatggaagtcaagaagagcagtagacatggaaggaagatgatggactcaatgttcaatttatagaaatgtctagaaaaaaagttgatactggaataccctagagagaagaatttccttcttttacttcttttctgacagacacagacctcattttttgttagatgattatattatctgcaaatattgacaattttgtttcttcctttctgatgctattaattctattttttattctatggcattggcttggagctctagtaaaatgttgaatagcagagtagcagtagaaatagacatttctatcttgttcttgactttaagggtgaaaacatctaatatttccaaatttgttaacaaacacttgtgtattgcttctgtgtgtgaaacgttattatgaacactttacaaatattaggctatttaatcctcctacaatgttatgaaatagatattattattattattattattattattcctcttttacagataagaaaactgaggcatagaaaagctaagtaacttgcccaaggtcacacagccaacaagtgttcaaagctccactgcttagctttggagactgtgttcttaactaccctgctacacttgctgcctctttttaagtatgaagttttctgtacctttctggaaagtactttttatcaagttaaagtttccttgtatttctaattttcttagagctttctaagagcaaatgagtactcaactcagttttatcaaacatttttgctgcatctattgaaatgatcatattatcttttcctttattatgcaaatataatgaattacattggtatattttctaatggtgaaccagccttgaatttctgagataaaccctacttggttatggtatagtcttctttttccaaagtgcgagatttgatttggtaataatttatttaggggttttgtatagagttagttttcggtcctcatataatttggcattggtgttatgatagctttggaaaataagttggaagtttctcatcttttttaatgctctgaaattgtttgtttggtaaagggattatctgttccttaaagctgttgtacactttacctttaaagactacttgtgtgtgttaagggggctgaggtgtacacatctttgattctatttccatttcttctctagttttgttgatacagtcagattttcatcttgctctcaagccaattttggtaaagtatcccagaaaattgtctatttcatctacgttccaaatttactggtataaatattaatacaaaataccaattatttataattttatacctgtaccaggacttacacaattactaagaataatattctcttatactttttaatatagtcttttttatttttattttttgtttagtcccacccttcatatctgatttttaatatattctaaatacagttctgtcctctctctctctttttcttcttcttctccctctccctatccttcttcctctccctttctctgcctctttttactcttgagtggttgttgatgtgttttgtttgtttgttttgtttcgtttttagcaaacttgctaatctttgcctattttcatggtcttcccaaagagctggcttttgcttgtattgatcaacatttcatttttgatgattgtgtattttgtaagtttttgctttaatctttcttagcaaaccttactcctgcaaagctcatctgtctagaatatcctttcccccttccctttcacttggctgactcctactcattcttcagtttatgcatcatgtctttcaggaagccttccctgacacttcagagtgatttaaatgctcatcctctgtcctcccccaacaacttccagacctcatcattccatgttataattagctgtctgctttatctctcttccctattagactgcaaattccttgagggcagggaccgtgtctggttcataattgtacccccaagctcctaacatagtattaatatttgccatccccaataggagttcaaatggaaattttattggaggtagcaacccacccataagctggtaggtagatctcacaaaggagctcctagtacagtctgttgcctgaagtttggggtctttttttaaaaaggaaaaaaatacccttggtagctttagtttcttgatttttaacataatcaaatcccttcaaatgtgtcattccatggtctgtctaccctttggggacgtgttctgcgcattctacctctgcactccagcatggatctagaggtttcaaccccaaagggcacaaggccaagagttggccctaaaggagctgagactgactagagttagagtctgcaggctgccccagggcttctttatttcaaagcagcttcctgcatgaaagccttttccttctctgtagttaaggttggggtacctcacccccacttccactcctcttgtttccaatctcatctgaaacacctttccctctatgttcatctttcctctcaattccctccccttatttgccattgactctgtagttttttattacttgtgtccaggaggtgtttcgagaatgtgaactgaagtagtagtttatgaaattggcaacatctgtgctctgctgccctcagttttcttctggaaacttatgtggttagcactcaggtccaaggaaagcagaacacagaacgaactgaaagagaggcatacccaaatcatggaacaccatcagcatcagggctggctcctgcccacgtctcagctcccacctccaccctaagctacaggctgatagaagactatttctagagacaaacatcaagctggtgactgagggttttcctgctcactgtgaatttacttcctgggaaagatggtctcacttcctcacatcatctgggttcctctttgaggaaggcatcatgaaactgaaatataaaaacacttctgaaagaaaactcattctgaaattgtagggaggtcagagaatacaggacccaaaggatacccactctgtgctacctgcctaagacagaactaaggaaagagagatggctacagggaaccatgcaggctcatggtggtgctaggaaaaggtaatggactgatgctgccaggcagcctatctcagtcttttctttcttctttcttcttcttctttttttttgtagagatgggatctcactatgttgcccaggctggagtacagtggtgtgatcatagctcactggagcctcgaactcctgagttcagtgatcttcccacctcaaccttctgagtatctgggattacaggcatgtgccaccatgtccagctaattaggtttttatttttttattttggagagatggggtctcactatgttgcccaggctaggcaaactcttggcctcaatcaatcctctcgcctcagtttccagagtagctaggactacaggcacatgccaccatcgacagctaattttgtacttctttgtagagacagggtctcactacgttgcccaagctggtctgaaactcctgggctcaagtgatcctcccacctcagcgtcccaaacctttgggattacaagtgcgagccactgcacctggccccattactcagacctttctaaggttgttttgttgacagcaaatgtgctccaggcactgtgctgggctctagggatatagcaaagaacaggacacagttactgccttgaggagcttatagtctggtatctgtgtgggacacagtgtccacatttggaactttcctggctactatgctatctggcaccttgacttgaatatgtaccatctcttcagcattttcagtggccccagagacagaaactgcatctcatttatctgtacccccaacatctagcacactacttaaaatatggtaggtacccaataaacatttgttagatgaataaaggaaggaaagaaaggagaagggaaggacggaaggaaaaagggctagatgaggtgtcccagaaatgtttcatattgactggagatgatgttgagtaactttcataggagccaatctcagggaaatgcttgagtccctgatgatcattgattggaccccccagaaacaaccctcccagtcaagatgtctctgaagcaactagaatcctgaagcagttcccaaagtcatgggacaaaagctcaggcatacctaggtcagcttcacagatgctagtgactttgaattggtcacttttattgtagtgtttattcatccttgaaggtattaaaataatagggtagaaaaatagtttgatggttcctcaaaaagttaaacatggaattaccatatgaccccacaattccacttctaggtatatactccccaaaaatcgaaaacagggactcaaatgagtacaagcacatgtgtgttcacaacagcactactcacaatagccaaaaggtgaaaacaacccaagcatccatcacatggtgaatagataaacaaaaaaatattgtatatctatacagtggaatattattcggctataaaaaggaatgaacttactgatatggattacaatgtggatgaaccttgaaaacattatgctaaaggacagaagccagacactgaggcctcatattgtatgattttatttacatgaaatatccaggataggtaaatttgtagagttggggcactgatgatttccagagtctgggagaaatgagaagaatctgcttaatgggtaagaggttttactttggaatgatggaaatgttttggaactagatagaggtgatggttatgcaacatgtgaatatactaaatgccacttaattattcagtttaaaatgtttaattttatgtgaatttcacctcagttaattattttactttggaaaaagtcaaagtagaacagcctcaattctgtggacaaactgggtagttgtgggaagggtagactagctgggtgtagagtgggaactatttccttccctacccaccaccccaccactccccaatgcttgttcctttcttcagctaagtcaagtgtttattcctatctccattcctgttcatatccaagaatcatctggaattattcttaagaatattctacttctctaaggactgttcatcagaaaaaggcagttgtaatttattgggagtccttctaagaaaccccaaatatcaaagattttaggaatatggaaaccatcatgtagacctatgtcagcttaagaagatggccttttgaggagagtcgtcagaaaatgttgatgtagccaaggtgatgggtgcatacaaaatgctgggtacctgggggatgctaggaaatgcttgttgattgactgattccttgattgagtaaaaaaagacatttgcattatcctaagtgaactaacacaggcacaggaaaccaaatactgcatgttctcactgataagtaggagctaaactttgagtacacatggacataaagaagggaacagcagacactggggcctaactgagggtggagggtgggaggagtgtgaggatcaaaaaagtacatattgggtactgtgcttattacctgggtggtgaaataatctgtacaccaaactcccgtgacacaaagtttacttatataacaaacctacacatgtactcctgaacctaaaataaaaggttttgtttgtttgctttttttttttttaaaaaagccagcaatggcaatagccaggaaggcacacccagcagagggaatggcaagagtaagagcaggaccaaagaattataccacccggaattatgctgcagatgttgacacagcagagagcttcaggagaaatagaggatgggaatctttctttacctaactctgctactgagatcctttggaaaagtagtgatgaaatgaaaaatacaaatatcaaggcaacaaaatctgaaaaaaatagaattagtgctgaaatataattaactgattttctatttgaatcatcgtatgacattcatagaatacttgcatcatggaactatttataagatttttctgctaatagtcaacacctcaacaactgtcaactcactttttgctcattcacaaaaaaatatcttagaaaacttaaggagaacaactctttagtctaaatggcaagtcttgttttataaaataatatctcaacatagctgcatgtgaaaaatggtcatttttaagcagtctttgtaaaagtaacaatgaattttgaagtagaagctgatgctttgtgtcttctgctatttgtgtggtcaatgacacggctactgctcccagagtaaacgatacgtgccagtgaatattttgtgcaagttaaatgttcatcatcctctttctgagaaataaaaatgcattactttaaaaacaaccaaaaaaggacatttaaacaaaggattcccctccagtagactctcgtttatgggcttcagaccacattttgtgtaagagctttcagtcatccattttttctttcattccacaaaaatttattgagcacctgctgtgttccaggaaatacagtaatagggatgcgccatcataggcatggataaaggaaattcacatacaatccccccaatttttttttcttttgagatggagtgtcactctgttgcccaggctggagtgcggtggtatgatctcagctcactgcaacctctgcctcccgggttcaagcgattctcctgcctcaacctcccaactagctgggattacaggcatgtgtcaccatgcccggctaatttttgtatttttagtagaaacagggttagaccatgttggccaggctggtcttgaactcatgacttcaagtgatccagctgccttggcttcccaaagtgctgggattacaggtatgagccactgtgcccagcctacaatcccccaaattctttgtaagcataatttcaaccctttactatctctaaactttgagcttgagtaagctgatgggcaagaacagggcaagttatggtgacgatagtggtgtgtccacaaactggaatatgtgatccaataagtatggttaatggacaacagagaagaatacttgcaaatagggctattgaaggaaatggccctttgacaagggaggtggaacagttgggggaaagcctggtcaatgtcttcttccttctgtcctgtccccttccccatgcctggaccacctggaaactatggattaaagcagtattctcttgcacccctatggctacacacacccctgggtgcagcggctgctttcccctatctccagcatagctcatgagggactccatgtgagcgctgggttgcctgaaattgagggaaagcaatctggtcagaactaagtagggcctgcttcttgttgcctatgctacagttaatccattgccatctgtctttattttgctgactcactgctttcatttgggttggcagttcttttgctgttggctgcagtctttaactgtttacggaggactgagatggatggagaattaggggctttgcattcattcgctgaatgaaatcctacccaggtactgtgggcctcttgtcgaggggctgaggccaaggcccctggattttgatggatggtggagattaagtgtagggtaacacatcatttagtctgattgcaaggccaggtttctcccaagcattgccaaatgagctgggaggtcatgcgaattgtctgcccaagcacaagggagcgtgatatcttttaattagagtaaggatgaaggatattagggaccttggtctgtcagagaacttggaacacccaaatgctatacttcattcaagtttctctttaagtttcaccttatccatggaagcttttctgcataaacttccatccccacactgcatcccatccctcctccgaaatgcacttccctgcgctttgaatctcatcagcatttggcttcaactgtatacaatcttggctcccacagccattttgaagctgcccttcagcagatttgagacccattctttatcctgtgagatagaaccttatcaagatgtgaaactctgtagcctttatagctcattttgttatatggcaattggatcctgggaaaaggtgacttggaggaagccatcattggcctttgagacctataggaattcagtagaaacactttcaggatgctttgtcaaatgacttgtgttaagatgccaagggtttgtcgtgggctcatgtaagttttaacccttttcaaggctactttctgtaagcattgtatcatttctggggtagagggagttgagggttttttggtatatctgcctactcagccttggtgtcaaccagtacttcctgggatttggggtaggaacaatagaagttaaaaaggaactttgtgttttaggtagggggaacgtaggtactggtttgctcaggatagtcctgtgttacacctgctgtcctagtgtcattatcgaaggcacatttgtgcccttcacccacaaaagtgttccagtttgtacaataaacttagctttaggcagcaccttagctttaggcagcaaatatgtaatgtacaggatcacacccagagctagaaagactacagagttttgcagttgatgagcttctatctcactgggataaagaacgggctttcaaatctgctgaaggacagcttcagaatggctgtgggagccaggattgcacacagtggaaacaaaatcctgatgagattcaaagtgcagggaagtgcatttcagaggaggggtgaggtgcagtgaggggatggaagtttttgcagaaaagcttccacggataaggtgaagtttggagagaaacttggctgggtgaggtggctcatgcctgtaatccctacactttgggaggccgaggcaggggaattgcttgggtccaggagttcaagaccagcctgggcaacatagtgagaccctgtctgtatgatttttttaaattagctagccaggtgtagtggatcacaactgtggtcccaactactcgggcggctgaggtgggaggtttgcttgaccccaggagactgaggctgcagtgagtcatgatcataccactacactccagtctgggcaacagagtgagaccctgtctccagagagagaaagagagagaaatgtgaatgaaatatagcatttgggtgttccaagttctctgacagaccaaggttctgaatatccttcatccttattctaattaaaaaacaccacactcccttttgcttgggcagataattcacatgacctcccagcttgtttggcagcaatatgttttataattatatattttataagcaagtgtaaaaaatacttgcttataaaagttgttcccttaacaacttaagattgcatggtcagactatcccagggaaagggcttctccaagccaccaaccctagaaagtatcctctaccaatcggacaggatcaaaacgtcacctccaggaattggagctctcagacactgctggcaggactgtaaaatggtgcagacactttgcaaaactgtttggaaattctcaaacaattcaacatagagttaccatatgactcagcagttccactcctacacatatacccgagagaagtgaaaacatatgtctacacaatagcttgtacatgaatgttcatggcggtattattcataatagccaagaagaggaaacaactcaaacgtctatcaactgatgaatggataaacaaaatgtagtatatccatataagggaatattatttaaccatgaaaaggagtagagaactgatatatgccacaacacggatgaactttgcaaacataatgctaagtgaaagatgccatcacaaaagactgcatcatattattccatttctaggaaatgtcaaaacaggcaaatccatacaaatagaaattagattactggttccctaggactgagcagggtggggattcagggatggaagagtgacagcttaatggtacagagtttcttttgggggtgattaaaatgttctaaaattgattgtggtgatggttgcagaactccacgaacatactaaaaaccactgaattgtgccatttaaatgggtgaattgtatggaatgtaatttagatctcaataaagccattaaacgtgtggcctccaggcataactcagactcagtaccagctacccagttaggcttgcactcctttagcaaggacatgggcactctcttccagagagctcttctcaggcttcaaaatgggcaagcatgaacttgggcaaatgcctcataagtgcaaaccagtgggaagaagccttgttaatacccataagcctttggggtttttttccccctttatagaaacatccaacccagagccacagagtccaataataattgacagacaagaaccttagagcttgcctactccaatccctctgtgtagatgctcagaaagaggaagtgacttgctcaagtcacacagctagtcagtggcaggacatggaccagaacctgatgctcctaactcccactccagtgctctttctcctgtcctggcttctccactacttccctttcccctgccttgcccaaatcagcccctttggcccttcttgctaaaatctaggagtcaagtctgagaatccaagcacaaaatcagggtgaatttacaattttggaaatatggtacaattttcctaagtagtagatcagaagatctgtattataggtcttccaacatcaggatgtggatggagtacaggatttgacccctggtacaactaaatttgtggaataatcacatgcttctttttatactgtatttggcagtattagaagagaaaaataatattcatcttaggaaaaccttggtaactgcaaatttgctggcaaccttatttcctcttgctttcttggaagaaatcaaacgaaaaagcagctgtacaaattagccctgaccaacaggctcaggaccaaaacaaaacaaaacaaaaaataataaagccaaaaacaaattaagcttaatatttaaatcagaatggaaaatatatccaactatacgcctactggaacccttgaaactgctaatctctacttgattattcacaacctgacctttgcaggaggtcaggacaaagctggggacagtctgaccgaaatgtatcagcaattttccaaactccttcatctgcattcacagattttcctgataaccctaagagcagcaaaaccattgatcatgcttgttggagtcctattagtaccacagtgaaaagaaaatgtgcttagtaggccatcagtcaacagaccctgtgtgccaggtacaatgccagtgctagggggagacaagacggggaagaaatgatgcctaccaacaggagccatacacccccaaaatagggtgaaccaggcatggtgtagggcaagagcatggggcaagagcaaagctgaagggctaggagagtagatgtatgttgaataacattgaggggactagtctttctggaatagagatttcttttgagggagttaatgggatgtttgattgaaaaagaaggttggagacagattgtggaggcaaaatggagcattttgaagaggtgagtggccagatgaaaaccacatcaggggagccttctcttcagcctcccctcaacactggttttggtattctctgggctcccacaaccccctgggccttatcctagcactttacacattttcctgtaattcactgcttccttgtacttcttccctcaaactgatttccttgtgggaacagcttacatctggttgatgcatatatccctaatgcctaacaaagggtttaacacgtggtcagcactcaggaaatgtgtgttgatgggatgggacaggacgggatgggacttgatagaaggttagatctgtggaggagccatctggaagagaaggcaggaagaggagatcagttagaaggatgttgccctgggagatgaggaaatatggccctgacccaaagcagtagcgatggtgacagagaagaagggaggatgtctgatgtattttgaaagaagaatagacaggacttgggaaccttagttaacactgacctgaggaaacaatgcaaaaggactgtggaaccaaagtaggttccccatgaggcagtgtggtaggtcctacagaccccaataggattaaccagcctccatttgcactttgtggacaattggttatgagcacagctgtacttttcatgtctagaggtgaaagggactagaccattgctgaggggactttgcccagctgtctctgtgccggctgtgctaagtccccagggagctcatgctgaccaataaggcaaagctcaggagtgatgaaccaccgtttggctgtcttaatcctaaggcctcaactcagctctgaccacctggaggtgtcacacaaagaagtccaaaataaagaagagtgtcagcccaagaaacaagagtctccttttcctagccatgcctatttcgttccaccttcagtctttctgcagctcaggaagggaggggtgagagaaaaccacggaacttttcaaaatcccattttccaaaagctaaatcagattcattctgtgtctcctgcgcagactgcattagtctgggtaatgtaaacactgtgaggccacagctgtctgccagctgcaacgttaaagcccgttttggggggcatgaaaaaacctgtctgtaactatcacagatgagaagtgttagttaatgaatggtccctgctgagtccagagcccagctgagttatttcagtcttgagccttagcagagatttttattgggtaacaaatttcaaatgctccagttacccctagaccccagattggagctcgttgctcaatccaacccccacgccccagccaaaactaattcactccagggacattcctgattgcagctcaagaatcttggtgtttggagtgttgggtgattgctcaaggaggatttggtaagggcttaataataacatcagcctccttgtgctccctgcagaagtgtggagagtgacctttttcaagagtagggccatccgtggcttccaccagggctggtcagcttggagcagcctaaggaatggtggctttgagttggacaccactgtttctgctgggccttggcttaaagctctgggttttgctggcacctttccactcctactattctttctcctcctacatgggctcaggtcaggggcaaggccaagagggccaacaaaccaccagctgcattgagacaggggctagggcccaggcctttacgtgcataattcagtggcatttcgtacgttcacaatattataccatcatgacctttgtttagttctggaacatttttatcatcgccaaagaagatccccatacctgttaagcactcatttcccatcccctcccctccctgtaccggctcccggaaaccactaatttgctacctgtctctgtggatttgcctattctggacgtttcatacaaacggaatcatacagtatgtggtctttgttgtcaagccagtattctttgagtacccactgtaatagacatgaggattcctcctcaggtgcagcagctactgctttttagaatacttagcttaatcaaggcacatgctgggtgattgatttgcaccattctgtttaatcttcacaacaactctctaaagtagataataataatgttcccatttcaaagatgagtagtccaagactaagagaaattgagtagcttggccaagatcgcactagtagttaagattccaactcaagtccttccattatttatcatgtattcagccctacttagagccagtctacttacttagaagcaacatactctcttcgtggtatgtgctgcctgccccatcttgcccgcccttaaatccccactgtgacagaccccataggcaagggaataatctcatgagccccttgtgaaaatacccatgtgttggcagggctagtagcctggtatgagtgcccctagtattcatatgcccttgggcacacccagagttttctttagttcccagagagctgaatataaccccacctccttctctcccactcatgaaagcatatgggtatgttagtgagagttatttatagagaaatctttgaatctgctcaaatttatttttaagtaaatcatatgcaagctttggtatttgattattagaaataaataataagtgaggccaggcgtggtggctcacgcctgtaatcccagcactttgggaggccgaggggggcagatcacccgaggtcgggagtttgagaccagcctgaccaacatggagaaaccgcgtctctactaaaaatacaaaattagccaggtatggtggcgcatgcccgtaatcccagctactcaggagtctgaggcaggagaatggcttgaacctgggaggcggaggttgcagtgagcttagatcgcaccattgcactccagcctgggcaacaagagcgaaactctgtctcaaaaaaaaaaaaaaaaaaaagggaagaagaggaagaaagaaagaaataataactgattatcaaacaccaacgtgtcctgacatcaaaggtgagaatttttggtccaaacacatctagaggctgcaaagagctacacctcagctcagttacctccagtttgcaggtgaattcccagatcagtgaagttctccctgaagactgaagatcggattgtgtcaaaggtctggggtggccttcatgaagcagcctcaaaggctgtgcacctcatgtctggacttttgagcagtgactctggctgcatctgacagggactctcatgtcccaaccacatgtacaagaaatcacaagggcttgacccaagttctgcaataaaactcaagaaaaaggaaaaggaaaatgtgagttgttccactgttttaaagacttcaggatatatgttttaaaaattcacaaatgggagcggcactcaggaaagttcaatggaactgaaagagacaaatattgatactcaacagtcagcttcaataataataataataataatgggaccgcctgaattcaaataaatggaacagatgttcctcatgtgttctgagttgaaaatcattccttcatgtgggatcagttaaaaatcaagcttgggacttactgtatgtttaatataaaaactctcaataaaaatactttggaggcaaaatccaagtgagggcatgctgcaatcatcagtgcaaataatcaaccagtcagcatttgcctgtaagagaccaagggatgtacatgtgtgaggatgagaattactgagatagaggtggtgatagaaagttatttgccatcacatctaaccggagctcagcatgcaggggttttctcaatgtaagtgggacttggaaattgaagctgtggtgagccatggaaaaatggaaaaatcaattattttgatatttagtggacattagaggaattttcaaaagatgggctcttagaaataaatgaaactgtcccacagaatagctaatttcaacttgaaccagcccagccccagtatgggggtggatataacgagaggactttagtactttagtctgccatcagtactccatccacacctaacatcagagctggaagacatactagaaactatgatccaacattctcacttcactgataaggaaacaggcacaggagtctcttacacatgcccagggtcatagaggaaattcatctccaggcagaattcagggaacccactaaaagaaagaggcagaatcaaaatggaatatagaaaacattgttgccctttcacaatacaggcataacattaggattctacaagaaacaccaaactggcatgccctttcattccacagtaccagctaacagccctgttcattttaaagaattagtggagtaaaacagtcacccaatccaaaaaagagaaacaccaaacaggcagccacaaagaaggtcttgacgaaaccaggaaagggtcaagggcattgggaagctgccttacaaggccaggcaggaaagattaaagcaaaatagttggggaagatgaaggcatagaagggatgtcatataatcaaagtatatagagaaactcctgaaggtcgtggatccaggggagttagacacattcatcagattctggagtacaagagagatgcacagcctttgcagtgattatcaggaaaaacagactgaaaaaagcagctttactatacacagtggatatgggatgcccagtaaatgtgaaggaagtgtgcaaaccttattctgaaggtgttgtgaagttaaaaagcattttaatgcttccagtaaaccaattcttggtttaataataacattaataatagctaccatttattgagcacttacgatgtgccaggcaccatgctgagctctttacatggttttcttatttcctccttttacctttatttcatccttttttatttcatcctacagttgtgatgtaggcactacctccatttttcagatgaggaaaccaaggctcagagaggttaactcatcttccctaagtcagacagctagtcagtggtggaacctcccctcaaatccaggtctcccttaattccagagcacagaaacactcccccatcctgcctctgtaattgggacagcttggttgcttgagactctccctctgacaaaagtggtattttagaatgttcattctggctggtggaaaaagtgaactggaaagataggccccaggaccaaggaaccagttaggaggcagaaccaatgaaagggaatgaaaataaagaattctgtgaaatagaactggaaggagaaactgacagactccaaagacgaataggatcttactgtgccaggatctgcttttgccatttaggatatcgtggagatcttcctatgataagacatataaatctgccttgtaccttttgtgactgcttaggcattcaatctgtgggagtactactacgacaaacactgttctagtgagcatgctggatatacgtatatctttgtatactggtatgtatataagatcaattccaatcagtggaatttctggcctgaaagaaacatattttaaattttgatagactttttcgggaagattttcatagttgagtgattattattttaaattaggggtgtgggagggaaccttccttggtagatatactatagcagaaataaattagttggtcatcattcaaaagtgtaatcaaaaagcacaaggcctttcataccattcctaccaaacaacatcaatgttgtcgaagctaattacaggaagaaagggaacagaagacacagtaacccttttgggaaccattttcaaatggagaactgggaactcatctctcttcattacttaattttgagggaaggggaactatgctgaagtgttgagcagctggatagctgtggctgtcatttttttttttaagggaaagggtctcactctgtcacccaagctggagtgcagtggtgtgatcatatctcactgtagcctccaattcctgtgctcaagtgatcctcctgtgtggctgtcatttaatagacagcctattgagaggcttctaggaggaagattggcaaactgaatacagggcaattttcagatataataataacaacttgattttgtttgtagttgagaaggttggctattgtttttagttaggggatttaaataacttctttaaaacagctcccaaagggaagggaaggtaaactcaagtgttattatgaagtataatggtctgtccctccaagtgataagtttgattcactgctagcagagccagttctgcttggcacctccccagtactaactgcctctggccaaaaagctaccaggccctggtgccagatcctgggtgtcatgagccaagtaagaagaagggagtagatggggagagaagatagctgaggcaagctgtctctcccagagagatgggttacaacagaatccaatgcaagcttttattggagagacctatgtgtggagacaataggcctactttttaaatttccacaaaatgaactaggtacagaataccactattttattcattcacttgacaaatatttactgagcatctactatgtgccaggtactttgataaacactgggagtaaactgttgaacaaaacagaagtgtcccctgccctcagggagcttactgtttcataggcaaggtgagtgaaaagcaagtaaacacacaaatatagaattacagatggcaaaagaaaaaatacaggtggggcatggactaagggtcaggatggtgtcgccatggtggcctggcatttagagtgagttctgaataaagagaagggagccacctttcaggctgaagggaacgtgtgtgaaagcacttttgggattcaggctcttgaagtcgctggtcaggcaggaggctccctgaaatctgctccactttttgctcctcactgtgcaaaccaaagtgctctaggctttgtggttgctcagggcacagaggaccagatgggttccagagaccagcctgaaagttccccagtgaggatgcatggtgatagcctgcgagtttcagccagttggatgaggtgagcttccaaaatattcttaaaccctacagcctccgagacccatttcccagtgatttccattcctggtcatcactttctttctgcaggggacacttgcctgtggaaaagcagtgcctcgccttggttagggttaaagattgaggcagtgctggccttcaggaaaagtgcaagcagcaatggagagagagcaaaaactgaagccaaggaagcagcccctgccaacaacttccgttctttccctttccttcggcatggctgcccaaggagcccccagtgactgttcatggtgatctgtttgtttcacaattgacaaagaaggagggagccctttctgacatttttgcccagaggacccagatttctcagtttgaaactgccaaatacgcaactttgggtggatatttggctgaatcactttgaagggcttgtcagtgcctaaaatggaaattgttagaaagcagaggagggtggttgccagcaaccatgaaatggtaatgaccaaatcatttatttttgcaatgaaatgtcatcccctaacactacaaaggcaggttttttctagcttagaagtactgactacctataaaaatcttcaaaagtgattctgtgtgccatgcacatgtacacatataccccatttctctcaccctctgccttccctcctaaaccaagcttcttccatgttcctggagcccagctgcaacctgggatgaattaagatattggctgattatgaaaggtaatcaggcttcagctatcatataaaatgaaggggagttcatttggttatttgtaagatggtatgtggctgactttctatgtgggaaagtcagtaggctgtaatagatcatgccccaaaatacgatgtggatcttttaaagatctgtttgagtctagctgtagttgcacctaggagacatgatacttaataaggtttctcctatctatctatctatctatctatctatctatctatctatctatcatttatctgtcatctatctatctgcttcattagcaggcaaattaggcaagatctcccattgtgtactttgtatttttaaatgctgacaccttttttctgagtttaggaggaagatactggaaaatacattgtgggttgacactggggaatgcaagaggatctttctttgaaaacagccattaagatactattcccctgggccaattcctgggcagttttaaccacatacaaagccccaggttcttcttctagcttttctatattgactcctgtgttaagatcagtgaaaatttatactatcatataatttattttaaagtaatactttacaagcctttggcttgaaaatatttcagtaacatctgcacattcaatactgaaaagtaagatggctccattctgctctcattatagtaggctttgagaggtatcttttctttgtatcacagtcattagtccagtggttgatcagcttctttttcaacagaagtggctttttccaaagtcctttgtgattgttgatgtgggatctattctgaaagcaggtttgctgttaaggaaggttataggaacattaccgtttagccatggaccttgatcatctgaatgtggtagctgggtgttatctcagtgcatttgaagctcatgcttatggaatccctgttatgcaaggggttggggaagcccactggaaaaagtggctccagtgtggatgaatccgtccttcagattcctttgtagggttggcttaaagggcaattataaattagtctgtgtcatttctgtccatttcccaaccttttaagagctctcctggccctcgatctgcatgtatctaataccactttctcagcctcagtttcctaatatgtaacacgaaggacttggactagacaagctacaagttctccccaaactctgacacttgataaatctaatgcacttatcagcagagaggaatgtggctattttccaactctttctttagtttggggaaactaattttatataatgttctttccctgtgtttcccttttaaaaggaaaacatgacccatttccggtgttgtaaagtcaacactttgcagctctgcacgaggaagcttctttctatgtagaaggggcacagaatgccacgggaaccagggcaggaaccaacacctgacaagagatgcaggcacatgcggcatgtggggcgggctgtccctcacaggagccagaatcatcagtactagcctcagtcctcccatgcagctggccccactcagaagcataatggtgtggagcagagatccctgagctagcattcctggattagagtgcttactagctgtttacctccagtgagttaattaacctttctgtgcctcaggttcctaatctgtaaaatacgaataataatcacactactgcagagtacagttgcaaggattagataagatcacgtgggcatgtaaagtgcttagaacaacgtgtagcacacacatattaagtgctcggcaaatgttaactatttgtccattgggctcaaatgtccaagtatggatccaggagttgaaaggttggattccacagggccatcctccctcttgtgtccaagactctttgtggtctaggacaacttttgtgagaacaacttgtatctgctctggaatagatgactttcccttttctatagagctactgtccaactagcccagccttagtgtccctgggttcacaagtcagtgataatgaccaaaaatatgaaaaactatctgacgagagggaaagtgtgctcattgagaccccagcaataagcaattgtctgccattgcagaggatttaacagagctcagacgtgaaggctcttgtagttgacaaaggatctttagaaaagaatgttccctgagggtgctccatgtctacagaggcccaaacaagagaaaacagattgtggttagacccagggaagacatttttaccacacacagataaaatgctgggccacattcccaaaacaggttatgtagtgtcttcccctggtaaattgggaaaagagtggctggccatctgtcctagattgtttcatagaccaccagagcaggaagaacccttagaggtcatcatatccaaacctctattttaaggattgagaatgctaatacacagagggaggagataattgccctatagtcatatagcaaattattagcaggaccaggatttaaatcttaggccaacacagcttgccactgcaccttagttatctcttaaggcactcaaagtgctgtcccttctagttctggaatgctccatggtatcaatgtactaaaaaagtaactgaggcccacccagaaggactcgaaggtgttgagcagtatccaaattgcaattcctctagtttacccatccgattttggagctccagctgtcaaagtgtttcagccaagcctcctcattcaactaactggtcttaacttaccatttgaaagcagctgtggttaaagcagagcttgctgactcagcccatgtagtaaggatgactaaacacaagaatttcctgtggaggggggaggagggggatggaaaatatctttcaaatgcatttgtttcagggaacccttctgatcagtcaggaggtagcccaccgtgggcccatgaggaaaagcagcaggctgtccccgctcagcaccaaggcaggatttgcagatgtttcctttcttttttctaaacaacattgtggctgtctcggcaccattttggtctggccagcatttgcacagagcttcatctgccaactgatacagcccaaagccaagcggagcagatgccttccctgactggaggggcctttcacattcctctgctcagagcccaggggtgaattggggctgatctgctttatctcaagacagtttcaattctgagcccaccttgaactcaaaagagaggatcacttatgctgaccgatcagaaaatattgtgggctggcttccatctccaggatgcaccttggggagtttgcaatctggagtaacgttatcattttcaggtctgagtaccacacggccattggacaacttcaggaaacaaacattgaccttcagttgggttgctcaccagcttaaagcagtaatccagtgaacccaaaatttgggtaaatattttaagactgttggctggaaaagagtctgccttgctcaattagaaagtggaagacacctggtgcatttgggggtgacagattttatttacaacttgcaaaatagaaaagggcagcagggaaaaagagagagtgaacatactcagccatattctgaaagccatatacaactcaaacagttcagtcattgaggattcaagtccaagaggcctgcctcaccctcatgctcacaaggagaaaacaggactaactgcctccgaggtctcaaacaagaccgaggattttcttttctttttttttttttttttttttttttttttgagacagagcctgctctgttgcccgggctggagtgcagtggcacgatctcggctcgcggcaacctccacctcccgggttcaagcgattctcctgcctcagcctctcaagtagctgggatcacagttgcgcaccaccacacctggctaatttttgtagttttagtagagatgggatttcaccatgttggccaggctggtcttgaactccagaccttaagtgatccgccagactcagcctcccaaagtgctgggattacaggcatgagccactgcgcctggccaaggatctatttttcataagcaagtaaaaatttcttcatctaatgggggaaatgttctggaacaggcaatgtggagtaatggaaaacaaactggtctggcaagaggagaggggagaaggaaggagggagtgtcccagttcccttgggtgtgaagggtgacccaagaagtgtaagctttgaagtgttatcttacttttctaagcctgtttctgattcagtaaatactttagctacacatagtgcctagtaataatgttttctgaataagtgagagtgagagagaaaaagaaagcaatgaatatatgaatgaatatgtcaagaaagtgaattaatatatgacagaatggtaaggatttgcgtagttcatggagttggtttgaagcttaaatgaaataatggttatgagttctcattttctaacactacgcttaatacattatctgtatactcactatcttatttgaatctttcgaggctcctgtgagataggcagggtaaggactgtcacctgtctgatagagggaattgagtatcggagaggtggagaggcaatagatgatggaactaggggctccgcatgcagtgctccttctaacgtaccacacaacctcttactttcagatgaaaaaggtttttaaagaagaaagttctataggaccaccacataggatctatgacttacaactaagcaccttttatatgagggcttaaacactggaagtgggcttagaagaagaaatatcaggctaggactaacaatgctattgaagattatggtaagaacttgtcaactcaaaatacaagaggccagggggaaatggtgttggaatgacttgggtttggattatctaatatttttgtaaaagaacaatgggacctctagttggcaaggaactaacagttgctatttgaaataacatgggccactataagaaggttgactgtagactcaagtaagtcagccagtatctacttagtttgtcccatcaggtgtctggcctttcatgaagccataagctgtttagcaggaacagacttgtggtctgagtcttctccaggtttacatgggtcttagaacctttgactcatgatactgaatggtgctgtttaataaagtcatatagtctagtccccatccagtaaagctattcctatctgatgagtcactgtccaccctccagtgacaaaacaaatgaacaaacaaacaaacaaaaaacttactgcctactgtacctatagtttccagctttctgttctggacagttatgatggtcgtctgtgccatcatcatttctaattgcatggggcactagggaaatagagatatgttcattgtaagtgtacctcatgcaggcaattagacattgaaaacaaaattttcataaagcaaatccttatttttgtgccctagatcggcttgttatttaaagaaatcattgatctctagtttatcattttctaaaacacagaattaggttttctttttcttttcttttttcttttttttttttttgagatggagtcttgctttgtcacccaggctcaagtgcagtggcgcaatctcagctcactgcaacctccgcctcccaggttcaaacgcttctcctgcctcagcctcccaagtagctgggattacaggcgcatgccaccatgcctggctaatttttgtattttcagtggagatggggtttcaccatgttggccaggctggtcttgaactcctgacctcgtgatctgctcacctcgccctcccaaagtgctgggattacaggcatgagccaccgcgtccagccagaattaggttttcttaatgcaggagttttaaacatggggtctgttgctcttggactagctatgggaagctgggtgaatttttctgaaactatgtgcagaattgtgtttttgcttttacatacttttctgagaggatctacagctttcctcaaattctcaaaagggttaacacccaaaaaggtgaagaaaaactgggtgaaaaaaatggtggaactataattgtgtttgtgagtcctaaagtatgcagcttcaactgcaattttttaagaaggtggctttgtctctgtcaattgcatggtctggttctcttccttctgctgcctctgaaggataggtacccatgggacatagtgccaagctttgactttttctctgtcgtatttgcagggtattaaccatgctaataggagttgaatggcaattgttgtagactaaaataaggtattatttgataacatttctaattccttgtcctcagttgtcaaccccagagtacagcctataaggcagacatctttgttgcatgacttcagctttagaatcagagagctctgtgaccttgggaaagtcacttaatctctctgagcctcagttttcatctggcagatgggaataataacagggttgttgtgaggattataagtgagatgatgaggctgggcatggtggctcacgcctgtaatcacagccctttgggaggctgaggtgggcagatcgctggagcccaggaattcaagaccagcctaggcaacataacgaaaacacgtctctactaaaataaaaataaaaataaaagattagccaggcatggtggtgcacacctgtagtcccagcaactgaggaagctaaggtgggaggattgcttgagcctgggaggttgaggctacagtgagccatgatcgcaccactgcactccatcctgggcaacagagtgagaacctgtctcaaaaaaaaaagtgagatgatgtatataatgtgctggaaacatagtaagtgcttaataaatagcaatgccaatggtacctgtgctgataagcaagttcttaagaagatccaaagctctttcctgaggatatggatagctctgtctgggagctaccttgctgcccggggccatgctcagtggtccatccatgggcatgggaacaaaaacagtcggacctttgtcactttattcaaaacatagggtttggcctgttcaacacttgtactctgctagaaactgttgaggagccctgaaaccatgtttgactattaaacccagaagttctatgtagggaaaagggaggaacaattggtgcagtcacatcagctcaaaagttccagtcggtgctttgacccagcagcaataatagtgtccaaagggccttcccatccctgttctcattttatcctcaaaacagccatatgaggtaagcagagcaggtgctggagaagccacttattgcagcaatgatacaagcaggtccagaagttttaaggactttgtgaaaatgcagtggtttgtaaataagtaaaattcgtgtgttagcaggaaatgtttattgggtattcgtttttgaatattgagtttattgagtataactgaatatagcacagagctgggcacatggaaaggcttatatagtcagattggtgtggcaagaattccatgacaatgcatcaaaaagattatatatcatgaccaagtgggatttatccctgggatgcaaggtgagtttaacatacacacatcagtcaatgtgatacacctcattaacaaaatgaggctaaaaaccacctgatcatcttaatagatgcagacaaagtatttgacaaggttcaacatcctttgttgatacaaactctcaacaaattaagtatagaaggaacttacctcaacacagtaaagaccatttgtgaaaagcctgcagctaacatcataatcaatggggaaaaactggaagcttttcctcctctaagatccagtactaggcaaggatcccaatctcgccacttctattcaacatagtattggaagtactagccagagcaaccacacaccttttttgaaaggcatccaaataagaaaggaagaagtaggccaggcatggtggctcatgcctgtaatcccagcactttgggaggccgaggcaggcagatcacttgagttcaggagttcgagaccagcctggccaacatgacgaaaccctgcctgtactaaaaatacaaaaataagctgggcatggtggcttgtacctgtagtcccagctgcttgggaggctgaggcacgagaatcgcttgaacccgggaggtggaggttgcagtgagccaagaacgtgccagtgcactcctgactgggcaaaagagccagacccagtctccccacccccccaccaaaaaaaaaaagaaagaaagaaaagaaaggaagaagtaaaattatgcctttgtagatgacgtgatggcggctgcctataatcccagctacttgggaggctgaggcaggagaatagcttgaactaaggaggcgaaggctgcagtgagtcgagatcgcaccactgcactccagcctgggtgacagagcgagactctgtctaaaaaaaaaaagtgatattcagatttgatgtaatccctatcaaaattccagcagcatttttcacagaaagagaaaaacaattctaaaatttgtgtggaaccacaaaagaccccagatagctgaagcaatttttttttgttgttttgttttttttgttttgagacggagtcttgctctgtcgcccaggctggagtgcagtggcgcaatctcggctcactgcaagctctgcctcccgggttcacaccattctcctgcctcagcctcctgagtagctgggactacaggcgcccgccaccatgcccagctaattttttgtatttttagtagagatggggtttcgccatgttagccaggatggtctccatctcctgacctcgtgatctgcctgcctcggcctcccaaagtgctgggattacaggcgtgagccactgcgcccagctaaggtgaagcaatcttgagagggaaaaagagagaaagttgggggcactttctgatttcaaattatattacaggcaggtggtccagtggctcatgcctgtaactccagcgctttgggaagccaaggtgggaggatagcttgagtccagaagtttgaaaccagcctcagaaacacagcaagatcctgtctctacaaaataatttttttaattagctgggcatggtggtgcatgcctgtagttctagctaccagggaagctgaggtaggaggattacttgagcccaggagttcaaggttacactgtgctatgattttgccactgctctctagcctgagtgatgagcaagaccctgtctcttaaaaaaaattatattaaaaatctatagtaatcaaaacagtataactctggcattaaaaaaacacatagaccaatagaatagaatagagagcccataaataaacccaagcatacacagtcaactaatttttaacaagggtgccaagaagacaccatggggaaagggcatctcttcaacaaatggtgttgggaaaactggatatccacattcaaaagaatgagattagacttttataccatacatacaaatcaactcaaaattggttaaaggcctacatataagacctgaaaccataaagctagaagaaaacctagcagaaaagcgccttgacattagctttggcaatgatatttcagatatcacaccaaaagctcagattacaaaagcaaaaataaagaagtgagactacatcgagctaaaagcttctgtacagcaaggaaaataatcaacaaaatgaaaaggcagcctacagattgggggaaaatatttgcaaataatatatctaataaggggctaatatccaaaatatgtaaggaacacacacaactcaatggcaaaataaatcaataaataacctgatttaaaaatgggcaaaggatctgaatagacatttatctaaagaaaacatacaaatagccaacaagtatatgaaaaggtgcacaatatcactaatcattaaggagatgcaaatcaaaatcacaatgagatatcccctacatctgttaggttggctattgtcaacaagtcaaaagataacaagtgttggcaaagatgtggagaaaaagggacccacctgtacactgctggtgggaatgtaaatgagtaaagccattgtggaaaacaggatagaggttcctgaaaaaattaaaagtggaattaccatatggcctatcaattccccttctggatatatacccaaaggaaatgaaatcaacaccttgtagagatatctgtcctcccatgttcattgcagcattaatcacaatagccaagattcagaaacaatttgtgtccatggatggatgcatggataaagaaattgtggtggccgggcacagtggtacacgcctgtaatcccaatgctttgggaggccgaggcaggaggatagtttgaagccaggagttcgagaccagcctgtgcaatatagtgacaccctatctttacaaaagtaaaaaaaaagaaaaagaaaaaaaattagctgggcatgataatgcacatctgtagtgccagctactcaggaggtggaggtaggaggatagcttgagcccaagagtttgaagctacaatgagctatgatggcaccactgcactccagcctgggcaacaaagtgagactctatctctatataaaaaatgaaattgtggtatgtatgtatattgtgtgtgtgtgtgtgtgtgtatcatatatacagaatactattcagcctagaagagagggtgatcctgccatttgtgacaacatggctgaacctggaagacattaggctaagtgaaataaaccaggcacagaaagaaaatactgaatgatctcacttatatgtagaatttttaaaaagagctgatgatgtacagcataaggactatagttaatgacattatatgtaatttcctaagagagtggagtttagatgctcttaccacacaaaaaagtacttatgtgaagtgatggatatattaatttgcttgattgtattattttactgtatatatatatacacatcatgttatacacctcaaatatatatgcaataaacattttaaaagaatatgtgaaagtaaaatcataagaaagtataactagacactgggtggtctggtacagctaagagctgtgagactgtagcaaagggaagatgtaggtcggttgcaggatccagggaaggcttcctggaggaggtgggccctgggctgctagggaggtggagggaagcagtgtggcaggcagataagcaggagcatagaggctgggatgagcaggctgggggaatggaggggctcacacagtggtcagccggggggtcgctttgggaaatagtggtaattttgattaaagaggttatggaaggcattgattgctcaaacaagggaaggggactggacttgatttcgtaggcggtgaggggctgtgaggtatggcaacagagcggcaagaaaaggcagtggagttgggagagtccagctgggagccaggagtaagaatctagccatcaatgatcagagtctgggctaggacgaagccatagaaacagagaaaggggaaggatgaaagcgctcactggtctctagagcctttgcttggagtaacacaaagacctttctctctgtaaggagcaagtccatttttggtctttatatttctacagcatgagaaatgcctctttcatccaggagcacgtgccctgcttgaagaaaaccaggcaagacagcttgcaaaggagagagcctgggagatgacttttcatgttgcacaatggttcttcaccaaaggagtcacagagggtcttttgacatagacactgccctaacttatgtgcaagttactgccctgcatcctagggaggctttggggtgtgggatgacaaagtacctccacagtccccttcctccgcctctgcccatagttctacttgatgtaacaggtcttgtgagtcttttcaggtgggaaaatgctctctcagccttcacaggtcagtcatgaacctgatcccacatggacacaattctgttgacattttagcatgaaaggtacaaaagggaaatctgcaaaggggtctcaggattcagttccctggatcgtcctgtgcatttctttctcagatttgaggtttttccttttattttggagatggggcctcactatgttgttcaggctgatctggaactcccaggctcaagtgatcctcccaactcagcctcccgagttgctggggttaccagtgttagccacccaacccatctcagatttgagcatttctttcagaaatatgagtgaggtggtttcatgtggagacccctctgaggctctgaagcatcatttctacctgctatgtgtgcctgagaaacccatgcctggcccaatccccatataccctcaagtacaaatgggataataggaccccctgggggtccatgcacttgaccaaggttgctcttagaggctggattcagcacagattcagctactccggctcaggggcagggcaaagcaaaggtaccaatacattcatctggctggaaaaggaggattttgtttttacgaactttaaaggaatataaaaatgactttgttgtgattgaattgccttgctggatgaagtgccctgtggctccagggcttagagaggcttgtatggagactgtgtatttccttatgtatgtttctatatagatatatttccttatatacaaacatctgcacaattgtgtttgggagccccaggctaaaactaagaccctgacatgtttgaaactttgctggatagaaactaggggtggagaaatcctgtttaattgctgcaagtagtttttagcttataagagatgaaacatttgatattcatttaggacaaactcttcctgttttaatgatagcatctcctatgtattgagagcttcctatgtgtccggcactgtgctaaacgctttacatacataatctcatttaatcttcacagtgtccttaaaagtgaggtactattgttgtcctccattttacagagaaggaaagtgatgggaagagaggttgagggacttgattaaggcaaggtggctaataggtggaaagctggggtttgaactgtagtcttaatgactgtgcaaaacatccttgtgagaactacttaagtttcttctccctgcaaatttaaagcaaatactttctaatgaaatcaggtgtggtacaagaagcaaaaatggctttgcaaggaggaagatatacaaagtcatctaccagggaggcagagtagcatttctgcaaactagtttgctattggagcaattacatctcggctgaagagagaacaagtacggtgaggtgatggagtggagtttgactttgagtcccttgagtgcaagaaggccaagagccagaggctgacaggcctgagaaaccatagcacccatggagctgcttctaagcccaggggttcaagtgtgacctagagttgggcagagcagacaaccagctcgttgcactaaacctacacctgccttgtgtctcgtgcctttttatcatggtagtttttaactcgttatttctggcacactggaaagttttcatttttgggttgtccactgtgcatctaactaccgcattgaactcttattcattcttttgcgaaattttaattcagttacacctcttgggtttctagatatgcaagcatatcattgcaaatatatatgcatatatatatacatatgtatatatgcatatatatacatatgtgtatatgcatatatacatatgtatatgtatgtgtgtgtgtgtatatatatatctatatatataatctatatatctatatccactttacagataaagaaactaaggcactcagagaggtttagaaattactctaggtcagacagctaataagtgatagtgcacagatttaaaaataggcctaccttcagatcctgagctgtaaagtactatacaatatctctcatacataaattacatttttataaaaatgagatgacactgtatacattctttgtaatgtcctttcacttaataactttcttatatgcctagatgtattcaataacataattttaaggatgtataaaatacctttatcataaaagtataggccaagcgtggtggctgatgcctgtaatcccagcactttgggaggtcaaggtgggcaaatcacttgagcccaggagttcgagaccaccctgggcaacatggcaaaaccccatctctacaaaaaaacacaaaaattagccagccatggtggtgcatacctataatcctataagctactcagaaggctgaggtaggaggatgcacacctataagcctataagctactcagaaggctggggtaggaggaacacttgagccttggaggtggaggtttgcatgagccttgatcataccactgcactctagccggggcaacagagtgagaccctgcctcaacaaaagtaaaataattaacatttattgagtgcttaagatggatgagacatcttaacatggattatttcaaataaatttgtttacatgaggcaggattactggttgttgtagtcatatcagttcagaaactccagcttgtcactctcctacttgctggcaccccagcctgtcaccctcgaccagctttggagctgtgggatctgcatggattgttatgctatccaatgcaaaatgcccttgttttattcatatgggtaaggagcaagcagcaagtatctggactgagcacagggcatggcaaaggcagccagagtgaccctccacgttgacaaggattcctgggaggatttaacattactagtctaaattagggaccaaggaaaactgttctcatctagtttcctggaagctttgcaatgatactggaaccctaggaaaaccatggccgagaagagattttaggaggtacaggagccaaaggtgaagagacaccattggtgggttgagggggaccaggtatagtgaaagcatcaacactaacatcttgcccacaaataagatcccttccagccaggtgcggtggctcacgcctgtaatcccagcactttgggaggccaaggcaggtagatcatgaggtcaggagttcaagaccagcctggccaacatggtgaaaccccgtctctactaaaaatataaaaattatccgggtgtggtggcgcacgcctgtaatcccagctactcaggaggctgaggcatgaggatcgcttgaacctgggaggcagaggttgcagtgagctgagattgcgccattgcactccagcctgggtgacagagcgagactgtctcaaaaaaaaaaaaaatttcttccactgatgcacaatgtctatttaatgctgctatgcttatactatgaactgaactttgtctcctcaaaattcacatactgaaactctaacccgaaatgtgatggcatttggaggtggggcttcagggaggtacttagatttagatgaggtcatgaaggtgggttccccgtgttgggatttgtgccctttatagaagaggaaaagaccagagcttggaactccctcactttctcttcacccagatgcaccaaggaaaggccacgtgaggcaggaagagggccttcaccaggaactgaattggacaacaccttgatcttggactttccagcttccaaaactgggagaaatcaatgtctgttgtatatatttttgctatggtggcctgagcagactaagacactggccatttacttcaactgattgcctacattttgaaagtgttagagaagaatggtttatgcttctcagatggctctcagaattacgttagaaaatatattttattcattctttaagaaaaatccgcaaacaattaccgagtacctgctatgtgccaggcactcttctaagcagtgaccaaggcagacatgatccctgccttcgtgtagcttacaatctaatggaaaaggcagatattgaacaaataatcttataaatagtgatgttatttccagttgttatgtggtgctaatgaagaagtgaaggagctatgaacagatataagaggggcccatgacctgaagagggaggatgagatggcttccctgtatgtgtgcatgcgctttccagggcatggtgggagatgacaatgacattactagcagaaagaatggcaccacaggccaggtgtggtggctcatgcctataatcctaacactttgagaggctgaggaaggaggatcatttgagcccaggaggtcaaggctacagtgagccatgattgcaccactgcactccagcctgggtgggagagtgagaccactgtctctaaaaaaagaaaaagaggccgggcacggtggctcactcctgtaatcccagcattttaagaggccgaggtgggtgaatcatgaggtcaggaggtacagaccatcctgaccaacatggtgaaaccccgtctctactaaaatataaaaaattagccggacatggtggcgggtgcctgtagtcccagctactcgggaggctgaggcaggggaatcacttgaacctgggaggcggagattgcagtgagcggagatggcgccactgcactccagcctggcgacagagcaagactccatctcaaaaaaaaaaaaaaagaaaaaagaaaaaaagaaaaagaagagtgatacaatttgatggaataaagcacatttacagtgttctccaaccaccaccactatttccagaacattttcatcatcccaaaggaaatcctatgcccctttaagtactcactccctgttgttccctcctccttgccctacataaccactgatctattttctgtatctgtggatgtgaacattctggatatttcatgtaactgggatcatatagcagtctttttgtgtctggctgctttcacttagcataatgttctcaaggtttatccaaattgtagcatgtatcagcacttcattcctttttatggctgaataatattccattgtactgatagactacattttgcttgtccgttcatcagctgatgaacatttggattgtttcaacctcttggctattatcaatagtgctgctaaacatttgggatacaagtttttgtttgaacacctatttccaattctattggatatgtatctaggaatagacttgctgggtcatatggtaattctgtgtttaacttactgaggaacaagaaaatagcactacttttattgttgtaaagaaaaactcaacaaccaaaacataatcatatggagatatatatttgtatttttcttttgcagcttgaaggaatacacatttgttgtctccatttttatggttcagtccaggcacagcttagctgggtcctctgctcagtgtgtcatgagcctgcagtccaggtgttgtctaggatgcattctcatctggagatctggagcttggggtccgcatccaaggttgttcaggttgttgacagaattgagttccttgctgctctagtgccgaggctctcacctcccggaggctgcccctctctccacaaccttgtttgcttcttcatgtccagcaggaaatgctgtctctcttcagggagggctaatagctttcacttgattacatcagccccacccaagataatgttttttatgttttgttacagtccagaggccttttttttttttttacatatatacctattatgccatgaattcatgcggagtaggttccagcagctccggctccttcccactggttcttgcacagtgtgcttctctgggtggagcgggctggtgcttcagttgaacccaggtacctttctctttggcttcctttttctctgaacagtttccttcatgcaattcaggatgctattttttggctcttaataaagtgcttaatatgctcaatatgcacattaattctcttggcaagaatcttaaccttgtgtttttaaaataatgccaacagcacactgggtaacaatgtaggctcttccagttttgccatgaaaacatttgtggggtattcctttctgaacagtgcccattcccttgatgtctacaatatcacctttcttgtagattcacaggtatgtggccaaaggaatgaacccacgttctctaaaaggcctagagaacacgtattgggtgcctcttctctttccctttgtgttcattattttggcaaaatactagaagatggtggttctggccaaaagtgatcatctgtcttttttattaactcaaaatcagctgatatgtgactttaattacatcttgaagctatattttaaaatattttgtacagatgtagagggtacaagtgcagacttcctacatgcatatattgtaccatggtggagtttgggcttttgatgtactcatcactcgaatagtgaacattgtacacaataggcaattttctgcaaaacacatgatttcattcttttttatggctgggtagtgttccatgatgtatagctaccatattttctttatccaatccaccactgatggacgcttaggttggttccattatctttgctattgtgaatagtgcagtgataaacatgagtgcaagtatctttgtcatataatgatttatttccctgtaggtagatacccagtagtgggactcctggatcgaatgatatttctaattttagttctttgagaatggatcaaatgacatttctattttttgttctttcagaactatccctactgttttccttaagttgtgctaatttacattctaaccaacagtacataagcattcccttttctccacatcctcaccaacatctatttttctttttaattatagccattctgactggtgtaagatggtatctcattgtggttttaatttgtgtttctctgattagtgatgttgagtgtttttttcacatgtttattggccacttgtatgtttaaagctatatttttaagcattatgataagcaatctagccagattagtgacaaaatgaaccctactctcaaggaggagaatccaagtgagtaattcagcacacgcacatcactacagttagaaaaactacacaaatacaacttttttttttttttgagatggagtctcactctgtcacccgggctggagtgcagtggtgcgattttggctcactgcagcctccgcctcccaggatcaagcgattctcctgcctcagcctcctgagtagctgggactacaggtgcatgccaccacacccagctaatttttttgtatctctagtagagacagggtttcaccatattggccaggatggtcttgatctcttgacctcgtgatccacccgcctcggcttcccaaagtgctgggattacaagcgtgagccaccatgcccggccacaaataccactttctattggccaacccaggaagaaacatgaacttccttcctcaagtttgaggctggagtctttgtcttagccttcagtcactagagtaagactggtgttctcctcatccaaccatgaacacattgaggacaagggcacatctgagtcatctctgtcatcccagtgcatggcacagtcaacatttgttggtggaaggaaggcaggaatgccacccatcccccccggggagatggtcttgggcacagtctctctttgcattgctcctgcagggtactgagccacctctaccctcacagcaacctcctctccatcatccatcacttcaggtcactcaatgatgagcaagccagctgatagcactttttagctacacaaatggataaatcacagaaaccaacatttgtcagactcagctatcctgattcttcttgtgaacaaaatgatcattaattcctttagacgagtcccccagtctccagccatttgtctcctttccccatgggcaaataaaaatgggaatcttattagtggtctctagtcatctcatagcattgcggggagagctgaagctggatgaatggacatccctgagcttgtggagttctcaccaagtgggcagtgactgggtatgatcccctttggagcctgtcactgctgttgacattgaaaataccggtgtggaaacaaatgctgtctttgtcacaggctcaactacaggggcctctccttccctaagctggcagctgagactaagtacttgagatccctgggccagctgttgtgaagtaaacgccaggcagtaggtaaggcaagattcagaactgggcagaaagccaggctggagagggagcactgataggaggggagcacaaaagttggcaaacaaatgctttccaagtaggttttaaaaaacacaatctggcctctaaagtagacaaagcaccaatggggggtgcaggggtgggggtgctgcctgaaaatgcctgctctgactatcagctcaagaagattctagaactggaaaggcactgtgagcaatgtttcccgaggaggcttcccttggagcacagaaagatagccacaccctttgaagttagctgggagcttacaaagggcagtgttgtttccactaaggaagaatgatagccctgcataatggtgtccttattctgtaaaccccagaccttgtgcgatgaggggcaagtgagcctgcaggccccagcaaagggggaggaaatggttggcaaaacacatacttttagcttgcttactggtcaacatggaaggtcttccctaggaagatggtgtggtcaaagtcaggggtctgtttcaactctcttccaaggatgattgctaaatcatatcaagatacctttttaatttgatgatggctgatgtaagtttccaaatgcttgcatcttctgtcatgtttgatgtatttcagtgaatcatgccacaagctgagaggccctagagatgaaaggctgatgagaaaaaacggatgagcccattgttttacatcagaatgtgaatggtgatatttctgagtagtgggattcctgtcacacaaaaggggaagtcagtaggctggcagtagctgccaagggcagcttattggacaattattagggaatggaatcctaaaattggaattttaacatagccttgatcaactttggaatgcctatggtattgcatcatacatgcttatgtcagggaccacttccaaaattctgactcatctcccaggccaatgaaaccatttcagcatgtgaattacacccctggtgttgtccaagggaatttttgtcagccctggtgcccaggactgattccattaggcctaggagaagctgtgtggtgcaacagaaagagccatgaggagccctgagctctagtcctagctctgttgccaattaactgtcattccaagtgaatcttttagtgaatctgtgtcttggtttcttcagcagttgaaaagagacagttgaatttgatgagttagtctcttacggctttaaaaataaaaatgcatgtttcatagcttggcatttaacaaagaattgtggatatgtaagtaatctaattttataattttctttaggtatgaaagggaccttaaacatcgtatagtccaacccctttatcatacagatgtagaaaccaaggtccagaaaggggaagggatttgatcaattagtgcagaattagggttagagatcaggtttctggattcccagtccagtgcattttccactacatttatttttaaatcaagtaatacatgagcatggtttaaaaatatcaaataggcagctgggtgcggttgctcacacctgtaatcccagcactttgggaggctgaggcgggtggatcacgaggtcaggggatcgagaccatcctggctaacacggtgaaaccccatctctactaaaaatacaaaatacccaggcgtggtggcgggcacctgtagtcccagctactcgggaggctgaggcaggagaatggcgtgaacctgggaggtggagcttgcagtgagtggagatcatgccactgcactccagcctgggtgacagagcaagactctgtctcaaaaaagaaaaaaaaaaaaaaaaaaaaaaaaaaaaaaaaaaatatatatatatatatatatatatatatatatatatatatatataaaatacagagagctgataataaaaaacaacagttctctgccccactcctccccatccccagtcccactcctcagaggcaaccattttttaacagattctgttggcaattcatctgatagttacttctgaatctctaaatattactctgttcccattcttgatttatccattttggacattatctattaactcctgttataaaaatggaagatttagctcacttaacattactcccaactgcctctctttcttctgcctccccatggttgatagcaatattttatgagatttttaaaaattcactttttaaaatagcatgctattttaaaaatttacttttttggtgtacagctctatgagtttaggcaaatacataaagtcatgtaactgccaccacaatcatgatatagaacagttccattaccccccaaatcccctcatgctgccctttgtaattggcttctccctttaccccctacactgatctgttttgttgctacaattttgtcttttccagaatgcccagaaattgaatcatatactatataaccctttgatactgacttctttcactcagtataactattttgagattcatgtatgtgttgttcattcttttgtattgctgaatagtactccactgcatggatgtaccacagcttatccattcaccagttgcagaccatttcagttgtttccagtttgatagcattatttttagttattctattggttactttttaactgaaaatcatatactgaaacctctacttcttgcaccatcatccactatatagtaagtaggtcttctttttcagaatagtaaatgctttggactgattgaaaaacataatactttcatttctttagtcacagttttagacggatttaatttgagggtgtgatttttcatggggttgggaaggtttgctcaaatgctgtccagcagccctattcaaggctacagccattctaaatgcctcctgtcacatagggggccttctctagtaccagatatgcttgttgctgggaagatacgcatgtactttctgttctgaccgttgctaactcaggcagtagtttttgggaaaaagacctttcttcatgtggatttcagcttttgtctgtcatgctttttctgttccagctgccttcaccagtgagcacaaagccacatttcaaaggaaactgacaaattatccccagctgccagaagaaggttagttttctgtgtgttcagtgtcccccttctctgataaccaacaggttaactttctaaagggaactgacaaaagcagaaattgtccttttacccaaatgagttgtgattgttgatttttttaaagatgtggatttgtaatattcctctccattcctactctaatttataccaggaaatagagtgtaagtgatcacaatggaacctctattgtttgcaagattcatattaatgcattctggttttttaagtgcttacaagatctaaattaatttttaaattagctagcatagtgtctttactcaatgagtagccatttaaaggctgaatgatgtcagccctggccatagagatttatgtgttgttatatttcatttgcatttttaaccatctttgtacatgtgttatgcctctagcacttatgctgtataacaggagagagtctaatgcctagcacagtacactacatatagtaggtgctcactaaatgccatttgaattgaaatgatccaaaagagtgtcatgtatatatgatggtaaaatattctgtgttaatgcagtgagtcaggcattctcaaacactaataggaatgcaaattggtacaactctcccacagggcaacttggcaaaatgctcgaaagccttaacaatgttcttatcctttcacccagtaattctccttctaaggatttatcctaaaaggaaatagagatgcacaaaaaaatacaaatacatggaaattcattgtggcaatatttaaaatagagaaaaagtggaaaaaacttaagttgtccatactatgaaatcctatgcagtaacatttatactatgaaatgcaatgtaattatttaaaatcatgtttagaagaatatttaatgacatgagtaaatgctcatggtctaacttaagtgggggaaaggaggatacacaaacatacagtgaaatcccaagtgtgtttgtgtgtgtgtgtgtgtgtgtgtgtgtgtgtgaagaaaaaaaatgactagaaagaaataatagaaatattaacaatgattagccagccatggtggcacatgcctgtggtcctacctactcagcaggctgagatgtgaggatcctttgaagtttgaggctgcagtgagctgtgattgcaccaccgtgctccagcctgggtgaccatgtccctaaacaacaaaccacaaagctataattatccctacgttgtgggattatgagtcattttcattttcttatttttgtaatgagcttatcttactttaaaatccaaatttttttaatttgaaagaagtaactactacttatgctagagggctgacattcataaaatcctagtaatgagatgtagaaccatttctccaactagtgtcaaatcttcatccttaaaaaaaaaaaaaatgagatcgggtctcactctgttgcccatgctagagtgcggtgggctgatcatagctcactgtagcctcaaactcttgaactcagtgtcaactcttcagatgacatgtggatggttacggcagtggtcagtttttagaaaaattaaataaagcccagaagccatttcagatttaaatgctctgaggggtggggtacagtggctcatgcctgtaatcccaccactttgggaggccaaggtgggtggctcacttaagcctaggtgttcaagaccagcctgggcaacgtggcaaaacctcattatacaaaaaatttaaaaaattagccaggtctggtgacatgcacatgtagtcccagctactctggaggctgaggtgggaggattgcttgaggtcagaagttccagaccagcctgggcaacataggaagaccccatttcaacaaagaaaaaaatgtgaaaaataagtcagacatggtggtatatgcctgtagtccgagctactcaggaggctgaggcaggaagatcgcttgagcccaggagttcaaggctgcagtgagctgtgatcatgccactgcactccagcctattattatttcaataataataataataataatgctctgagccttagtttgatattgaaaggaaaatatgtttatccttttctctaggcctagttaattttcatccttttctctccatccccacccctttttaaactttccagatctgtggaacaaatgttgagcaaactggaaataaataaaatccaatggctttaagataccacaaatccctcccttcctgtgtactaatggctacctgcccattctactccccagagtgaagggctagagtcagccaaaatggaggcttttctgattcaaacatgaaaaatgcaaatgctcaaaagatagaaaaacttaggaagtctgaaaagattgagacataacatgtacaactctccctcccctagattcttagcttcacgtgatataaactgttgggctctgctgggggaaaaacccaatcatagaaggcagatatattagtctgttctcatgctgctctgcagaaatacccaagcctgggtaatttataaaggaaaaaggtttaattgactcacagttccacatggctggggaggcctcaggaaacttacactcatggcggaaggggaagcaaacatgtctttcttcatgtggtggcaggagagagaagtgctgagtaaaagagagaaaagcctcttataaaaccatcagatcctgtaagaactcactcactatcacgagaacagcatgagtgtaggcacccccatgattcaattacctcccaccaggtccctcccacgacacttggagattatgagaactacaattcaacatgagatttcggtggtgacacagccaaaccatatcagcagatgtattaaggacagttcatatttcaaagaaatcacacaatcctagacctttagatctggaaggaaaatattccagcaagtatagggctccttccaaataccagatactatgctaatccaaatgttatctcataaaaaaccacctaccatcgcacctcattttatacatgaggaaactaaagcccagagaggggttattaactatcttagctcacatcatttgttggctgctaagttgtgatagttcccatatcttctggaaactctcaagtgaaaagatgggtttttctagtataatctttccttcagctccaaatattccaaatacttactgtgtacttgtgcttggatgttttgctaacagctcaagctaatcaggtacaaagtcaaactcatggtgtttccctcatctccctgtcacccaggatctgaaccaaagtctgttttgctttttactgaatttcatcccccacaaacagtctgttaacaagtcctgtcaattttttccttcaaaaactaccgccaggtcctaacatattgtcaaggaaactcaacctctacctccttaaaaaaacaacccttctcgaccacttcagccatactgctgcctctcttctggcttcatacagcacttttaatctgcatcacacagtttagtttagcacttgtcattcaggggcaattagcatgtgctcagcagcattcactcatgcaacaagcatgtattgagtgtctactatattctacaccctgaaatggagaattcacttttcttgttttcccatatagacatcaaataccctgagagtcgaggccacatctttcttcatagtttcttaaacacccagtgcagttctgggcacatactgaagatctgttagttaaagagcagtacagactcaaggaatctgtcaccagttcagcagctgacgagctcagctcaggggacactttagtctatagttctgcttcaacatctcacaagctacacgagtatgatccactcattcaacaaagacaacgtattaaaatgtgagtttttaacaccataccttcagagataagtaatgagatctaataactaatcagagacgtgggatcctaaaagtcaacttctgcttttagaaagatggagtagatgtacttttccctattcctttcactaagtacaactataaaccctagttattatatatacaacaaacataagacaaccaagaaaggtggagagaagatagactgactaaggaccttgagactcaaagagtgacatgagttcgtgagttccctgagctttctttttgcctcaaatatcccagactggctgctagagaagctagcaattcagaaacaccagtgggaacagatttttctaaagtcccaacaaaagcctactctctctagccaaaggaccagaaaaggggcatcctagaaagacagaaaacttttagaccattactgctctactatagccaaacaccacaggaaaaactgcaaccctcacctccaactgtccatgcaaaggctgagtggtgagcctgaacttctaccccaatttggcagtaacaaggcaacccttccagttttttctactagagcaatgtcagaaaaaaaccactaaaacctaaggtttaaataagatccagagtctcatgacataatatccaaaatgaacagtattcagttgaaaatcattcatcataccaagaaccaggaagatttcaaactgagtgaaaaagacagtcaattcatgccaatactaagatgatgagatagaattatctgacaaagattttgaaacagctatcataaaaatgcttcaatgagcaattacaaacatgcttggaacaaataaaaacggaaagtctcagtaagcaaataagaatacataaagaaccaaatgtagactttagaactgaaaaacacaataaccaaaatgaaaatctcagtgaatagggtgaacaacagaatggaggggacaaaggaaaaaaatcggtgaacttgagtatataacaacagaaattatgcagagagcaaatagactggaaaaaaataacagtctcagggacctgtagaattattacaaaagatataacattcatgtcattggagtcctgggatgagaggaggagactaggactgaaaagtatttcaaggaataatggctgaaaattttccaaatttggcaaaagacatacagattcaaaaagcttagagaatctcaaacatgctaaacccaaagaaatccacactaagacatatcatagtcaaacttctgaaaactaaagacaaagaaaacaatcttgaaagcagacagaggaaaaacaatgatttggccaagcagagtggctcgtgcctataatcccagcagttttgggggccaaggcgggtggattgcttgagcccaggagtttgagaccagcctggacaacatggtgaaaccccatctctgcaaaaagtacaaaaattagccaggtgtggtggtgcacacctgtagtcccagctactcgagaggctcaagtaggaggatcactgagcccagggaggtagaggctgcagtgagccatgatcatgccacactgaacttcagcctgagtcacagagtgaggctctgtctcaaaaaagaaaagaaaaacaataatttgacagagaaactgataaacaattatttaaatggcagttgatttctcatcagaaaccatgtgaccagaaggaattggcacatttttcaaatgctgaaagaaaagaactaaatcctatatcccacaaaaatatccttcaggaatgaagtgggaatcaagacattctcagatgaaggaaaattaagagaacctgtctccatcagagctactctaaaataatagctaaaggaagttatctaaacagaacagcaatgataaaataaatcttggaacatcaagaagcaagaaataatacaataagcaaaaatatgatgaacacaatagactttccttcctctttgagtcttcaaaattttgtttgatggttgaagcaaaaataataatactgtctgatatagttctaattgcatgtagaggaaatatttaagttggttatatcataaactagggagataaagagacattaacagaagtaaggtttttatacttcactcatactggcaaaataacattaccagcagactgtgataagttatgtatatacaatgtaatacctagagccactcagaatctatacaaagatatacactcaaaaccactacagataaatcaaaatgttacaatattccccaaaatattcaaatactcataggaaggcaggaaaaagaaaacaaaattaaaaataaaatggcagacttagatcctaacatatcaccaattacatttaatgtatataaggtctaaatacaccaattagaagacagagactggcagagtggataagaaaaaatgacccgacagtatgtactctacaagaaactcaccttaaatataatgatataagacaactgaaagtaaaaggaaggaaacatatttatcatacaagcattagtcaaaacaaagcatgagtgtctatattaatatcagatagacttcagagaaagaaattatcagatatatatatatatatacacacattatatatatattatatatataaatggctcaacccaccaaaaagatgtagccatcctaaatgttcatgcaccaaacaacagagctgtttgtgaagcaaaatatgtgaagcaaaaactgatagaactgaaagaagaaaatccacaaagccacaatagttggaaatttcaacactcctctcttacaattgatagaacaactagacagaaaattagcaaagatatagaactcaacaataccaacaataacaggatctaatcaacatgtatagaatactccatccaacacaagcagaatacacattctgtagaacatagaacaagatagaccatattctgagccataaaagaaaccacaacaaatttagaagaattgcaattgtacatagtgtgttctctgacaataatggaatcaaattagaaattaataacagacagataacaggaaaacatccaaacacttggaaaataaacaacattcttctaaataatctataggtcaaagaggaagtctcaggagaaatgtttaaaatacattgaactggattgaaaataaaactataatatttcaaaatttgtgggacacagtaaaagccacgttgaaagggaaatttgtatcactaaattatacattagaaaagaggaaaggtctcaagtcagtaatctaagcttccacctcaagaacctagaaaaagaacaaataaacataaggcaagcagaaggaaggaaataataaagataagagttgaaattgaaaaaaaggaaaacaatagagaaaattaatgaaacaaaaacctgttcctttgcaaaaaataaaaaatttaatgaaattgacagacctctagcaagactgatcaaaaaaagagagagagagagaagaaacaaattaccagcatcagaaacagaacaggggatactactacaaaccctgcagacatcaaaaggttaacaactttatacacacaaatataacaatgaaccaattccttgaaaaacacaaactaccacaattcacccaatataaatacaggtagtagctccataactattaaggaaattaaattcataatttaaaaactccccaaacagagatctctaggctcagatggtttcactggagaataaacatttaaagaaaaagtaatgccaattgtacataatgtcttccagaaaatagaagtagaggaaatatttcccaattcattttattaagctcatattaccctgatactaaaatcaggcaaaaacagtaaaagaaaactgcagaccaatatcactcatgaatgtaaatgcaaaaattaataacaaaatattagcaaacagacttcagcaatatgaaggaattatacaccatgaccaagagaggtttattccgtgtatgcaagtctggttcaatatttaaaaatcaatcagtgtgaaccaccatattaacagctaaagaagaaaaatcacatgattatatcatttgatgccaaaaaaatgacaaaattcagcatccattcatgataaaatctctcagcaaacagggaatagagaggaatttcctcaacttgataaacagcatctgcaaaaaaacccctacaactaacattttacttaatggtgaaaaactgattgttttcacccttagatcaggaaaaaggcaaggatgtgcactttcactactcttattcatcatagtgctggacattctagctagtacagaaagtccagaaaaggaaataaaaggcatacagattagaaaggaagaaagaacattttcttattttcagatgacatgatggtctgtatagagaatagcaagaaaactattttttttaaactcctaaaacaaataaatgagttcagcaaggtcaggagatacatgcataaacaaaagataagcatacaattgtatttctatatattaataatgaatacataaacaccaaagttaaaaatacaacaccatttataattgctcaaaaaagacttaggtgtatatctaacaaaacatgaataagacttgtatgttgaaaactacaaaatgctgaggaaagaaatcaaatatctaactcaatggagaagcataccatgtactttaaatgctttaaatccattttaaagattaagcataaaggtgtcaattatttccaaattgatatacatgtttgacataattcccatcaaaacagcaacaagatttttgtacaattttatgtcaaatttatacagaaaagtcaaaggaacacaaatagctaaagcaagtttgaaaaagaagaataaagtgggaggaatcagttgaccctatcatatatctacagtaatcaagactgtgtggtattggtagaaggacagacacataaatcaacagaacagaacagaacccagaaatagtcccatataaatatggccaactgactttttaaaagatacacacacaattcaatggaggaaagatagccttttaaacaaatgatgatggagaaattgcacatccatggcagagaaaaaagaaccttgtagtagtcacggttctccagagaaacagaaccaataggatgtgtgtgtgttggggggcctgtttagagagagaaaaagagacacagcgctgggcgcggtggctcacgcctgtaatcccagcattttgggaggctgaggcgggcggatcacaaggtcaggagatcgagaccatcctggctaacacagtgaaacccccgtctctactaaaaaatacaaaaaattagccgggcgtggtggcgggcacctgtagtcccagctactctggaggctgagacaggagaatggcatgaacctgggaggtgtggagcttgcagtgagccgagatcgcgtcactgcactccagcctgggcgacagagcgagactctgtctcaaaaaaaaaaaaaaaaaaaaagagacacagagagagagattgattgattgattgattgattaaggaattggctcatggaactgtggatgttggcaagtccaaaatttgcagggcaggccagcaggctggagactcagggaagagttaatgttgcaacttgagttcaaaggcagtcagctgacagaattccctcttcctcaggggaggtcagtcttttccttaaggccttcaactgattggataaggcccacccccattatggaaggtaatctactttactcaaagtctactgatttacatgttaatctcctctaaaaaacaaaataccctcacagcaacattcagaggtgtttcaccaaatatctgggtactgtggcctagccaagttgacacataaaattaaccatcacaaagctcagtctaagactcatactttatacaaaaagtatctgaaaatggatgatggagttaaacataaaaactattttaaaatgtttaaataaacagtagaaaatgtttgggatctagagcttaggcaaaaaggtcttagacttgatcaaaagcacaatccatgaaaggaaaaatcaataaattggacctgaccaaaatataaaacatttgctctgtgaaagaagatgaaaagacaagttatataacataatgggagaaaatattttcaaaccacacatctgacaactgacacatatctagaatacgttaagaactttaaaaaactcaacagtaaaacaaaatccaattagaaaatgggcaaaggacataaagatacatttaaccaaagaggaaacatggattgtaaagacatgacaagatgttcaccatcattaatcattagggaaatgcaaattaatacttcaatgagatgtcactacatacctattagaacagctgaaataaaaaaacagtgacaataccaaatgttggtgagaatgtagagaaactggatctctcagacattgctagtgggaatgtgaaatgctacagccactctggaaaactctttggcagtttcatataaaactaaacatgcaattaccataggacccagcaatcacactcctgggcatttatcccagagaaatgaaaacttatgtccacacaaattctcatacatgaatgtttataacagcgttatttgttaacagcaaaaaactagcaacaaccaaaatgtccttcaataagtgagtagttaaacaaaccgtgctacaataaaaaagaatggacaataacttggatggaccttaagggtattaccttgagtgccaaaattgtttgcacaaagatctccactcctcactcctctgccattgcaaacatgctagcttcgattcattgggattcaaaagacaaattggcaaaagaagcacccaggtgatttcaattttgtagcagtgtatgagaagtggcaatctctgaggcaatgtttcttaaatattattatcccatacctgcaagacacacatattcacacatgtgtatgtgtacacacacacacacacatttccaagatgacagattttcatgcaatgagatttttgcctgtattgattcattttcaaagatgaaagatagagacctacctgagctgtgctcgaatgaggggaaagggtgatggttggtagtggcataaggaaaatagcagggaagaaaggaagataacacagagttgcatgaagaggattgtgctgacctgggctccagctctgtagtgctggtcttggccattctctcgacatgtgctgtcttccccatctgcagccccaactctgtatctgacaactgatgttaaaatgtctcttctggccaggtgtggtggctcatgcctgtaatcccagcactgtgaaaagctaaggggtggggtggggggggagggtggatcacttgaggtcaggagttcgagaccagcctggccaacatggtgaaacccggtctctactaaaaatacaaaaaattagctgggcgtcctggcttgagcctgtagtcccagctacccaggaggctggtgggaaaatcgcttcaacctgggaggcagaggttgctgtgagccaagatcacactccagcctgggtgacagagtgggactctgtctcaaaaaaacaaaaaagtctcttcttcagggaggccttgccagatcccgagaataggttagatccctctgttatgcattctttattataacacttgcatataacccttgtatcatttatcgcaaatgtaattacacatttttgagatcaactatctaatactaagtaatgatgtgtgaatttatctatttacttcgtgtctcccatttgggactgtaaactccattaatgtagaaaccctgtgttagttccctttttgatattcccagcacctaacacaatactggtccaaagaaggtgctcagtacgtatatgttggatgaatgaagccaggtaataagaccctgattgacttaaacacagttactcaaaatcatgttaaggaaaaataaactttcatttttaatttatttatttattatttatttatttatttatttttgagatggagtctcactctgttgcccaggctggagtgcagtggcgtgatcttggctcattgcaacttctgcctcccaggttgaagcaattctcctgcctcagcctcccaagtagctgggactacaggcacgtaccaccacgcccggctaattttttgtatttttagtacagatgggttttcaccatgttagccaggatggtcttgatctcctgaccttgtgatccgcccaccttggcctcccaaagtgctgggattacaggcgtgagccaccgcgcccggcccatttgtatttattttctctcttacaaaagaggaaaaacatccctatcccacattggataagactgaatagctacagggatgccctggaataaaaagtactgtttgactacatggactaatgataggaaagcaatggtttcctaccctttgagtctgggggtccactgtatttttttttttttttttgagacagagtcttgctctgtcacccaggctggagtgcagtggtgtgatctcagctcactgaaacctctgcctccccggttcaagcaattctcctgcctcagcctcccaagtatctgggagtagaggcatgccccaccacgcccggctaatttttgtatttttagtaaagatggggtttcaccatgttggccaggctggtctcgaactcgtgacctcaagtgatccactcccaaagtgctgggattacaggcatgagccactgcgcctggccccattgtatgttctttgaggtacagaatcccaagccctgaatcttctgcacatgaaaatgcagacatcagtactcatgtatccatcactggaggggtttctttccacccacaaaatatcccttgaaatcatccagtagagcccaggggttgatggaaccatttgctactcaagctaaaaattacgatttccatcccccatacttattttccccaagggaacaagcgaattaggcaagcacaaaggatttgagaggaggctgcactttagactttgactttaggaccccaatattcttcctcaggcttctccaggtttccagttccctgtcactcacattggagccctccctgccagccagttaggaaatagagattccaccagtgggagaaactggaggggttgggggaacatgctcaaagtcggaacacttcagggacaagtccaacctgtttagcctctcacacataagcttgccttttcttctcaacataccatgatttagtgccaggccacctaggttccccgcatctcctccacccagtcccttcagggaaacagggtcctttctggctgagttccatgttcagtatccagtgctctcctcatggccacctgacaccggagctgttgctcaacccctcccttgatcggatgccctgtattgcttgaactcatttttctccctgggcccctaaatcagtcaaatttttccccagctgctcttctgctctctgctactcttgattgaattcatcccttctctcaaatgtctccttctcacttcctccagcttgtgttttctccatccttcagtattctccaggctcctctctctcctggccaatggtgctctggtgagatcattttcttcacagcaccctcaccccacatccatcctgggcctgctccccagctgtagatgcggtcatttattcaccagcattttgcaatcaccaaacaaccacaggttcctgtgggttccctacacaaggagggtctaactccagcacacacataacagaaaagagggttctacgggaggcagaggttgcagtgagccaagatcgtgccactgcactccagcctgggcaacagagcaagactctgtctcacaataaataaataaataaataaataaataaataaataaataaataaataaaataaagagttctagaaaaaaagggtgcaagattcagatattactgagtttgaagatgagagtatttttcagcaaaacagctagaaaatcgctagctttccccctaaagagggggtaagctaatcaaatcatagttaaaatctattcaagggtgtttttatatcactttcctatatgcatcctctttgtatataaaccttcttcaaaatgctctcagaaagaatacaacaagtaccagaaccttataaattgggcttttctagggtcaatcacatttttaagtgggggtaaaactgtaccagttcatagaaataagaaatatcttgacagttgttttattctgcatgaaacgtgccctttttcttacagtttggaggttatgaagggaggtaacagaacaacatcgattttaatccctgtccccttcccgcactgcctgcctcattgaaagctagtgggtcttatgaacaaccttaagatgcctgcgagccacggcagaggccaccatgaatagcacttgaatgaagtgagagaaaaaggaaaattgggaagcatcttactggtgccatctcccctacttaccattttctgtgatgtacctgggccctctcttcatgaaattgttctggagaactgagggatttaaagggctacgcctccctagagcagtctgcatcttaacaggatccacaagtggaggcttttttttttgaaacagggtctcactctgtcacccaggctggagtgcagtggcacaatcatagctcactgcagcctcgaaatcccaggctcaagcgatcctcccagctcagcctcccaagtagctgggattataggtgccaacaaccatgaccggctattttttaaatttatttatttatttatttatttatttttgtaaagacaggggtctcattttgttgcccaagctggtctcaaactcctggcctctagtggtccatctttcttcctcggcttcacaaagtgctggcattataggccccagccaccgcacccagcccataaagggaggcttaaggaaatgtctgacttctgtggggagagaaccagctgtggagtgagctcagcctggccttgactcctggtcacttactaggatgtgacctgcatgagcaagtcatccaaagtctctaggcctcagtttcctcctctctcacatgggaataataacagtccctacctcagaacactgtgaagcctacatgaagcaaggctcacaaagccctaagtgcagtgcctggcatgttgttagtactccataaatgttaatgtgggctgggcgcggtgtctcatgcctgtaatcccagcactttgggaggcttaaggcgggcaggtcacttgaggtcaggagttcgaggccagcctggctaacatggtgaaaccccatctctaccaaacacacacacacacacacacacacacacacacacaaattagctgggcgtggtagtgcacacctgtagtcccagctactcgggaggctgaggcaggagaatcacctgaacatgggaagcagaggctgcagtgagccaagatcatgccattgcactccagcctgggtgacagagtgaggctccatctcaaaaaaaaaaaaaaaaaagaaaagaaaaagaaaaaaaaatgttagcgaggagaaggaagaggaggagagggagaaggcggcaagatgaccttggagtcccctggaaagaaggggcctagctgccctctgcgtccttcccctaccactcttcctttcacggcctaatccaaaggtggcttcacggcccctcgggtttaacagctgagactttgtttccagactcacaggtgtgctgtagtgagcacctgggtggaatgttgctctctgtttcctgcaattactaaatcgctttaaggggaatgctgtacatttttttttcaaatgaagtctgtgcttgtatttgctcacagggaattttaaaattgaggagatgatgagcttgtttactaaataaatatgtgtgtttggaccatttgccttctcctccctccagatgccctctcctcctcccctcgctgtgggcttcaaaagcagggcaggcggtggggcaggaaaatgccagttgttggtcttcttggacccaacaattatttacagagcacaggatttacagtcaggaagaattttttttttcacagaaatgggcaaatcctagatgctctctatgtatacaaacttcctttccaacagttatgaaaggacattttacattttaaatgagagccctgttggcggtacattctcaaatgctaagttccatcaaaacagcatgttgaggggaagaagggcacatggcaatgggcacctttgggtcccaacttctccccagcaatgctgtgactcaggaagtcagcaggggtccttcttttcacccctagttccctcccccaactccttgtacatctgatgtcaaagcataagctggtaacctataccgagagggagaattcaacccaggggcagctcaacttgaacagttctatccagaagtccaactttaaattctaccccccatagaaatagtcccattcctgcagctgctctctaccagctgcctaaccagctgccattgggccaaaattacccccacctcagggtccccacctcaggacatcataaacacactccctggggctcattcattaacccatgagctggagttgcccactttggaagtcagctgtggtcttcactattttttttaacttaaacaataaagagcaactcacagatatccctcactctcagcacatgtggaatgagataaaaacaaaagcttgctaagtcagaccccagaaccaactcaaggcagagatgatgtgaatgtggaactaatcaagaagttacacgtgttagaaagatctggcttaatggttctctttttaaaaaaaaaaagttttttgagacagagtctcactctgtcacccaggctggagtgcagtggcacaatctcagctcactgcaacctccacctcctggggttcaagcgattctcctgcctcagcctcccgagtagctggggctacaggcgcgtgccaccatgcccggcttttttttttttttttttttttttgtacttttagtggagacagggtttcaccatgttagccaggatggtctcgatctcctgacctcgtgatccgcccgcttcagcctcccaaagtgctgggattacaggcgtgagccaccgcgcccggcctaaaatactttttaaattttaagtggcatcatgaaaggtggaatccttgccccgtttttctgattccttgttgtttttatttatttagggagaaagacgttctgcctgtgtttatgtgtcagttgcagaatttgtgggtaacaggaaatcaggtatgaaattgaggctaggagctcacagggagcaagagataaataatccaggattcaagattaaaatcgctgttgcttctgtggtgagagcttgtcacacaggcaattcattgtggattaattttccagtgatgtagtaacaaaatcagcacatcaaataaaatatttaacacccaggaaaagccaaatgcatattctgcatgtgtgtccttaagtggtacttttatggaaggaaatcttatttgaaacaaatgttggaacagaagttgagcttatgaagggcaccgagaaaccctcacacataaggttttaaaatgttgcccagaaaaagcataatcttcagtgtcagtcccttggatggtcagcgtgcacgttcaatgctcgtgtttatccacctgtgtgcacaggtgtccactcacttgcaaatccttcacgtcaaaatctgatagtcatattgcttacctgtgttaaatggaaaatggaagtcgactggtgggtcctgttgtctagcaccctactacttggtctcaggacaagaagggaatctcagaatgatgaatggggttatatctggataccccttgctgggctgcctgcgatcagcatttctgcccacagctaagcaattcaagtgctctgaccccaaagtggtgagcccccaagcttctatctggatctcttgaaggaagtgtgtagggtgttgcatgtgatctgtgcaaaaggaaggagcaaattggagttattgagtgaaccgatagccaggggaggcccctgtatagacagatgtcgtggaggcatagtcaggaaaagtttgccatgactcggatttctttctctgcctgcccagatgcctgcctgcaacctcttttttttttttttcattcacttgtacatacattcctcaagtatttaccaaacacctatttcaggcatgggcctgggctagccagggcagtagtatacagaagtcgtttgttttctcctctccctctcaatgggtcttctctccttctctctctccccataattcagtggtaacaggggtggatgaaggaatatccaaaactcgtctctgtaggagacatctgcgccaggaatttccagcaacccctgaggagagtggcagattgatgggactctagttgggactaaccagggggtggagggaggtgggggcggaaagagccctgcagccaggctgtctgcctgagcctattctatagctcccattgattggacacttgctctgtgccaggccctgtacgtgcagtttttcagacctcattcactcctccaatcccattgaggttgctattataactgtccctattttatatgaggaaactgaggccaggagagggaagggacttacccaaggtcacacagctaggaagtgacagagcctcaattcaaacttaggtctgtatatctccaattctctgggcatttaaaaaaaaaaaaaacaactcagatgtggtttagacgtaagccaaaaaaaaaaaaaaaaaagccaggcatagtggctcacgcctgtgatcctatcctttgggaggcggaggagaagcatcgcttgaggccaggagtttgagtctagcatgggcaacatatcaagaccctgtctctacaaaaaaattaaaacaaaacaaaacaagaaaaccctccttatcattatatcaaaagtccagacattttaaaaagagagagcttaggagcttctaaaaggtgctatgaactctgtttccatgtgtggtttagtctaatttctatattcaacaataataattttaataataactaacacttactgagcacttgcatgacaggagctacactaaacagttttacactcatggtgtcatttaataatcataacgacccgatgcagtgttatcgttattattattatcctcattaacaaatgatgaaaacaatgcttagaaagtaattcccaaagttagttagcgccgtcttattccaagtctctcttggtacatcaaagccactcaactactagactatcctgcctcaaaccctccaggacctcattgcttccaaacttctttccctagactttcttctcacctttttttctgtccttataagtctgtccaaatacattgcactcatttctgtcctatgagtgagctaagtcattgtcttctccataaccttgccttttctcctcacccaaatcacttcttatctccaatatccaattagacagatctggaagttccaaggatgtgtccatatagggaaatcagaacaagaatactactaacaccaagttttcagtcacccttctaggttcacagaatcttaagaagtcagcaaaaccataagcccttgtacttaaaaataatcaatactacttaaaacttggtatttattttattttatcttattttatttacaaacactatggtgactttaaaacttagtttaaaaaaatactccccgaggtctgtaatctcccacatacaaaatctctaaaggagaggcttaaaagagaagtactcctccctgaaaatcagactattttataaataatgataaggtggcccttttgaaagtattgcttatttagaggctggggatttaaacttagatcactagtgagggtgtgttccaattaccatatccctagataaacatgaccttctttaatcagctctttgctccctagtttcttagcagaactgccaatgagccagggcagctgccattttgtgccagagtttctttttccattttccaaggaagcaaagaataaggaatgcctcacttccctccccattccctgtttggagtcatgccctctgagaacttattctatttcagcttctacctctatgcagtcagaaaaatgattccgaacaacccatagaatgagcacctgcttcagttattgtcccaatgtgaaaatgctaatccctgggtttaggcgaggtttgctttccacacaaaatggtcaggcccctctaataggccagcacttctggttttaataccccagtcttgatttctaacaggtgggtgccacagttgttcagctcttattatgagctggttcatagctcgaacaatataggattcttcataaagagtctgagaaactgggccgggctcggtggctcacgcctgtaatcccagcactttgggaggccgaggcgggtggatcacttgaggtcaggagtttgagaccagcctggccaacatggtgaaactccgtctttagtaaaaatacaaaaattagccaggcatggtggcgggtgcctgtaatcccagctactcggggggctgaggcaggagaatcacttgaacccaggaggtggaggttgcagtgagccaagatcccactactgtactccagcctgggtgacagagtgagactccaactcaaaaaaaaaaaaaaaaaaaagagtctgagaaaccaccagatggtattattggggggaaataaactcagttcctttcttcagcaacccaagctagtggttttaatcaggaatgaagggcgctttcaccctgctgctttcttcaaactcagtaagtgccccccaccctttttccagtttttacaaattaaaatgtttgtaaaaacccaacttatgccagggaactagggctgcctagctctggttgtttccaacatggcactaatgagacattgcccattgattcagtcatttgactgtctgtactctttccctccctcccatccaagccctgacatccaggtctggagtgtcacaaacattcaggcttggcaagagaagcccattctttttaaagatatgatgaaatcagaaagacacacaatccctgtcctcagagtggaatcaggaatatgtgattctccacttccataacaaatgcaagagttggagaatgtgtggtaccctttttccattcaggaagatttattgggtgagtctacaggccattcttcttagtttggggttgccgtatctggtggctttgtacagaagccatacacatttccctcgtcaaaacagattgagaaggcctgaatatacagtgtgtctcgaggttcattgtgttctgggtatgcatgcaacccacggaataaatgtgttacattgaaataaggaatgactgtgtgctgacaagaagtccaaaatatagagagtgataaaatagaaacagtggtccagaattatctactctaaatgcccttgaatttctgtctcccatttattgcctctatttttctcaatttcccctgcttgaaaagctattaacttccccacctctccaccaccctagactctgatacccataaacaaccgttgccactcttttatgtcctctgttatgaacaccttcactgtgtttactttcttggcactggcatagactagacagagaactatagaagcttctcgttctggctttgccacttatgacctttgtgtctttaatgaatttcctaacctttctgatcctcaattcttcttccataaaaggaagctaataataataccacacagagttgctatgagggttaagtgagatactgcacgtacagccctaaacacagtaatacagtgtctcaatatatatccatttccctccttcctgttttccttcctttcttctttctgcgggaatctcagtcgctacgtttaagcaactgcctatgatgaaaggttttgtctagtgggtggacccagtttctgtctttgttctcatcacttaggtgtaaaaagaaagctttaaaaagtaggattatttttgagggcatatagaaaagttgttgctctttgtataagacaaaatatccaagtttcaaaaatcccagtggcctgcctaccttgaacctctttctgttcttctactcccaagggtgctccaattggcggaaggtagccacgtgggaaattaaacggcccatctatatctatttatacccagcgtaaatgcagagcgatcaattttagaactggtggcttggcctgagaaatagctatgtttggtggaagcagggcaggttcataaagaagtgcacagagctcttggaatacaggaattatctgctcttcttggatgtgggtgtcctcctagggatgagcatctgccctcactgtcctaagttctagaggcctcagctttccgggaaagcacaaaccaccgctcagctggagtctatctgggtctcccctctccaacttgtgacacaagtcttgtgtgaaagcctgagaacactccattcttcctcttgttgttttcaggaaagatttgtccctgtctctcactgccacataccatcttagagcttctctcagcttccccgagtcatgcatgggaaattgctcccacagcccctctatgctttggtttgctcagttttaaagttgattctgtcccctctcctaaaaactcagccatcagacactgaagcagaatcacccaagtgttttagagccatagtccggaagccaagccacctcaggactttccttttctttcatggtgattaaatttattgtaatgtctggccatttttctctgagttgtaaggcagagaagcaaggtgggctggtggaaaggcctgaggccccgattgacttatctaaccttgatcttggccaaggctctctgcccttctgggacccccgtttccacagttttaacatgtgatgcctgtctttggggcccttacaggagagctgcaaggatcaagagggataacaggagggagtgcattctattggggtagggctggggaatctctagacaaaagatatccaaattaaagcaaaagtgctgtattttgagatttgttgccatatgtaatccatacacgtttaaacaagctttttagaacccctggtttctgtaatcacttaagacattgcaaagaagcataaatatatatttttaaagtcatcactactactactttctaggtgaaatagaaagtatttctactttgaacatttgccctataactgtgacagggcctccatagactgcagttccaaggatcagagccccaaccttttaaattcggtgcaagaaatttgctttaatttggatatcttttgtctagagatttccccagccccaccccagtagataactccctcctgttatctctcttgatcagctctcctgtaaattccccaaagacaggcatcacatgaacccccagttcaggctttcagagaccatgctgcttagaaagaccatttcctcaaaaaaaaagtagccaggcgatcccagctactcaggaggctgaggcaggaggatcgcttgagcccaggagatgaggctgcagtaaactgtgattgcacgactacactccagcctgggcaaagagcaaacccctatgtcaaaaaaaaaaaaaaaaaaaaaagaaagaaagaaagaccatttccactgccccacccccaggctttagggctgggcagtaagctccattctgagtttttttttcttttctttttttttttttttttgagacagagtcttgctctgtcactcaggctggagtgcagtggtgcgatctcggctcactgcaagttctgcctcccgggttcacgccattctcctgcctcagcctcccaagtagctgggactacaggcgcccgccaccacgcctggctaattttttgtatttttagtagagacggggtttcaccgtgttagccaggatggtctccatctcctgaccttgtgatccgcccacctgggcctcccaaagtgctgggattacaggcgtgagccactgcgcccagctggtttgttttcttaatgactaatacttagaatcattctgagtattttcctctatatcatgacctgccctcccttctcccctgccaccttccccttgtaattgccaccaatacacagtcacatccagtcacaacaaaaacctggctgagaggtcaagtccctgttagaaaatgttatataatcttccgtatctcaggattagaggcttcaggcatcaatgacattgtaagactttcaagagaagacctacataaataacctctgtatgtgtgcatgatgtatgtatgtgtgtgtgttcccatgcatgcatttgttcataatacatgtgctaatctatccctccactacacacacacacacacacacacacacacacacacacgcatgcatgcacacatgaggcattctgtgatagaaccttaaacaccatcttttttttttctttggtggagtctctctctctgttgcccaggctggagtgcagtggcgcgacctcagctcactgcaacctctgccccccagttcaagcgattctcctgcctcagcctccagagtagctgggactacaggcatgcgccaccacgcccagctaatttttgcatttttagtggagacggggcttcaccatgttggccaggctggtcttgagctcctgaccttaggtgatacgcccgccttggcctcccaaagtgctgagattacaggcgtgagccactgcacccggccaaagatcatctactctagcctctgacgtaggacaggatctccctctccagtgaccccaacaagtggacagccagcctctaactgaatgcctacagggaacaaagagatcttagtttcactctaggtttctccatccatttttggacaacttttatagttgggaacgtctccctgatattacactgcaattctagttcagtttctcctgtaggcatcaaatatcagcaccaataccacttttaactggcccctttctttctaagtttttgtctctattccttgttgcttcatcatatttctaattctaaatggaatttaagattgtaacaaaacacagagtcagaacattaataattgcaggctcctatctcagaaaggaggcatgtgtgtctgttccatttgttgggaagatataattgttagtttgctagggctgctgtacacaaactgggtggcttaaaacaacaaaaaatgtattgtcttacagctctgggggctggaagttcaaaatcaaggtgtcagcagggccatattgtgtgacggctctagagaagcctcttctagttctggtatttgctgacaattcttgacgttcctggggttgcaggcacatcattggagtgatgcacatggccgccttcttcctacatgtctcacattgtcttacctctgtgtgtgtctgtctctgtgtccacattttccccttttgtaaagacataagtcattggattggagcccaccataatgatttcattttatattgattacctctgtaaagagcatatttccaaataaagtcacattctgaacactaggggttaagacttcaatatatctttttgggaggacacaattttttttttttttttttgagacagagtctcactctgtcgcccaggctggagtgcagtggcacgatcttggctcactgcaacctccgcctcctgggttcaagcgattcttctgcctcagcctctgagtagctgggactacaggcatgtgccaccatgtctagctaatttttgtgtttttagtagagacagggttttaccatattggccaggctggtctcgaactcctgaccttgtgatccacccacctcagcttcccaaaatgctgggattacaggcgtgagccaccacacccagctgggaggacataattttatacatatatatgtatatataattatctagctatatagaatatatagatatagaatagatatagatatataatgtatatatagaatattagatacatagatatagaatacatagataggtattcctaaacatttgtagtccagtgatgtaagttcaagtctcagtcctggagaaaaatttcagaaagaaagtccttcattctttgttaagggaagatagattaccagtggggggaaacttcctttttgttgttaataattatattaatatcatatatgtatatattattagatatgataagacttttatatttatttttaacattatatatggtgtattttaaaatattatgtattataatatgcaaatgatgaacacaagtttaaccaattgcttttttttaaacaagtaattaatttcaggaaaaaggcaccaaaccaacaccctgttctacttttttttttttttttttgagacggagtcttattctgtcgcccacgctggagtgcagtggcgccatctcagctcactgcaacctctgcctcctgggttcaagcaattctcctgcctcagcttcccaagtagctgggactacaggcacgtgccaccacgcctggctaattttttgtatttttaatagagacggggtttcactgtgttagccaggatggtctcaatctcctgacctcatgatctacccgccttggcctcctaaagtgctgggattacaggcgtgagccactgcgcccggctcaacaccctgttcttgctcttttttttttgtttgtttttttttggagacagggtctcactctgggctcaagcaatcctcctgccaagtagctgggacaacaggtgcgcaccaccacatccagctagtttttaaaaaattgttatgttttttgatattgctagtataaggagctatcacacccaaagtcaaatcttcgttatatagaaagtccagatcagagaagtgtatagtgatatttaccagtacaatactctatcatatgtggatatggggtcaactgcaaagcacttttgggaacattcaggctcggggacactcaaactgacgtgaagttagcctggatctctcttttagtccagagttggcagagtgaaaagcccagcccagagggagccaagggtcaagttggggtaggggagaattcacccatcttgcctctgatttcccaagaacctctagcattttctgatttctgtatctgtgtatggaactgggagtggatgtgtaggtctgctctcaggaggaacagatatccagcctgtggtttaggttcctttttctagctaagggaatccttggacaacctcagggctaagtccatttgcctgggtaaacttggggactctagcaagccccttcgaggcaccccaccattcttcagtacctcgtgaacctgaggcttctgcttctgattatgctgtctctcaattgcctggacttggtctagatacggcttgataatttcttctttcctcccatgtaaaggccagactaggggagagttccactttgtcttctttccagaggacgacttatcacagggatggaggaaaaggggtacaaagagtgctggctgcacttggagtcactgactaagagctaattgacaggacattgggtaccgttggatgggacagacatagagcccttggcatcaatgatcctagaagataagcaggtgtgcaagtggacaggccaggacgcttgttaggactctgtactctctaactattatagaaaggctctactgctaccccaggccttcaactggtagactagagaaggagtgggggaaggggttagccaataaccagattcaggcccttaggggctggacaaggaggcacaggggcaggtggtgatttctggtggtcattcattaatttcttccttctttcatttaaaaaatatttactaagtacttactgtgtaccagatactatagtagatcaagaccccatttttaaaggaatttatggtacaataattaaggaatggggagaaatagtagggatcagggcaatagtaagaaacagatttggggattttcttctcctcagtatgtgtgtgtgtgtctgtctctccatcactgtgtgtgtgtgtgtgtgtgtgtgtgagagagagagagagagagacagagagagagagagaaaatttatcttcctacaatgtcctcatcacaaagcaatgcatctttacctactccgatatgcacgcatgcctcccaaattgtaggctcgctaacaatgaccaacagccttcctatcaaaggaaccttttctaaaaccttctctacgtctcaggagccaaatgatggtgaatggcctcagtcaggatgttatacacatgcaccaagtgaccacattctgggtggggcatgcacaaggtagctttgggttttggaaagatgcattctggtcaagtcagtgaaaaatcagccaagtagcctataaagtcaactgtggtttattttggacttaggccacacctaaggggccatatgcgtgcacctcactttaagaaaacctgtactcaaaaatcccaattttgaaagggagacgggaatgtgcctgaccatttttggaagccatctagagccctcatttattgacacaggtgtatcaaagaggtggtgaagcccttgaaggaacatctgattcaatcctctgccttctgatgatttcagatcacctcaggcaaatgggcctttatctggttttggcagactcccagagactactaatgggttaaaaatgtggccgtggctgccgtggagttgagaggtctgcacagacacaaacctaccttgtcttttaaaatgagaagggactctggggctttgtggaaaagggtgtagttttctgaaaaaaatcaaactcaaataaattgttaagttaaaacataaactgaattaggggcatacatttgggatgtccctcacacttcatggaaattatgaaatacatctctttgttcaagtttaaaattcaaccaactcagcttctctgcacaaaaggggaggagttcccatgacctgatctttgcaatttcctctaaagtatggctttctgtatttatttaggaatatttatgttcagtcagggcatggtttacccttgttgtgtagccttattatggtttgatttcacattggactactcaccttttagtaaccaaatttgcgacccagcggaaatttctctcttacaaggagcttggattcttatttattttgcaacctttatttgtgtatgagatgaaccatgacatttaaactatgcttgatagcttaacagattataagaacaaaaccagatggcccaaacaaaaataatgctttgattgctttaaaattcaatgtcaaaaattaaaaacagctttcaaaaagccttgacttttttcccccgagataattttgaatcatatatgtggacatatactttccccccaaattagaaatatataaaaaatttaacaatggttatttgggggttgagaagggtgtttccttcttttttcttttcgacaccacccaatttttctgcagttagttttagaatcagaaataaatttttaatggctgctttttagtttaattttaatgaagcctttttaagggttcggtcaaggtgtttttctctgctgagaaaatggacattgttaagcattagcagttcataattcttcttccacacaaaatgatgaataatgtgcggttactttaacactgtgcttcatgaggttggaaaactaaaccggtctcagcgtctttaaaattaatgtaaattctacaaaagcagttatttaattttctaactcgctttaatgtactttcaacatcattagtattaatcacaattgtcactttctttgagagcagtgaaccaactaattccttaaaactgggctttaaaaagaacctccattttaaaaggctctcaaaccttgagatagtttgcaggtcacagtcagaatgtgactgcttgaatgtttaaactaaagcacccacaaagtgttaggattcctttttttccgttcttgtcttgtaaaagaatctttattctgactcagattcatttttctttaaatcagctgcaagagagtgaacaaactttgctgcaaatcaaagccctgacagttacatttccctgagataattgcatgctgctttggagtttccttttccctgctgtttccttttgttttgacaacaagtttctgggaaaacaatatacaaatgataactatgctgtcacgagtatactgaattttaaaaataaataactgtcgacccaaaaagcttccaggagcctatggagtgaattctttttccaaaccgttccaaaaccagatgtggaaatgtttagctaattccccttcccattcttcatgcaaagagttcatacgtgtctctaacgacatcagaggagatggggaggcaaaaaatcctgtctgctttcaaagcgatttctcttacacttctcaattctctctctaacgtcacaaaactaatttggacttcagcttttgtctctttttaaaaggatttttttggggtcctgagattaaaaatgctctgtgcttagaccaatattcaatctcttcattataaaacattaagaaatagagctcatggtaagaacacttaaaatctaccctcttagccattttgaaatatacaatatattattattggctgaactcaccatgctgtgcaatagatcactagaacttattcctcctgtctaactgcaactttttactttttgaccagtatctccccttaccccttccactccaccccaataaccaccattctactctctacttcttaaagtaaggcaatggtcatgttaaccagcttgatctaaaataatcattccacaatgtaaacatagatcattgttacatgtatacatagaacactgtatcccataaatatatacaatttttatttgtcaatttaaaaacaaaacaactgctgaactttataagcagcattttcagcataaaaaatttaacgatgggggagttaagtggcagctcttcttcctctttcctttttttgttttggccaatccattctcttcctgtctataagaagaaaagggctgtcttggtttcacaagtactacgagatctcagtctggctttgctaatcagattgtatcactgtcagtgactgatatagatagctcttaaacataaacactggcatttttctgaacttaattaaaagagcatatgtgtttatgagggaagaaaggaaatacagtttatattcccaaaatgaaatgttttatgattttttaatgtagaaaatttattaaggcttattagggagttcttgaaaaaaagggaaagaggaaaactctgttaaaggagctagtgggaaatgtatatgcataaactccatttacaaaaaaacagaaagctacttgtactctgtagcttcaaggaaagcaaacattttgcatccaggtgttattagaagctctgggtttgcctgacctctctatagctcagttcaggacgctgtgtaccaacagctgagccctacttggctatacaaatgcatctaggctcattgcttcgggcatgttgcaaggctaatttgcaatcgagtcaaaatggggctacagtgatacagaccctgagactgctttttttctcagcacagaggcctccccaagaagctggacagtagtcccaaaatgagtgctcccttctttgcatttatttcttccccagtccccaactccacgtcagctctaaagagttctaaagactttaaatagaattctgcccacagctcctgggatactgtgcatggcccgcatgatggctaaaaataccttcagctgggcacccccacacagccctctcttctggcatctccttcccatctctaacccctcagccttcttttccctctgcccccaataactagagcccactttctccctcccttgttcgggatcccattcttccagcacatctcagcaaggtgttagaaaagtcagctgatgaattcacactgtgttgtgaatgacttataaccatcccccctgccggacgtggtggctcacgcctgtaatcctgtaatccgagcactttgggaggccaaggcaggcggatcacctgaggtcaggagttcgagagcagcctggccaacatggtgaaaccctatctctactaaaaatacaaaaattagcagggcatggtggcgggtgcctgcctgtagtcccagctacttgggaggctgaggcagaagaatcgcttgaacccaggaggcggaggttgcagtgagccaaggtcgtgccactgcactccagcctggacaacagagcaagactccgtctcaaataataacaataataataataaccgtcccccaacacacacacacacacacacaaacacacacacacacacacacacacacacacacacacacacacacacactactctacccttccctaggaattgcaggtagcaggagaagggaggctgccctgctttgaggatctgttctcagcaagaaggagtaagtctcaaagtgtgccaatgagctgggcattcgcaagctcattagaaagtacattctgctttccccctaatctcctttctctccccttagagatgagcaaccttaaacctgggtctcagtgacctcttctttaagctttatctgagctgaagggtgtgctgtcacatgcctagtcatcttcgtttatttctcctatcacatggtgagctgttcttggctttatgaaagtcagaggaaagagattctgccgtgttcaaatttggagagttgtactaaatgaacccctaaactcaatgacattattgagccccttcctttgagactgactcagtgcaacataatacaagaagtgaacgtgtgggggtgggaagtgaggtagtctaaaatgattgcttgagggacaacagtctcatttctcagaaattctagacattttataattatatttggattatctttggggaaggaggagaaggagtacaggaaagatgcttgagggagggggaggaaatggatggcttagctctctggaaaagagtagccttaaacttgggtgttaattttggggtttgaacaaaaacagttgtttccttggcctagtccagaactacttaaggaggaggttttcattcagggcaattaggcccaggttgtgggatgatgttaaagaaagaaggaaagaaggagagagagaaaaagagagaggcaggaagggaaagaaaacccacctaaagcacatttaagacaaggtggtcttctatagatcaagacaatagtgcagtagtgatggggtgattatctcagcttccaaaaggcacctcagcaaatgttatgcagtattccagagcaggtggtttctttacttaactgttgagtcatccaggaccagctcacatcagaatttacttatttgtgttgttattattgtttcctttttgtttgttttggggatttttggtgcgggggagagaaagggagtaggtttttgtttgttgctgctgcttctacttttgctttgtgaaaaaaacccaaaaaagttgtcccagaagagacatttcagaaggaacaaagaggaaggagcctggcagacctgtggggcttctcttttacacccacaacacccctgagagaatgaggaatcattaacggcagagtgaaagacagtgagaccaatccgtaccaatcagaaacaaaacatttcatccaggccagtgcgtttttctagcgggctcctgtgccatggtttccattaaacaatgcagcaaattcgtcactatcaagggaagagaaagagctgtatttttgcaactggggaaaaagagaagagagaaatgtcttgggacgttttttggcccattgccgtgcacatagtaggcattcaacaaatattagtcaaagaatgaatttgtgcaggggttacttatctcagcagggaacaaaagtgaatccctatatgcatgtacatttccttccaaactttaggtactttactatgtgatttatgtcattttcacttgtaaaatgaaagttgagttggaaaacattggatgatgttgctcttgctttcttctttcttcatctgttacctccttctgatagcatgttttagatacttattcctagcactgctttttctcctcactggtctgcctgtcactctttgagagctagaagcaataggactaggaagtggccacagagcttcctatggaaaaagaaaacaataaaaagctagagaaaataaaagacgtaatgcaaagattttaggagatatcttgtcaatcaatgtgtaaagtacaaactcaatcctccctctctccctccctccctccctccctccctctctctctctctttctttcctttcttttctttcttccctttttttttttttgagacagagtctctctctctctgttgcccaggctggagtgcagtggcacactcttggctcactatagcctcaacctccaaggctcaagcgatcctcccacctcagcctcccgagtagctcatactacaggcgtgcaccaccacactcagctagttttttgtattgttttatagagacaggctctcactatattgcccgggctgctcttgaacttctgggctcaagcagtccttccaccctggcttcctagaatgctgggattatgggcataagccgcccctttctttaatataagacttttacggtagttttcatgtgtaatatgcattgaaaaatgtaaaattaaaaaccagcatgtttttatgtttccacaattttagtattttacaaggtgtcctaaagaatttatcagggactctattggtcataatgacttatgatgctgctgccagagtttatgaagcattcgtttgatcattttaagtaagccactcggcaaaatttcaatatctggttgttaagaataaaccacaattccttcataggtttttatttgatcaaatctgttgtaacaacaacaaaaaagcgatagggaagggttcattagtatggcctatgagaggacatggaggcccctaaagagggaagtattgccatcttgaattaaactctatctcctatctctttattcaacgtttgacacaaaaactgttctgttttgggttcatcttgaggttaaacacaaaaggatgccactcctgatcagtgtaaactgttgttctacatattagggatatgtgttttatgctagaacagcatgggaaagtcactttaaaaagccattgtaatcgtccataaacacgtgagttccaacaatgaaattaaagttcagttctctctcaaatgagtgttttcctcttcttaatgctttaggaacagccctttgcttaaaaaatatatcatgtttgaactttcaatagaaaataagatgacttgcctcttgtgtttttttgtgctctagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatg

SEQ ID NO: 3735 - DNA, 162765 bp, human
acctctaggaggagggtgaagcttcttgtcttccagacattcccgaggaaaacttacacgaggagtctgtcaaggagtgccaccctttggtaatctttattaatatatacctaatatgtaccttatgtttgtggcatgtgatactgatgttccatttatcatagtgataggaagctttttattacagtaaacttggcaggtcgtatagtaaaggaaaagtgacttaatttaaatacgtcttgagtaaatgatagtatgaacgatccatagccagatatggcccaaatcttaaaatatacataattacttcgatccaggaaagtattgggtcacagtggtgtgtggaacagtctgtatgaagaagttagaagctgtggaatctgtgtggaatgctcttgccgggttctttttagatttcctcttttttgggattctgcgcttttcctttcccttttcttttctctttctttctttctttctttctttctttctttcttttttttttcggagtttctttcttgttgcccaggctggagtgcagtggcgccgtctcggctcaatgcaacctccgcctcccgggttcaagcaattctcctgcctcagcctcctgagtaggtgggattacaatcacccgccaccacgcccgactaatttttgtatttttagtagagatggggtttcaccgtgttagccaggctggtctcgaacttctgacctcaggtgatccgcctgcctcggcctcccaaagtgctgggattataggcgtgagctatcgtgcccagcctattctgcacttttcttctcctgtgaggtgtggtaagacaggtcaggaacctctctcctttagcttctggggggaacatgaggggctgaggtaaagtggggctaaagagcacttaaggcctggtttgcttacctatctcttctgactaaaaaagtgattagaactccagagctaatgtcagcatgcagccctcagagaaaggagcttctagtctggatcactgaggcctgccttctttgggcaagaggaatttttagtctagttcccctcatgactactgaagtagtctggggtgaaagccctagctggtgaagtgtttctttgaatcttccctgtaagcatccatctccctcggagacctgtgggatgcggggaggaagaggggaagagaggctgtggctgttgtaggtgaggggttaataattctaggatttgtaatcctgaccatgtatatttctacctcagagacaaaattaacatctcatagcagtggtttaatttctgttattgtttttcatctttattcatttttatttatttttgaattatggaggagaaaagcttgttacaaaaagtggaaacctcatagaagtatgcaaagtaaaaaaatactcccccttcagcgttttcatctataatgtaatagtttgatttgtgtaccaaattatctttttcttttcttttcttttctttttttttttttttttttttttttttgagatagagcctcattctgtcacccaggctggagtgcagtggcatgatctcggctcaccgcaacctctgctgcccgggttcaagtgattctcctgcttcccgagtagctgggattataggcgcccgccactgcgcctggctaatttttgtatttttagtagagacggggtttcaccatgttggccaggctgctcttgaactcctgacctcgtgatccacccgcctcggcctcccaaagtccaaagtgctgggattacaggtgtgagccaccgtgcccggccctagttatctttttctatacataggcgaacatatttgtaatagatgcacatgcatattttaaaatttttatggaaatgtaatgtatatacaaaaagtatacaggttgatgaattatcacaaactggatcttctgggggaatgttctctgtgacctgggtgatggttacatgggtttattcatttgtgataattcctggagagtaaatggcagaaagtgagccagtagggaacaactcaagagttctggaatgttctctatggacctgggcgatggttacttgggttgattcagtctgtgatcattcatagagtgaatgactggaagtggtcattggggggggggtgcctcaacagttctggaatgttctatgtgacctgactgatgtttgcttaggttccctttgtcagcattcaaagagtgaatgactggaagtaggtattgtggggcacctcaagagttctggaatgttctctgtggacctgggtgatggttacttgggttgattgcgtttgtgatcattcatagagtgaatgactggaagtgggcattagagggcgcttcaaaagttctcgaatgctctgcactgagataggtgactgtttatgggttcatttttagcaattgtgtgaacattccataatttaaccctcaaatgatgatcattgaggttctttataattttttagtatacacaagtaaatgttgttatttatttaaatttgtccgcttctgtatgtatttcttcaggagagattcttagaagtgataaattgctgggtcagaggacatgtgcattttattattttctttttggaaaggtaagacaagttcagtgtaaaaaaatcaaatagcaaataaaaaggacatatagggaaaagtcagttttcctcttacccttgacctccagtcccatcagatcctttctcagaagcaaccagtgttaccagcttctggcaggttctaacagagatactgtgtacattgcatatatatttacatatccttataaggcattgcttaaagccataccaccaccccatcaagattgtaccaatttataatctcgtcaatagcgtttaagagttcccttccccccgatcccgaaccctggccagggatgatttgggggttctgaaaatatttgagtaaaaaggaacaggttttattcattcatccattggcaatacattaatgtgcttcagaattcaaaaggtgcaaaacgtctgcctcccactttcatcccctagctgtcatagctcctttcccccagagcaattgtgttttcagtttctaatgcattcttacggagaaagtttgcatatgtaaacaaatccatctatatattttttttttcctgaaattttacacaaatggcagcatatttgtatgagcgattactacatgacctccctctccttttcccctcaaaaacctaagtgacttaaaacaattattcattttttctcatgagcctatgggtaagctgggagtatctgctattcagggccaggctcagatcatcttggctggtcagttgatgggtcagttggggattggttggtctagaatggcttcagctgggattgttcagctctactccatgaggtctcttacccacaagcagtctagtctgggcttgttcccatcgtagtgtgaggactccacaagaacagaagcacagaaggcctctggaggcctagacttggctctggcacaacgtaactgtcttattctgtcgaccaaagcaagccacaggctagctagcccggattcaaggaatgtgaggagctgcaaagtcacgttgcagggtgtatgggcttagggaggggaagagctggggccatttattctatcaaatacaatactataggtattgttatgtaccttaaccttttttttttaacctaacactgtatcttggaaatgacttcatattagtccacaaagagcttctttgttttttattctatttcattttgccagccccctattgaaggaaacatattgcttccagtcttttgctattatctaacaatgctgcaatgaataacattgaacatatgtcagataaattcctaggggtggaattactgggtcaaaaggtatatatatttattatgtttgatagtgacttccaaattaaactgaaaattttgtaattttttttccactctaaagaaatagaagttcagttttgtgcagtggcagcatcatagccagtgaggtttatctgaggagtgattattgctaattgaaaacttttcccagtaccccgccatgatggcttgaaatatagttggcgttggcattttttgacagtctgtatggagactaaactaaaaatagaaatgaagaaaaaagaaatggaagttcataatttaaaatttttatttttttgtacaaattgatggggtataagtgaaattttgttacatgtatataatgcattgtaatgaagtcagagtatttagggtgtccataacccaagtacaatatatttttgttaagtatagtcaacctaatgtgctgtcaaacactgaatttattccttctgtcttactgtatatttgtaagtaccccttaacccactttttttcatcctcctccctacccccgattcacccttcccagtctctgttatctgtctgtccactctctatctacatatgatcaagttttttagctcccacatataagtaagaacattcaatatttgtctttttgtgcctagcttatttcacttaagatatgacttctagttccattgatgttgctgaaaatgacatgatttcattcttttttataactatatagtattccattgtgtatatgtaccacattttctttatccattcatctgttgatggacatttaggttgattctgtatctttgctattttgaagagtgctgcagtaaacataggagtgcaggtatccctttgatatattgatttcttttcctttgggtagatacatgggattgttagatcaaatggcaattctatgtttagttttttgagaaatctccatactgttttccatagtggctatactagtctacattcccaccaccaatgtataagagttcctggccgggcttggtggctcatgcctgtactcctagcactttgggaggccgaggcgggtggatcaagaggtcaggagtttgagaccagcccggacaatatgctgaaaccctctctctactaaaaatacaaaaattagccaggcatggtggcgcacacctgtagtcccagctactcaggaggctgaggtaggagaatcacttgaacccaggaggtggaggttgcagcgagctgagattgcaccactgcactccagcctaggcgacagagtgagactctgtctcaaaaaaaaaaaagagttccttttctctgcatcctcaccaacatctcttattttttgtcttttcagtagtagccattctgactggggtaagatgatatctcattgtggttttgatctgcatttatctgatgattagcgatgtagagtattttttcatatacctgttggctgtttgtatgttttcttttaagaaatgtctattcatgtccttttcccattttttagtgggaatatttgttgttttcctattatttgagttcttggtatattctggatattaagtccccattagatgaatagtttacaaatattttctcatattcaacaggttgtttcttaactctattgattgtttcctttactgtgcagaagatttttagcttgatttgcctatttttgtttttgttgcctgtgcttttgaggtcttagtcataaattctttgtctagatcaatgtccaggagagttttccataggttttcttgtagtgtttttatagtttcaagtcttatgtttaatccattttgagtcgatttttgtatatggtaagagataggggtccaatttcattctgcatgtggctattcatttttcccagcactatttgttgaagaaagtgtcctttccccagggaaagttcttgctggctttgtcaaaaatcagttggctgtgtatgtggctttatttctgagttctctatgctgttccattggtatatgtgtctgtttttataccattaccatgctgttttggttactatagccttgcaatatattttgaagtcaggtaatgtgatgcttccagctttctttttgctcaggattgttttggttacttggactctttttttgttctgtatgaattttaggattgttttttctaattttgtgaagaattatgttggtattttgataaggattgcatcgaatctatagatagctttgggcaatgtggtcattttaactagattaatttttccaacccatgagcatgggttttttttttccatttgtctatgtcatcttcaatttcttttatcagtgtttgtagttttccttatagagatctttcacctccttgtttgaagttattcctacatattttatttttgtaactattgtaaatgggattgccttcttttctttcatgtctagatcattattggccatcatatagaaatgctaatgatttttgtacattgattttgtatgctgcaactttttattttaaaagaagtcaagcctacagaaaagttgaaagaatagtacaataaaaacccatatacccttcatgaagattaaacacttgtttacattttgccacatttgttctctctctgtgtgtatacatatatataacactacatagaacatacatatatatatatacatattttatgaaccatttgacattaagttggagatatcaagacactttttcagcctgtattgcctaaaaacaagggtgtttacctacataatcacaattttgttagcacacccaagaaatttaagattgacagaatattattttattcatagcccatattcaaatttcccgattgccccaataatgtcatttagagcttttttttgtttgtttcaatcaaggatcccaaattcaggatcaaaggtcatacaaattcatgtacttgtcatatctctagtagtctttcatataaaagtttcccacttttttcatctttcatgaaatattcattttgaagactctaggccagttatcttgtatcatggcctaaaatttggatttgtcacattgttccctcatgaatatattcaggttaaacacttttggcaaagataccacataggtggtttccattgcctcacgtcaggaggtgtatacaatgtcaatttgtcctattgccaagttggatcacttgaccaaagtagtgtaatccagatttctccatgtaaaggcacattctcctcctttgtaattaatattcaattaatatctttaaagtatgaccatgtaaatattctgttccccaataattttcatctgatagttttagcattcattataatccctatctgaatcagtttttaacacagtggctgcaaaggtacgttttcccaattctgttgttccttccacatttattagctatccattcgtctgtaaaggaagctgaccccttttgtttttcatgtcacttcaaattcttttttaaaattaatctgtataacctgttaccattattggactcgtgcctgaatagacagatcaacaaaacaaagcagaaagtccagaaatagacccaagtatatatgaaaatgtaatcttttttttttttttgagacggagtcttgctctttcccccaggctggagtgcagtggcgtaatctcggctcaatgcaacctccgcctcccgggttcacgccattctcctgcctcagcctcctgagtagctgggactacaggcacccgccaccacgcctggccaattttttgtatttttagtagagacggggtttcactgtgttagccaggatggtctcgataccctgacctcgtgatccgcctgtctcggcctcccaaagtgctgggattacaggcgtgagccaccgcgcccggccgaaaatgtaatatttaataaacagtttattactggggcaaagatggactttttaaataaattctattggcacaactggatagccatttggacaaaaaggtaatttggtcccatacttcacattgtaccctagaataagctccaaatggagcttattatataaaatatttaaaaaataaaaaataaaaccatataggtaccaggtggtccaaatattaaaaaaaaaaacatataggcactagaagaaaacgtcgattaatttctttataatctgggtgtggggaaagccttttaaaatatgactccaaatccaaatgccataaaatgatgagtattttcaagtacataaaaatcaaagtaaaaacctttttttgcatggcaaaaatcagataggcaaagtcaaaagaaagatgatgaaggccgggcgtggtggctcatgcctgtaatcccaacactttgggaggccaaggcgggcggatctcgaggacaggagatagagaccatcctggctaacacggtgaaaccccgtctctactaaaaatacaaaaaattagccgggcgtggtggtgggcacctgtagtcccagctacttgggaggctgagatagaagaatcacttgaacccgggagccagaggttgcagtgagccaagagcactccagcctggtgacagagcaagaatccatctcaaaaaaaaaaaaaaaaaaaaaaaagaaagaaaaggaaaaagaaaagaaagatgatgaaactgagaaaatacttataatgtatacataaataaaggtccaatatcccaaacatataaagaactttttaaatctaaagaaaaaaggctaaaaagtctcaggaggaaaatgggcaaaaacatgaatacacagttcacagaagaaagtatacaaatgatccttaaatatatgaaaagatactcaacttcacacatagtaagagatgcaaatatatttaaaatacacagtcaacttgaccatctggatcatttggagaggaggagcaatgccaggttaggttaagttctcccatttaggcactccttgatatccctgggcttcaccttttatggcacttatctgacttgtaattacagtgattgtttaatgtctgtcttccatactagttaccaaatgtataagaatagtgaccaagactatcttattcacactggtatccccagctccacgcacaaagtaaatgctcaattaacatttgtcaaatcaatgaacaaacaaactacagagtacttatactcaccaataagagctaccacttaatagttggatgaatgaatgagtaacgtggaggcaaggaattgaatctaaatctatgttttctgtagttctctctccccgcttctctttcagttcttgcccactttccatggcaaactctctctcctattttttctccctaatttccatctaatttccacatgctagctaaagtaaaaccttcagcatggcctatgctcataaaatgtgtgcctagatcaaaaataagaaaagttgcaaatttacatgataaattggatgttagcatctgaagtgctttaaaatggcctgctttcttatgtttctataattattttcttatgcaccaaaataagaaaactgaaaaataatttattgttaaagtcattccaacatttatcttattgctaaaactgcttcctaccgtttcattgcaaacctacagtattttagctttacttttgtgaatcaaattggaactctaaccagcgtaatcttgtctcttcaagaaaatgcattgtaggcaccaaaaaaaaaaaaaaaaaaaaagaacaataaatgttcgaaatgtagcacatttgtaaattggaagacagcttgtttatgagtgcctgttgattaaatttgttaatgagcccttaagaaattgcccctttttctcctaccactagaaatccttgatggatttttctattacatctaattttcaacacatagaataaagccttccatctatgttgacttttacctcagaagttgagcgagttacttgatttttacaagcccagaaaaataggcttccccctagacagtcattgtaaaaggagtctcttggtagcagattccatttttttctaatactataattatagatcgatccaataaatgttactttaaaattttgctcagtggaaaggcactatagaaaaatctcatgtattagcctaaagcagcttgaatctactccctatcttgtgaatgtttaggagttttgatagcctatataaataagtgtgctgcatagcagcagttattacaataaaacaatattctgctggattttgttgaagctttgattaatgtgaatataaattgatagggacaacagaaagtttgaggttaaaatttaggtagcaaccttgccataacgtattgtaaaagtaccatatgctcattggataatatatgaaaagtaatgaaaaatagaaaaaagtttaaagtgaaaataaaaatcaccataattacgccaggcagagacagctgtgtgtttgtggggttttctatgtgatggaactcagatgctatatgcaatattttagtctatggaagcacttaaacattgatagtattttttaaagaaatattttgtgtcatccggggtatttaagttttatggtttagcacactactctggagaatggtttgagactcccgagtcgagaaatcaattcacagaagtcctgtttcaattacctgcagatgtcagtgtggatctgagtgtgattcaacactttgttccaggatgtggtgggacagttgaagtccagttgtgaaccagttgcttattaaacaaataacagtttagtttggatgagaaatgtgagctgtaaggacctcaagtctccgaaatttctttttataaaatctaaataagcatggatatattctccagttacatccagttcacagaagattataccatctcgttcccgcccctgattgtttaaacagcctaagattagttatagtgctggagaagtagagttgatgtcgttgggcttattaaatttgactccagcccagatggcaggtctgagcgatacattaggagctgtgttggtttactttttgctgttatcgtatatttaaactcaaagtttaaaactgatgattccagctctaaaagggcatcatctttgccattgcttctgatgcttatctgcttttctacatgatcccgctctttcatgcaacttcgtgacatgaaaagtcaatgtcgattaggctaggaaaatgtcagggagacttgcagtggctcattttaccaaaacacaattgtttctcgggccacgacacaaatctgccatctgtttcataagcttgcaggcttcctctgaagtataatttgctatatatattggtacagaaattgttggtagcttatgtttacctagcaacataatctgtttggtagaaggctgtgggaaaggaggctttgtggaggaggattttctttttctttctttttttaaagagagcagtttcttcatctacaaattatctttaagtgcaagaaaggcggatgtgctggcccaaacaatctgccttttataccattttaacctaaattgcctagtaaatgctcactttgggagttatttttgctatgtcaattatctcatatatacatgaatgccctcttttcaatttatttttcttttcatacaaatcactgtgaaataactgccttgaccttctagctgtaaaagatcaccgagctttgggactgcctgcatctgtccagtgtgtatttctcctgtttcccagtgctcttagtgtgacttgtgggttttgaatgttgaatttacatttcaaggatgtttgtcagggcctggtagtctttaagttaaatgtaacaaaatcaagcagcctgcactgtgttgtctgcattacattaattttcatttaattgaatgagctgtatatttctacctacccactttcttagctttcttatcagcagagcaatgtgtctgttgaaagaaaaaaaaagccaaggggagaaaaaaaagttttgactttccttcatgttagttatagacatcatatgctggtaaaggttagagtgtactttctacattcattttgagaaggggaagaaagtgttgtcctgtcaacttccttcatgtaacaccaaggtataatttgctgcaggcttattgcatgatattgcccttctgaaagtgacgggtttttcattttaatctatagctattatgtagttctcaatgaagaggcaatgtggaggttactaacccacttccctctctaaaaaaaaacaaacaaagaagaaatgaaaagaaaaacgaacttctatatcatcctgagactttgaaactagtcctgagaaaagactgtagcagaattgttatatggacaaagttcctttagccagagccatcccatgtctttcatcttgcagcctttgtttctgcccccttgagtccctaactcttcacaagcccagaaatctcctcacaatgtagcctcacaggaaagcactgataacttctacagagttggccctgacagttttgcaagggacataggaattaactgggttggaaagcaggtttccttgcatcactgggagcagccattaataatacaaacatttattcttggtgttctccagtaatgctagtcatggaagtgagaaattgacagcttgagttgtgaaactgagacccatttttatacagagcagatagttaaaggcaagtgagagaagatgagctaatgagagaagggttgacaaaagaagagcagaggaccgggcttttgcaacagaagggagatgtaggatgaaagatcctggaggagtgaatgatcaaggagggaagcttattgtcttatttaaccaacacttcttcagcattggtagtgtgccagagacaagagatgggaggaacaggatagagaggagacatttttaggagggtgatgaatgaaaacaaaatggtagaagatgccccaaaagtctttagtggctttatttctgtcgagaaggtcggaagtcagattgcagaggagcaagaaaggaatgcagcattcattctaaaagtttggcagcattctagagactggtagctggaagggtaggagggtcacttgtagagcagttgttgatgttgttgttgttgttgatggtgatgcagttgtctgcatgagattgaagagccaatgggataggaaataaatcagaggtccctggtgagcagtgctgtccactagaactttccacgatgatgggaattacatacatttgcaccgtcccattcaggagccgccagcaccacgtggctgttgagtacttgaaatgtggctagcacaatcaagaaacttcatttttagctttatttcattataattcatttacatttttcttttcctttttttttttttttgacagagccttgctgtgttgcccaggctgcagtgcggtggcatgatcttggctcactgtaacctctgcctcctgggttcaagcgattctcctgcctcaacctcctgagtagctgggactacaggtggcgcccccacaccaggctatatatatatataaatatatatatatatatttataaatatatatatataaaaatatatatatataaatatatatataaatatatatatatatatttataaatatatatatataaaaatatatatatataaatatatatataaatatatatatatatatatatatttttttttttgtatttttattagagacagggtttcaccatgttaaccaggctggtcttgaactgctgacctcaggtgatccacctgcctcggcctcccaaagtgctgggattacaggcttgagccactgcgtccggtcataattcatttacatttaaatagctacacgtggcaagaggttactatctaggacagcagaggtctataaggagaaaataaatgtgggagtaagaaaatgggaagagatgaattctagagcagagtaggaggcagtaacttagtatttaggaaaaatcttcatctgatgagagatgctctcacatctccaatagctaggggagttcagacccatagcgtaaatgttttcagcaaccgaattgtcaagctcatctactaaaaatgggagagttgagaggaagaagatttggggacccgaggagaaagattgggatattcacagcatacggtatatcaggaacaactgggcagtgatgggaaccaaactgtggttgacagcatgagtttgtggtgggccaagtctaagaggctcaacatgggccaaatttgtactgagccaaatgcgtgcaattccatataaggttctttctggaataagaaacaaactaaaaggatctggaaaaaggatattatgcaatttaggcttagaaagttatgtttgagtatatcccagcagctctgttactctctcttaaacatcttctgataaattccattggtttttttttctgatgaatttaagccttgatagtataaaatgtatttagaggaatctcactaggcaggttagggcccttctgcctgggtggtgtttggttagggttatctgcaagattccattgcttgttctccaagcaaaagagctttcgggtagctcacccacgcctctctggtgataggagtggagatggtgggggcttccttatagctagaaaaattatagcactgtgtaagcccattgctatttaactaacactctttccagatgttcttggaatggaggccaggggcaagatatgcttattgcaatacagcttctatttgtgggaaaggagaaaaattaaaggaatgagcagatagaaatggaaactgatcagctagtatttttctatatgttaataacacgaaaagaattaattatgaactgaacagagttttctttaaaatccaggtattaggcagcaatttaaaatcttgattttttgatagaaatatctcaacaagctcaaatttttgacttcagaaacaagtgcactctttggctacctcgtcagtcctgtggatatttctgtgtaggcatttggttcttgttttcttctgtcacccaggttggagtacggtggcctgaacatgtctcactgcagcctcaacctcccaggttcaagggatcctcccactttagcctcccgagtagctgggactacaggcaaacgtcaccgtgcctgtttgttgttgttgtttgtttgttttgttttgttttgagtcagagtctcacactgttgcccaggctggagtgcagtggcacgatcttggctcactgcaacctctatcttccatgctcaacaatcctcatgcttcagcctcccaagtagctaggactacaggcaggcaccaccaagcccgcctaattgttgtattttttgtagagacagggtttcatcatgttgcctaggctggtctcgaactcctgggctcaagtgagcctcctgccttggcctcccaaagcactgggattacaggtgtgagccaccatgcccagcctgattcttgttttcattgcagcctaacactcttagaaaaggctgattcgtgtcaaaaacccatgacagtgagtaaccctgattagaactcttcttctaacattaaaatttaaagtaagcaaaatgtgtcttgttcaatatgttccagtggccagtaagggacaatacgacttctccagtctctatagttccagctagggatttaaagagaaataaaacagatgttagagcctcaacctgccaatatcagacctaggtaattgtcttgccagtcatttcatccatctgctgtaaaatatcaagacgttccccccatttaaaccctgataccagagtaattcaagctgcctgagtaacaccagtagctacgaccaaattaagttttcaaagatgagaataaaactgctgaaagtagaatttggcatgcctctaagagataaggagtcactcagaaattttagaatttcaatttgttcatccaggcatttgttaaatatcttccaagatcccttaccattggtgatgtggggagaagacaggcgattcagtagcggtatcagatatgaatctggccctcaaagatttgtactctagttgggtttacagatctgaagcttctaaagcaattcgagaacaattagatgtaaacttacatggtaaggcccagaaggtgactagaaccagtacttttttttttttttttttgagatggagtctctctcttgtcgcccaggctggagtacagtggcgtgatcttggcccactgcaacctccgcctcccgggttcaagtgattctcctgtctcagcctcctgagtagccgagattacaggcgcctgccaccatgcccggctaatttttgtgtttttagtagagacagggtttcaccatgttggccgggctggtctccaactcctgacctcaagtgatccgcccacctcggcctcccaaaatgctgggattacaggcgtgagccactgcatgcagctgaacctgtatctttaaaaacaaaagagacatgtgatagcacagagagaacctggcattagcgtatctaaggccaattttgtcactaactgaccggatcaccttggccttaaactctaaatcctgtttgtttttctataaaatggagattgtgctacttgctaaactggctttctcacagggcttcttgtctagggtgggaagccatactggataattttgaagtcctttcctggctcttaatattctatgattttatggtagtgaatgcaaaagtgctttgaaaagtgttaagtggtgtacattgtaatatttgtggcattatcatcattatgaatgcctctttggggttcccagaggctgatgttctccgtgcatctgctcacaggaccaccacacagcaagtttcctgactctcaggccaggattctctttctgatcccataatgtctcttttaaaaattaataagctgagtgactagcagataatttcccaaggaggtccctacaatttccccactcccacacacatttattttctcttccttggcagagtgcaaacttcactacaggccaccgaacaaaataatgtcttcttttaaaatcattaagctgagtgaccaggcaactcgaaatatagcagggtgtttcccagggaggtcaggtcaccactttccccaccccctcctcatttatcttctcttctccatcagaatgcaagctgccacacaaacttttgggcatatgctcttttggcctcctggataggcaggtgttagccacaggaaacaagcaactaaacaggctgctcttggtgccgattggccatgggttaatgagaggtttcatttaactctaggtggtcggtggtgttccaccccacctctcccagagtatgtcattgtcctgaatgagaaggcctgagggcaatgcttagaaatgagtttaagctgttacacatcaactaaggttaaagtcctctgtgcttctgtcccccttattgcctactctataccattcctcttagcatatactgccttgggctgtttttattttttctgaagcatgtggcctgtatcccttagtgaaaccctgtagccccttgaacattgagcacaatgttctgtaaacaatattcacatgatttgaaaaacaaaatccaagcaatgtagaaaatacgatcttctgaagtatttacagtccaaaagaaattatactgatactaatccaagagacttggaagtctattcacttccaccctttcacctcaaattgtgcagattggtttaacagcccaccatgtctcactaatgttaatgtatggttacctctggcagtctcgacgctgagatctgtgactggagcctgggcatcagttaactttgccaatgactgtgatatatcatctataatatatgatacgtgatatggccagtggagccaaacaagtcattggagagtgagttatgggctttctggacagaagaggtattgggtcaagtccaaaaacagcattcaattttcctactctgtaagcagcaagaaaaatgagggccaaggtgaccacaatcctatctagcctctacatctgcctttaccaagatgtttctaaagtccttgatgttaactccagaaaggcagtaaaaatggaccaacagcagagagatgtaaagggtgccttcctgtctcttgggacaatgaggcagccagccagcctggccagctgaaggagaacaaggcaacctgcccagcgagacaaagcagaggtcagacaaggaagtggaactattctgcaagaggggtgggagttttgaaaaattaaaaacaggtcaaggaggaagctgatgatgggaactgaacctcaggccacaggcctttgattgtataccctccagaacagagtgtcacactgagcactgcaagtaatctggctttgcctatgtcaatgtgtgttatcctcaaccttggcttgggtgagtcttcaattctcaagctgattcattttaaattcaacaaaaacaagggagaggtggggaggggaacagattttaggggttacttacctccctctgaaactaacgctggtgttttctaacccagcaccttgcaacaaagggagagcatgttagcttccttctgggaaaggaaggaactggactcactgtggtttgggtagtgcttgctactgaggcattaatcagggtcctgacatagctggaaagggctggtttccttttcatgtatagaatcataaagggggcacaatattcaaacaaaaggccaaggaaacctctcccaaagatcctatcaactgcagttctggaccaaggagtctggccagaagggaaagcccattttagaaaaggaccctgtttttccaggcagtgacattcctgttactgcggatatgactatagttccaaagaggtcactgagatagaccttaacttcaactggctttcagggactggccaattatttatggtagggttatttttcattatctgtaacattaagaagtacagatctcctacgcttaagatggtagccattgtggtttgacatcccaccatccattttacctcttacattgtttaacgtaagtatagttttggggattgcttccagctccagtgggtggagcctgattagtctgagccaatcttggtgatgccatgtctctggatttttcagctatacctcgctacaaggattggcttgggaatgggcatatgactaaattcatatcaatgacagatgaaggaaagtttgcagtgggtttctgaggaaagcttcctcattgttaagaaagagatctctctcactccatatgttgtcatacatgggtgtgaggtcttcaactgctgcagacatctcactcaagcttgagggtaaagtcaactgggggaggaggccaggacaaaaagaagagtggggaaaaggaaccagggctacagaattatgttggccctgaagccatgtgcctctggatttctagttttatgagccaaaagctttctcattttggaaggtagatggtgacaagagagtctggcttgtccttgagacagggactcccagatcacccagtggagactctgggagactgatacacacacactggactcagaagagactgtaatctggaacaccaatttattcaatgacaaggagtatgtgtctttccaggacctgaaatgcttgtgtcctctaacttccaatcccagtatcaaggtacctaggaacccaggctggtagtacaaaaatagcaaactgcaaaaataataataaccaatagcctggtttgcccaaagtcacgtagcttgtaaatagcagagcacagagagtcaacaggtagactctgatctgagtccaaagccaaaactcataagtagtttatctagcctttagtgacaatcaggacgttattccgatggacaaaaacaatatactgagcccttgctatgtggctggccctgtgctaaacactcaacatttattacttaattgactcctcactataacccagcggggacaggtattatgataattcccattttacagcagtggcaacagaggcttggagaaatgaagtcagtccccaaggctatgtgggtaataagtggcggggtcacctgatataattctagggtatccactattctttaaggaatcataacgaagggagcggggagaagagtagcatctaggttgtttcctctggtcccatccaaaatatacctttctttttcttttttttttttttttgagatggagtctctctatgttgctcaggctggagtgcagtggcatgatctcagttcactgaaacctctgcccccttggttcaagcaattcttctgcctcagcctccttagtagctgggattacaggcatgtgccacacccagctaatttttgtatttttagtagagatggggctttcgccatgttggccaggatggtctcgaactcctatccttaggtgatccacccgcctcggcctcccaaagtgctgggattacaggcgtgagccaccgcgcccggcccaaaatgtatctttctgatggcctaaagaacttacgtcctcttccttaaacaatgccacacacttgctgagaacgtcttacaatccagatgtccttattcagtattcacgttcggttaccaaaaactttcgtcacaaccagatcaagataacttattttgtattggttagccctttaaattgatcccttgtggttgagattttagaaaccactctcagtctcttgctgattttgagatagtaccctagtcttaatagcatcgatggctagagtttttcttgtttcggagagtgacattggctggccttgtccctacatcccaggaggctaccttatttgtatcctgcagacctcttcttactgttttcagaatttttatggtgtttaattattcattcttgcctgaaccatacatctttgctgtaacttatgtttcttttggttttttactacgtctttattttctaattaaattattttaattgttttatgtttggaagtcttctctcccccaccccccaataaaatgacaagcttctttcaggcattgactgtattttctgctttctacacattccccacagcaccaaacagaaagtggagcacatagtaagcattcagtgaatgctgatggaattgaattatgaactattgtctcatgttcagtctttccccaagggcttttggttagaacatttggccggaatgtcatacagacaaaactgaattaggaaaaaacatgcaatatatgttagagtcaaggtttcaggcttagaattttgcattacctaatgttttgacttcttttcaagtcagttagttattatctggcctcacaaacattgcctttcttgttacatcttctaggtgggacttttctttctctttgtcctgtaatttcacatttatccctctcaaacaaatccttgagcatggtttttcttcttgctgaagaagtcactgttgtggccatcctagagtggcctgctgtgaaacatgtgctatttcacttctgtcttcatttttattttcttgtctttctgtttctgttttctttcctttctctctctctttctttccttcttctttctttttacattaacaactgcctgtagatgacaacagctagaaggtgacaacagaaacaggaggaccagcccttgctgtagcttacaccctaaaaggggaaagacaggacatccaaatggaacaaaacacacacatttgaggattccaatgcaggaggggacagaggagtcatcaatttgaacctaatttagccccttaaggaagtcagcaccgagaccattgccaaaactttattgattcctactttggacttaaaaaaaccctctcagagttgaaagaagaccactgttgtctttttttcttttctttctttctttttttttttgaaacagagtctcgctctgtcgcccaggctggagtgcagtggcgtgatctctgctcactgcaacctccgcctcctgggttcaagtgattcgcctgcctcagtttcccaagtagctgggactacaggcatgcgccaccatgcccagctcatttttgtatttctagtagagatggggtttcaccatattggccaggctggtctcgaacacctgacctcaggtgatccgcccacctcagcctcccaaagtgctgggattacaggcttgagccactgcgcccggcccactgttgtcttccttacttcgtactccatgctccaggctgtgcagccacagtcctgtgctctcagtgcctgggcagggataatcaggaagtgtcaactctgttatggagggaacagtaagcctgtctgcccatcttcagtgatgaggtctctttgaacttacatattcaatacctggatttagacagcagtggcctgctttagacagccatacatgagaactgactgcatgagggtggaaaaaggctcttccccactgcccatcccccacccagcccctgcacctgtgactgtttgaaatccccactctgccagctttgttcctcagtaattcctgctgagggaatttaggcctgctctccacagccacttccatctgcacttggctttcttcttgagtccacagttctggcaagggctgacttcttccaagtcagtgagaggagagtgcacgttcaaaatcatctgcctgggattggagagagtggaaaatgggaaacatgctcggtttggaggcatctcattcttttggaaaaatctgaaacctccactggtttactgtttataggctgccaagtgtgttctttttttttttttttttttccaagacagaggacaccatctctgcatctcattctaaataacagacaaactatatacagtgcttctcccacccattacaaaattgccaaataaggtggggttaggatttggcttattatcgtggttgtttaccacaaaggggtcacagttgaactgcttttagcaaaaatagggtgttgttactctctccctcctcggtgattgggtatgtctattccttatccaaaatttccagacagttcctgtctcagagacttgttacccctaaactaccttgctacttaatttaacaaaaaggaaagtatgaaaattagatgtttgctcattgcttctgacattttttcttccaaagttctcctcaccgtactacagtggagggaaagactatgaacatacattcgttacgggtatacttttttgatttggtaaaaaggctctgctattgtgaagcatgtcttaaacataaacaataaaacctcataaagctagcttctgtttacccaaagtggtgggtaattggaaaccggattatagaatcatagattttttaaaataaaattgttatcgaagcataatatccatgtcaaaaagtacacaaatcattagtgtacaacttgatggatttttacaaaatgaacatacccgtgtaaccaatacccagatcaagaaacagaacactttccttatattagtttctgtggttgccataacacattactacaaatttcatggcttaaaacaacagaaatgtattccttcgcagttctagaggccagaagtctgaaagcaagatgtcagcagggctgtgcttcctccaggggctgtaggggagaatccttccttacctcttccttcctggagctagtggctccaggcattccttggcttgtggctgcatcacttcagaattctctgcctctgtcttcacatggccttctgcttctccctcttctgtgccttctcctttgccatctcttataatgatacttgtcattggctttagggcccactcagataatccaggatgaactcatcttgagagccttaacttagttatatctgcaaaggcccctttcccaaagaaggccacattcacaacttctaggacatggtcatatcttttctggggccgccattcaagctaatacccctctcagcgacttccatgtcaaaggtaaccactgtcctgacctctaaaagcatagattagctttgcatgcaattcagttttctataaatagaatcatagaggccatactcttttgtgtgtggcttcttttcgtaacatcatgctcatgagatctccatggttgcttacagctgttgatcattcactctcattgcagtatagtattctattgaattagtttttttttttttttttggagacggaatttcactgttgttgcccaggctggagtgcaatggcgcgatcttggctcactgcaacctccgcctcccgggttcaagcgatacacctgcctcagcctcccgagtagctgggattacagacatgcaccaccacgcccggctaattttgtatttttagtagagacggggtttctccatgttggtcaggttggtcttgaatttcccacctcaggtgatctgcccgcctcagcctcacaaagtgctgggattacaggcatgagccaccatgcacagcctgaatgactttatcacaatgatccattcgacttttgaagggcctttgaattacttttagtgttaccattacgataatgtggttatgaatattcctgtatttgtgtcttggggcaaatgtgcatatatttccattgggtatacccaggggtggaatttttaggtcctaggatatgtgtatgttcagcttcagtagacagtgccaaagaattatagattttttaagttataattaatctttgaaatcgagaccagatttaagtaatgcctcacttaaataaaatgcatgtaataatcccaaatccactaatccaaaaaacagtatttctcctggtgcccagacctttcgaaaggggcagatcttattctacattgccattctggcacggacaccccaaaaacatgctgcattgtctttgtcagatcacacaagtaaaagagaacttggtagcattggccatggagagaggcaagaggcaagccatgtggccaagagcattagctggaattaaccagcttcctccctgcactgaggcttcctgtttgctctagcagtcagctggcttgggatagcattgaaggcaggctctcttatcctcactagtgtaggcataggagcgatgttgcctaggaaagggcattatacatgaagcttgcatttcaagaagtgtctgtttcaaaaaaaagttcccacttttggaccctgagctatgaaaagccaaagtcacctcgaagtcgaataaaaaaatcaatttaacaaaacagtccctttcacacacactcccaccctgctgtgttatttttttaaaaccatttagtgtcattaagccattgcctcataaagttgtttcaccaggaacttcagtttccccaggaagagatgaaaataaactgaacatttcatgtcactgttcccacgagtcttaaaaaatcatgtttgtctttaacagcacgatatgaaacatctcttgtcgataaggagttatacttcaggataacaaggcaacagaatctacaatgataaattttacccacattttaagccagaattcctcatatagattaccaggcatatttgactccaaccatattttcccacataattatttcttttaaatctcctaattattccattctgttgaataccatatgtcctgctgagggacaattgtgtctaaacaaatcaacaggttttgcatcattgtctaaatatgagggagaaacaacagccccacaactctactctggcattttggtggaaatgaagagttctaaatcccacattgggaatgcctcatctctggctcccctggaagataacttgtggagcccaaaaacaaagccaaatgaattttggaaaggtcagtgggaaagacattggggtgggacttttccagaaaatgtttgagcctttgctccatgagctgtctggtcacccggacagtttgtacttcccagagagggtggggaagagagcagaagcaattcttctctctgggtacctgggtccaggggggctggaaacctgggatttgctcagttggcttgggtgcagttgtctcaccctgggaacgagcccgtttgaaccctatgaacagtgtagttatgtcaggaaccttggagatagaacagaacatctgtgggaataaaatagctgaggattgtctgccttgtgtcttgttttcgagagaactgctgatgtgtttcaaataattgaatactgtgcgctgggaaagtgcttctccctgaagccagttccaggcaccccagagctccagtgcttctgctaagggcttgcagacatcgctgttaacacgccaccttccaacaataattgacctttctcctttttattttcttttttctcaccctctctgtcttgctctcactactctccccctttctctagtcttagttttctctttatatgtttatgtcttccctcaaagatgtggccaagaagccccgatggctctcagagtcacaaagaaggttaagtgcactggtgtgaggataactggcagttctgagaaatccgcaagtccctgaagattcttttcctccctctgtgattgcatcagcctcgccctcccctacttgtctgtgttgtccattctccttttatccatgctcacttctaaatcagttcattcaaacaccataagcatttgccttcagcgaattaactctgatttagttcaaagttcaatcaaaaggaaccagaataaaggaatagagtggactttcctttcggcgcccccacctgacttcccataagccaaactagctttttcgtcgacctcagcatggttagagcttccagatctcctttccaactgcccatgcaatgtcagaaggaagggtaatggagcacacctctagaatgttggggatcagtggtgctcccaattaggggcaggtgcattagcacacacacacttcctggcctcttccctggcccctgtccagaactccagcaagctaatcacaaggaaaatgtgtgtgcctgaatgttaggagtgaacaggcaggtgacttgcttcagaattagcttgcagcgtctctttttctagctgccatccagtattagatgtggtaaccacaccagttaacaccccggattggcttgggattatgaatggaaggaagggagatccccatgcaagcaagcagctgtccctttgcttaattattgggatccacaagtccatccctattgccagggcttcagtgtcgagatgatgaaataggtgattaagggacttggaggccagtccacattgcagctttgtctgagtgttccaacgacaagtgttattagtccactaatcataacattgcctgcagtggaatttccttgggaaggaatggggcagcgcctccatgccagagggctgcgcagcatgaaaatactaacacatcacaattggctgttctgtgggaagacgattccaacatccaattcaggaaataggtcaccgggctgctagatacactgctattttgatttacttccttagactcttgcagtcttcatagacttctctctgggtagaatcaaactcctccaacttactggcttctggagtgccacatagggaaagatgcaagcaagttctgaaaacagaggcatggatttctcgtgatcaatcttgtggtgtcctggtgtccacttgcttctagaatcaaacacaatgcccttcgggatactcctcaccttgacctctttcaggggagcttcccagaggtctggggccatggcttttaggagcctgcagctgtgccggccagacaacaaatgtttagtgagaggttgaagagatacaaatgggttgaagggcgccagagccttctcagtaatgagcatagcaaagcttcgatttccaaggatcttgggaggacaagatgtactcatttggagtattgcactgccagggctgtttgtaccagctgtcgggttcagagaccaccctgttggtggggtcaggggcccagccaaccctttcttttattctatacctctggtcacttgggccttaagaagcaggagtcggggcggtgggggcggtttggggctctgtcactaagcagctgcctctttcctggatcagtctagacttccctctgatttttcctaaacccaagcagttgtctactgccttggagtgtcagcaaagggtatttgtgggtctttggtatttgcagatttcatatcaggcaaaagcttacattccccttttcttcttcttcttttttttttgaaatggagtctcgctttgtcaccaggctggagtgcagtggcacaatcatctcagctcactgcaacctctgcctcccaggttcaagcgattctcctgcctcagcctgccgagtagctgggactacaggcgcatgccaccacacccagctaatttttgtatttttagtagagacagggtttcaccatgttggccaggatggtctcgatctctcaatcttatgatccgcctgcctcggcctcccaaagtgctggaattacaggcgtgagccaccgcgcccagcccctttacttcttcttcttctttttttttttttttttttaaggtagacagattatatgacattgggggctctgaacttacccactgcccactttttgtttttagcctttcaactactgggtaattctggatttataacctctttcttggtgcccagagacatactatattatgttggggcataaattttgggcttcagctcacctgtccagagatgccatcccaaggcagtcttttaggagatgaggagttgtaccagttgagataccatgggagggtttgaagaggtgtcttgctgagtaagaccaaagggtgttttctctctctctctctctctcttcctctctctttcttgctttctctctctcttccctgctagccatgacctatatcagcaaatagaaaaggggaatatttgtgataaactcctcctggcaaatccattttttgggctctggacttgagaagagctttactgccttttaaaattctaagtagtctgttaaacactatttcgaccctctaattctttctccagttcttttttcttttctttctttttttttttaacaaatctttagagcagaggttgtcacacaagtaagtggagtagaatttatagtcactgcagaacaaccacatggttattgcatatactgcagagacaagcaaaagatatgagacaaaaattgcaagagcaagcacctccaagttatccagcagccagtaaggttacagagattgctactggttacagaggctgtgatgtgagctgggcctgaatttgatccccagctgtgctccttatagccgtggcactaggcaggttcctgagcccctgcttcctaccctccagatgaaaacaaaagttcttagtgcgaaagggttgggaaggttaaacaagaaaatataggtgatatgctttctcagcccagtcctggaaattagtaaaatggtcacagaatggtgacttttctcattatgaaaatcacctccttggctttgtagtcccatttcctgtttaatagcaactgaaatagccacaggagccaccaccccccatctgagtctggctattttcgaggctccatttggaaggggatggccccagcagtccagggggtgggaggtggtggggagggaggcattattctctgggttgcagctgtggcagtaagtacagtatcccccacatgccagatgaatcaagctgagggccagatctgggctgtgggccagaggttccccaccctgatttatagcatggacagagatgtgggtgttttgtgaatatattttgatgatgataaaaaaaagagagaggggagggaacgccattccttaaaaatgtgctgagggagggaggttcagacctatcttcaagattagagcagcctggctgttcgcggtagcaagtcattagaaagaggcccatggaagagcagcctgtgagaggccttgaaacacagtgaattgtgaataaggcccctgtatgccagccattgggggcagattaggcttgctgtcctctctgcaggtgtggagtgggggactaagcctgcattttaactcctgcaggtcccaagagcagagaaagggagcactgggtctgctgagctgtggggagccccccggccccatgcgttcccagtgctaatagttctcccgaaaccagccaggctttgcctctgagatcaggcctaggtcattgccaatggactgaggacaacaggctaagtgtggaagtttgccctggatggagtttggagaaaactcacgtggaggatttattctaaaccttcaacctaacaacacatttgagagggctggctgagcagcagatgggagttgtggctccctccagaatgttcccctcccaaacaaggcacagctaggcacagacctccttgttttacttgtgggatatcaggcacagttgtcctggtttactgtgtttcatccaggaaagaacttcaatcaggtttcctaggacccctacagatctttgaagacaagagatttattccccagaggtgaggccactaaacagacagggtcctaaagcttgcagttcataaaatcacatcggtctgcaaacatctttttttttctaagggaagggcagtgaacgctctcatgccaacagcctgcagtatctgacaagtacaatctggtttttttccctctcacctctcactgctcccagccttgagccttctgttcaaaccaggcctcatcctcatccccagcacccctgccaacccaccctgctcagatttgcctttaagcttttgctccatctggaatcctcttgccctttgaggatccaaagcctttgtcctttcacatgaccagttctctgaggaaacagccctagctattcctgaggcccccattactgcctggtcaagggctttggggcacatactgcctgtgcgtccatcctcatgaactccaaatctccccgctactccacaggacaaagaaaacgagactgacaacgaagtctgaaggagaaaggcaagtatctttctgctggactggccctcaagacttagcacaagtgagtttttggagttttttcctgtgatttctgtgtgtacatatatactcacctcttttctgtgttcacttcactgaaacacaaatccaccacacccataaggccaaccctgggttactttttgagcctgcagagatttcccccaacagacaaaacttctaagccccggaagttctctgttttatatctaggatgtgaactaagactctgtgagaggggttctggtctatatcacttggggctgcctccttcaagggatggtgagaagccccctgaaatgaaataaaatggtttctcaggctcttccttttgaatttcccatttcctgcctcagggctcaacaaaggacttgtgtatgagggggtgtgtgagtgtgtgtaccatggcaggagaaggcacacaggatccttgttgttcattcacttttcctgggaggaaacagcagtgggtgtctattcccagcagtattaggaagcagtggtgtgggcccctcgccgtctctcttcccagcttgctgggaacgtcttttactccaagctggttaagtaaccacagagttgcatctctggcttctctgactacctcccactctccacttgatgcccacaaaaacaatgtgttcagctgatgtttgggtaacgttgtacatattcctagcaaggacattggacatattccttgcagataaggaaggtaggatccgttcctgactcaggaggctgatgtttcattctaataaagctcaaggtttctcctcgcccacagtcgtgctttttgataacctggcaacagccaaacctcagtcattgctttgaatggccctatctcagcatttaagagcatttttcaggggctgggcttcataaagattggggtttttttgagatcctgttaaaaaatggggtaagcatcgtgggcacatgctcatcacaacccagggaacaaactgttggcgaggagtgtagtagagcccacatacagaccaaatgcattaattatgaatggttcttatcttgtgattaaaacagatctggcaggcctggaacttggcagcccttggttagctattagttctatgctactgtaccggctgggcagtcataaaactgtatctctttgaaaaatggtccatcatgtagaacagcctcctctgcacccattagctcaaattgatatgacttgatggcctaatcttgggcttctcagatgctggatttaatttctgtctggagctttaggaaatctggaggaagggacacaagggctgcatgcagtgaggtagggtcagaggatgtacacaccagcccccacctccatctgcacaactccccttactgatggaaggcatccctctagttcatgttgccattgtgtgcccccactctgtcaagccctgttaaggaattaactacaagttgggagttcattggtaagatcctggggcatgacttgcaggtgcaatcacagcttactgcagcctcgacctcctgggctgaaatgatcctcccacctcagccctccgtgtagctggaactacaggtgtttgccatcaatcccgggtaattttttatacttgtatattgacaggtgtctcaaggaggcaaaagctcccaaggatggaggccatagtgctgggataagaactcatagtgtagatatttttggactgagtcttatcagaagacactttaggaatttcaggaatcagaagggtgtgattgggaaaacaggggcagagcttcccaatgccccagaaatcccaccaaatagaccacactgagtctccagtcagatggtgccaatctctctgctctaccccggcagtagtaggcctacgatattgctagatagcattcatgaagttccagctaggccaagtacttttgcaagttcatgagcaggcccctagggtagtctagcttgtagtctagatgagaaggctgttgctaatgcttgaatggacttttatttgattatttgatttaaatgtctcaaaaatggagcaagaacctaatctattgacaaaaacatgaatttgggaatcaaatccaaccattgctcatttattcaccttcaaaagttgagcattttatattgagcattaaatatgtgccaggcacagtgaaaagcattcatgtgacaggtaggtacaattatatccccattttatagagatacaaactgatgctcgggcatattcatctcggttgcacagctctaaagtagtggtgctggaattaaaaacaatgtagcacagagcataggttgtgaagtcaggctgcaggaatattcatattcttatagataaatgtgtaaaactaagggatgtttcttttcataagtgttctctggaggagctctcagcctcacgtgggaaaatagctctgtcactcagaggagagctttaggaggatgatacaggtatgggcaccatcaacatatagaaggcaagtgaagctgagggagatgagaggaagggccagaaagacttgctgtaggtcacacagccatcaaggacagagccaggcccaggcaacagcacttcccccattgccgtttccttcagctgcaacttccataccaagaggcggctccatcctttcctcgccccctttctcttactttacagtcagacaggagttatttcccaggaagcaataacagtattgacaatcagaggagtttgggacaggcaccgtggcttatgcttataatcccagcactttgggaggccgaggcaggaggattgcctgagcccaggaatttgagaccagcctgggcaacataatgagaccccatctttacaaaaaaatttttaaaaaattagctgggcatagtggcgcacaactatagtcctagctacttgggaggctgaggcgggaggatcgcttgagcccaggattttgaggctgctgtaagctatgatggcatcactgtgctccagcctgggtgacagagcaagacccctatctcttaaaaaaaagaattcatcttgagtaattattcatagctattgagtatgaatgaattctgtggtaaatagacaactctagggatttcagcacccactcccattgggaaaccttgctctaaactctcacataaaacactttccttctcagaaactcaatgctggctgtgaagaagagcttccagagcaatgactttctcttgacaaaggctggccctctcaaaaatggtaacatttgtctgttgcagtgtgcaagctcacacctttctctcatatggagccttcaggtcctcatgtgcttgtgctttcacccctggatcagagtgcatcttcatgtgctgtccacatgtgtacaacaaaactgtctctctggggccaggtgtgatggctcacatctgtaatcccagcactttgggagactgaggcaagtggatcacttgaggtcaggagttcgagaccagcctggccaacatggtgaaaccccgtctctactaaaaatacaaagttagccgggtgtggtggtgcacacctgtaatcccagctacttgggaggctaaggcaggagaatcacttgaacctgggaggtggaggttgcagtgagccaagatcaagccattgcacaccagcctggggaacaagagcgaaactccgtctcgaaaaacaaaacaaaaaaaaagatagaaagaaagaaaaagaaacagaaaacacctttctctatggaaagaatatcataatggctcatatgctcttttctgggcctttgtttcaggggacaagaaccccaacagtggaatttcaggcatcagccagcaggtgggtggattaataaagagagattgagagaaggcacctttctgccactcctgaaatcatactcctggctctgagtgtcagtcccgtttggaaactatagctggaaaagtctcagctgcccctgacacggtcaaatggaaagtgcatgggctctggagtcagactgtctggggtcgtgttctagctctgctacttactagctgtggcacttttcataagttactcaatgcgtggtgcctcagttttctcgttctataaaacaagataagtatagtacataattcacagggttcttaggtgggtagatctagataacttgaatacatataaacacttagcagagtgcctgtgtgccgggtacaatgggaagcacttaatgaatggtatctagtcttatcatttccttgctaaagctacctcttcttttaagtcccttaactaagtaggtcactttagagaaactcaattcaactggaattattgagtgtctgttgtgtgcctagcattgtgctggggacactgtgaggaatacaggagaaatctatgaaggaagaactgttctcaaggagctttttaggcaggatgttttgagtttcctccaacagcccaactagcagccacgtggagaggcccacggctcttccttacatagtagcatagcaaggggtttaaacttatgggctctgcaatcagacaggcatatcatctctgcctcctgactgaggtgtgatgttgggaaaggtacactacctccccatttctcggtttcctcatctataaaaatgtgcatcataattacatctttatacattgtgtgcccatcaacatagatttatgattattgatttatgcaattgtcttttcaatcagataggaaaaaagggagttacaaaataccttaaaatctttaacatttacctttaaatattaaatttactggtgttcttttctttcttcctgtggattcaaactactatctggtgtcccgtcatttcagcctgagagattccctttatcatttcttgtagtgaagatatcctagcaacaaactctcactttttatctagctgggaatgccttcatttctcctttattttaaacaacagtttggttggggatagaatttttggttgacagttgtttgcctttcagcactttgaatatgtcatcacactggcttctggtcttcatggtttctgatgagaaatcaactgttaattttattgggggtcttttgtatgtgatgagtcacttccctcttgctgcttatgagattctctttgcctttggcttgtcacagtttgattacgatgtatctagatatggacatttttgagtttatcctacttggagttggtggtgctttttggatgtgtaggttaatgtttttcatcaaatttggggagattctgcctattatttcttcaaacattctttatactcctttcttcctctcctctccttctgaaactcccattaagtgtacgttgttatgctggatggtgtcccacaggtgtctgaggctctgacatttttcttcattcgtttttctttctgtttctcacgctggataatataagtatcttcaaatttgctgattctttcttctccccattcaaatccgccattgaacatctttagtgaatttttcattttagttattatatttttaattcaaaaatttctatttggttgttttaaaataatttctatttatattttctgtttattgagatatcactctcatattttagttctttagacatggtttcctttcactctttgaacctatttgaaatagctgatttaaatctttgtgtaaaaagtccaacatcaggccttcctcagggacagtttctattgattgttttcttttcctttgtatgggctatttctttgcagatcccatacattttttgttgaaaactgggcattttgaatattataaggtggcatcctggaaatcagattctctgtcctcctgagcgtttgttgttgttgctgcttgttgtagtagttatttgtttagtgacatattctgtttgaacttctaccagagttggccagtcctatctcatagctacaatttgcaaagtataactccccctactgtttgctttggctgccccacaactcttttgatgaaacttaaagccaggcattaagagaagcaagatataaatatgaagcttgtcttgatgcctcttagatcttcatggagcaacctttattcaaataactcataaattacaaggcaaatcagcattcattatctgcctttatgtcagaatgagaaaaaaatgagagatttacatggcatgagagaagaacgcattccactcttctaagaggcgttaaaggctccctttttagtgaaataagccacaatccagaaggagaatggaaatccatgtcacttgagagagatgccactagccctttccttctatttgcaagcctccctacttttgagggagggggagcacacccctgctaaccggagttgtctaggtcctgtggtgttaccagagacaggggtgcctatgtgaggctctctctccgagcaaaggaggaagccttaggaaattgggaggtaatcagagactgggccagaaggactggtaaggtagcctgaggagcatgggcagagtgtctccagcactggatgggggtaaagaggagggagagaaagggggaaagggaggtaggtaatgggataaaatatggtcaataaattctgtgacactggggcaggcttagagcaacgggtagtttgcccttcctgactccatattttcaccaggaagttttttttttttttttttttttgagacagagtcttgctctgtcgcaaggctggaatgcagtggtgtgatctcggctcactgtaacctccaccttctgggttcaagtgattcccctgcctcagcctcctgagtagctgggactacaggcgcatgccaccacgcccagataattttctgtattttagtagagacagggtttcaccatgttggccaggatggtctcgatctcctgacctcatgatccggccgcctcggcctcccaaagtgctgggattacaggcgtgagccacagcgcccggccaggaagtttttaatattgttattttgttcttgaaatattccttaagcatcaaccttatacattcattcaacaattatgtaccaagtgtcaggcattagaaatactgagatgaataaaacaggtcccgattataagggaaagtaatgtatagaaaattacagtagtgtgagagcagaagtgtgactgagggaaggccagggagctggatctgcaaggagacccctcactccagcttcgagtaggggtaggaaatagaatttataaggcttctagcaggaggtaatgcttgagatgaatctctaaccttaaagcacaataaatttgtcaagcatcattggccaaaggagtgtgtgagggtgcaaacatcctagtgagaaggaacagaagccagaaggagcttctggtatattctgatacattctaagacggaaaaatagctttggaggatggacatagggtgtatggagggttccaaaggagattagattagaaatttaaataaagccagatcatgaaatgccctgcaagtttttgtttgcttgttttttgagacagtctcactctgtcacccaggctggagtgcagtggtatgatttcagctcactgcaacctctgcctcctgggttcaagctattctcctgcctcaacctcccaagtagtggggattataggcacccgccaccacacctggttaatttttgtatttttagtagagatagggtttcaccatgttggccaggatggtctcgaactcctgacctcaggtgatcgatccgcccacctgagcctcccaaagtgttgggattacaggcgtaagccactgtgcctggcatgccctgcatgttttaaggaggcatctgtgctttatcttgaaggttatgagggagtcaacaaaggatttcacaggggaatgacctagatagtatagtaaggcagttaagagtgcagaatctatatatcagtgatgttcaaagtgtagttcaggtaccagcagtctcagtgtcacggggaacttgttaaaaatgcaaattcttgggccccattctagacctactgaatcagaaactagagataggccccagtcagctgtgttttaacaagctctccaggtgactgcaatgcgtgctcaagctggagaactacttccctacacagaccacctaggttggaagcctagctctcccactatataacctggggcaagttctaaactccagtgaagagagggggtaaggggaggggacgggaagtgagggaacagccatgacactaaactaagacccacaggccatataaaaatggttggtcatccagaaggaatctgggtgacagtgacattcatgataatagcttacatttattaagagcttactgcggaccaggtattattctaagaacttcacaaatattaatctacttaatcctcacaacaactttataatcctatttttcagctgaggaaactggggctcagaaaggtaaaaatatggtgtgatgtggagagatgtttacaattaaagtgggaatttttttttttttttgagacagggtctcgctctgtcgcccaggctggaatgcagtggcacgatcacagctcactgcagcctcggccttccaggctccagcgatcctcccacctgtctcccaagtagctgggactacaggtgcactccaccatgcccagctaatttttgtatttttttgtagagatggggtttcgtcatcttgcccaggctggtctcgaattcctgggctcaaatgatccccccaccttggcctcccaaagtgctgggattacaggcatgagccactgcacccagccgagttttgtttttattaaaagaaaaaacccataaatcatgtatatatgcatggaaaaagactgggaggaaatagcccaacatactcattgtggtggtgcaattgcaggcatttttaatttcttttttgtagttatctttgttttccagaatttctctaagaagtttatattgcttttgtaatcagggaaaacacccttttgaaaaagaaaagaaattgaacatgtgcacttgaggaagatgtgagcatcctctcagtgcacaatgcagacccacagaaagaaaaatgcacctggcttgtcgctatttcatgcaagaggattctgagggccttatcatgttggcacgcagtgagggaactggtggaggagtttggaaaaaaaatcagtgcagatagatagttcctaaacacccttcatccagctttctctaatgttaactgagttaaccatagcacagtttccagatcaaaactaggaaattaacaatggcacaataatattgactaaaccatagtttattcacattttcccggtctttccactaatgtattttttctgttccagaagccaatctaggatcccacctggcattgcgttgtcatgtctcattagcctccttcaatttgacagttcttcagtctttgtcttttgtggctttgacactttctaagatcctggtcagctactttgtaaaatgtccctcaatttagatttgttttatgtttttttttttcatgattagattgaggttacacgttttttgagaggaatatcagagaagtgatattatgccattcttagcactccctggtcttttaataactgtgtccccttaaacgctttcatcatgcaattttaaaattataagcataaatggttgcaaagatgtttatttccaatctgttgtaaatatcagcatttgaaatgcaattacttcactcttttaaaggtattcaatggaatctaaatagcaaagtcatttttacccaccattattttattttaaaatacatgaagatcttttttaaacatttaacattttactccttgaatctgtatttctagtccactttcctcagataattttatcttaaggtaatacattcttggctgggagctggggctcatgtctgtaatctcagcactttgaaaggctaaggcaggaggagtgcttgaggccaggagtcaagaccactctgggcaacatagagagagccccgtatctacaaaacaaaaattttacaaaatcggccaggtgtggtggtgcgtgcctactgtcccagatactcagaggctgagttgggaggatcgcttgagcttgagaggttgaggctgcgctgagccatgatcctgccactgcactccagcctgggtggcagagtgagaccttgtctcaaaaaaaaaaaaaaaaagtaatacaattttatacctaaaaggtaaggcttaaaattctcaccctatgtgacttctctgtaacaaaaatatgctttataaattgaaattgatttatacttgatttttaccataaagcactattagaattattatgattattatacacagtgatcaaaacaagtatatttaaagttttttaaaaataattattacttgtgaaaaggaaatttttatttaaatatatctcttaatgaaatgaatgggactttcttttcaggtatctaggataaataatacttattgctagaaagagacagtattcagaatcacgtctttttttttttttgagacaaagtctcattatgttgcccaggctggactcaaactcctggactcaaacagtcctcctgccttagcctcctgagtagcttggactgtatgctctcacctttcagcatcaattctatttctaattttttaatatatttaagggctgaataaacttgtttacataagtaagaagaagaaaatttaaaagttttataatagcactgtcatgtaattccataaacatctgggctataaaccaaaaatcagttatctccctgcaaaaataactttttcgttttttattgagatataattcatataccatagaatgcacacctttaaactatatgattaagtggttttagtatatttagaaagttgtaaaaccatcactactattcaattccagaatattttcatcatccccaaagagaaactcattacatgttagcagtcactccccatttcctcctcgccccaactcctggcaaacattaatctttcggcctctggatttgcccattctggtcatttcatgtaagtggaatcgtgtaatatgtggccttttgtgtctggcttatttcactttgctgaatgttttcaaggtttatccacattgtagcatgaatcagtgcttcattcctttttatacctgaataatattccattgtatggatataccaaattttctttatccatttgtcagctgatggacatctgagttgtttccatcttttggctatctgtgaatagcaatgctatagacattcatttatgccgagtgcaatgacatgtgcctgtagtcccagctactcaggagactgaggcaggagggtcacttgagcccaggagttcaagcccagcctgggtaacacagagagatctcatctctaaaataataaaaagaacacattgatttacaaggttttcggtgggcacatgttttcgtttctcttactgggtcatatgggaatttatgtttataaatttttgaggaaatgccagacattctcaaagtagctgcaccactttacattctcaccagcaatgtatgagcgttccaattcttccacacccttgccaacacttcctgttattatctgcctttttttatttttatttttattttttttgagacggagtcttgctgtgtcacccaggctggagtgcagtggcatgatctcggctcactgcaacctctgcctcccaggttcaagcaattctcctgcctcagcctcccgagtagctgggattacaggcgcatgccaccatgcctggctaatttttgtatttttagtagagacggggtttcatcatcttggccaagctcatcttgaacttctgaccttgtgatccacccgccttggcctcccaaagtgctgggattacaggtgtgatccaccatgcccggcctgtcttttttttaagagacaagttctcactctatttccaaggctggagtgcagtggcagcgatcatagctcactgtagcctcaaaatcctaggctcaagcaatcctcagcctcccgagtagctgggactacaaggtgtgtgccaccatactggctaattttttaatttttttttcagaggtggggtcattctatgttgcccaagctggcctcaaactcctggcctcaagtgatcctcctgctgtagcctcccaaagtgctgggattataggcgtgagccaccatgcccagcctgtctttttgattatagccatcctaatagatgtcttcactaggtatctctttgtggttttgatatgcctttccttaatggctaatgatgttgagcatcttttcgtgtacttattggccatttgtatatcttctttggagaaatgactcttcagattctttgcccatttttaattaggttatttgtctttttatcgtttagttgtgagaattctagatactctagatacaagtccattatcagatatatgacttgcaaatattttctcccattctgcatgttgccttttcactttctgggtggtttaatttgcagtacaaaagtgcttcatgctaggaaggcacagtggcctatgcctgtaatcctaacacttcgagatgctgaggcaggaggatcacttgagcccaggagtttgagaacagcttgggcaacatagtgagagcccatctctacaaaaaataaaaaaaattcagctgggtgtggtggcacactcctgtggtcccagctactaaagtggctgaagtggaaggatggcttgagcccgggaggtcaaggctgcattaagctatgattatgacactgtgctctagaaataaaagtgtttcattttcatatagtccaatttatctctcttttttttcctttgtcacttgcgtgtttgttgtcctatcatcctaagaatttcttacctaatccaaggtcaggaagatttacacttatgttttcttctgagttttagttttagttgttacacttttagctctgggtctgttgcattactgtgtacattttaagatcaacatgtcaatttctgccaaaaaaaaaaaaagccagctgagattttattagagattacactgaatccgtagaacaattgggggagtactgccatcttagcaatattaagtcttctaatccatgaacaagaaatgtcattccatttactaaggccttctttattctctgtcaatggtgttttatagttttcagtgtacaagttttgcacttcatttgttaaatttatttctaattagtttattattttattgcaaatagaattgttttcttaatttgattttcaagttgtccattgttagtgcttagtcatagaattgattgttgtgttttctggcatcctgcaaccttgctgaacttgattattagctctaatagttttttgtggattctttaggattttctaactaaggttgtgccacctgcaaatagagatattttttacttcttcctttccaatctggatgtctttaatttttttctcttgcctatttagcccagctagaacttccagtataatattgaatagaagtggtaagagtggacattcttgtattgtttttgatcttagggggaaatcttacagttttataccattaaatttgatgttagttgtgggtttttcatagatgttctttaccagattaaaagttactttctagttcttgtttattgagtgttttttgtttgtttgtttgtttttcattgaaacggagtcttgctctgtcatgcaggctggagggcagtggcatgatctcagctcactgcaacctccacctcccaggttcaagcaattctcccacctcagcctcccgagtagctgggattacaggctcccatcaccacgcccagctaatttttttatttttagtagagatggggtttcgccatgttggccaggctggtctcaaactcctgacctcaagtgatccacccgcctcggcctcccaaagtgctgggattacaggcctcccaaagtgctgggattacacctcgcctggcctactgagtgcttttatcatgaaggaatattgaattttgtcaaacacttgttctgcatctatggagattaacaggtagtttttgttccattaatgcagcatactacattgactgattttcttatgttgaaccaaccttgcatccctaggaaaaattttatttggtcattgtgcgtaattcattttatttgttgttggattcagtttagtagtattttgttgaggatttttgtgtttgtgtgataaaatacagataacataaaattcgccatttcaacaatttcagagtgtacaactcagtgacatttgttatgttcacagtgttgtgcaatacttaccactatgtagtttcaagacattttcagcatgacaaaaggaaaccccacacacactaagccgtcattctcccctccccctggcaaccactaatctgcttcctgtctctatgtatttgcctattctgaatattttttgcccaggtgtgaggtgaaaagggtttgggtgaaatttcctctatttagaaaattactatcacaaattctttatcagtcagcagccagtcagcagcctgtcccacacaattattcacaggccccttttgaacctcctgcatttggcaagaaagggaggtgagcatggaaaaggaagagggcaatctttcaactgtctcccctccttctgctagagaagggggactatgagaagaggactgcccaggatggctccaggcaaaatataaacatttgtctcctttgccctcaaatctcccctttctgctgctatatccaggccctggtggcctcaagtagccaggccctaggatatctctaagatctcttccctccaggcggggctgcaggccctgagactactttcataattggtttcctgttgggtgtcccttgcctgcaagccttactaactggccagatggcatccacttgcttgagccacgtgttcttgtttgctaaggcctccctaagttatcctgtccaaattccctgaacgtgaggaatgtcaagccccaaagctgtaaaaacggtgactcactgaagtccaagaaggaggtacttctggagagcagggtgatctttacgtacttttcaagtaatgcccatgggcaaatttgttatttagtgaagcaggatcaggcagtgggaaaaaaaaggtgacaccccaccctcacagtatgccttacagcccactccacagctttattaggagctaagtctctggagagattctggggaattttttttctccagggaggctttctggcttacacttctccagaccccaaggacactcccagatgcaaggtgatgtcattggagtgttttcagatagagaatttaagacttgctctgacctcatgtgctttgtgtttccagtttaactcaaactttccaagacttgagttcatttacctttaatcaaaattccctttctgggctccacttctgattacacatgggcctctaagtcttcttggccatcaggtaccagttgatcaaaagtgtcacacatttaggtagggccagtgtggctgacatgccctttgaagttcaaatagggttggaaatgagtgcaatattgctcacatgatgtcaaatctcacatgtttgaaatagagtgtgtgacatttgacaaattcaagcacatggtgaggcagctattctgcttacagagcaaagactccactaaggactaggtgagtgactgctcattggggcctgcctctttgttgacaacagactcagactggggcctttttgacgaaaaatcagaatgctatttccaacccttaggcaagtaatgggctaatgaatggctctagaattttaggagacaggcctcactctgggggacagtccccactgaaggcaaagttctttcctcacccccacatgtgtggctgataaaagctacttgtctggctgggtgcggtgtctcaagcctgtaatcccagcactttgggaggctgaggcaggcggatcgcttgaggtcaggaggttgtaaaccaccctggccaacatggtgaaaacctgtctctactgaaaagacaaaaattagcaggggtaatttttggcacgcacctataattccagctactctggaagcagaggcaggagaatcccttgaacccaggcagacattgcagtgagccgagattgcaccactgccctccagcctgggtgacagagcaagactctgtctcaagaaaaaagctacttgtcatatgtgcgcaatgtacttctccctgaagactatttcaaatggtttcagtttggccatctacccagaacgcacacgtacccagcacgcacatgtacccagcaaatgccttcctatttctaccatctttacccatagaaggccttagagtaagtactctttttcactgagtcaggtttagaccacagaatcctcagatcagcactcccagcagcctgggccagttgcttggagttggtatacaagataatgaaaattgctatcattttactgaggatttattatgggtgaggcactgggtaagtgcattacatgcattatctcttttaattcccacaatagtcttgttatgtactattattctcattttacagacaaggaaccaaggccaagggaaggtaagtaaactttctcaaggtcagattggcagaactgggctggaattcccgtctgtttgactccagagactaacctcttaaccgttacgctatgccagttcattcattcactcaacaagtatttaatcggcacaaattctgtgttagcatggttctaggccctggggatacagcagtcagaagatcttcgcccagtggaacatgacactgtgtgggcctctggaagaaggccctctgggaatcagtgacttgacactggataatacatccatttgctagcaggatgagggatctcaaaaatgtgggagctccacgcctaaacacagggagtatatggaaaactcaagccacaaggcaaaagggcaatggcaaagtttcagctcaaccctgacagggctctgtatgcttagcataggctatagcccatgctccagtgcttgagaaggataacatgccctactgatctctgtaacccttgaaggtcaaccaccccaggccctcctaccataagccaacattaagtttttcaagcatcccaggtctgcctgtcttttttgccattagcagctgaatgtgtgaagctcgtggctccccgcaaggaaccctaggggtgggtcacaggtggggctgagctcactcttcctatagatacatttcccccttgtaaagagcaaaggagacagatcaaaggccacctgggcccacttgcttgctagagagacccgggggagctggaaaggaaaggggaggaggggactggggtaggctggagctgtgctgtgattgattggcttgttttgctcctgcacttctgtttacccagctgggcctgctgctgcccagaggaccagcatgtgcatggccactctggccggcctttggggcagtgtcagagtgagctgtgcactcagccatctcctggcaaaactgaggcagggaagtttgtgttttatgtctgcaactttcctgccccactgggccttctcccacctccagggacacccctccgtaacacacacaccccagtctcagccacaaagttcttcaggtcttcttcctcttagtggaacctagtgtcactcaggtatctaagacactaacaggtaaacatctgccaacagcctctagcttaattcttctagcatttcaaaatgccgggcttctctgtaattaattagtccattcaaggcagacaagagcagagggccccaggagagggaaacaaatagcttatgaaagagctacagatccaaggacacaaatgaagtccctggtcttctaggtcagtctttctgttaattgacaaacaaggttaaaacaaatcccagcatctcagtaatgctctctgctcggtttgaatagcagtagcccaaggtagaacggtttcagaactcagtgtgttaggggggtggggggccgtgggcaggatttgaagatttgaaggacccttccaagtgcacgtggccactggtttgtcagtgtttaacgccagctctacttttcttaaaaaccaacccaaccccaaatcagaagcaagtagagactggtggcaaagggcccctgggctttgggtaggcactagagtggtggtttagagtgggctttggagtcagacaagcctgagtgggagtttcaaatctcagctctgctacttataactgtttgactttgggcaagttgcttagcttttctgagtctcagtataaccttctgtcaaatgaggataacacctacctcactgcattgttgtgaggattaaatgccataaagtgtgccaagtgcttagcaactgatctgtgttatcaatatatacagaggggtgtgatgatcaaagacgaggattgtggagagagggggatgggatacctcattctcttcctgaaatgttcagcactttgggtgtgcattcctaatgtttacacagttcaaaggcgagttcaaaatgtggaaacaacccaaatgtctatcaacggatgattggataaacaaaacatggtacacacatgcaatggaatactattcagcctttaaaaggaaggaaattctgatgcatactacaatacagatgaactttgaggacattatgctaagtgaaataagccagtcactcaaagacaaacactgcaagattccacttacatgaagtttctaggatggttaaattcatagaaacagacagtagaatgggggttgccaggggctgggaaagaggggaatggggagctaatgtttgatgggtacagagtttctatccgagaagatgaaaaaattctggagatggagggtggcgctggtggcacaacattgtgaatgtactgaatgccactgaatcgtacgcttaaaatggttaaaatggtaaacgttaaattttatgttgcgtgtgtttactgcaattttggatggattgggggtatatgtgtgagaaaagccatgaaaggttagtgccctggtgaaagccagggattctattttctactccgctatgagaaggcagccagtttccatacaggggaaggggagagagagagggagagggatggggggatagagagagagagaagcaggagaggagggaaaggagaatggcctgggctgtcagtgtaaaacaaaaaatacaaaagttggaggtttttcagctctgaaaatgcaacaagcaaggagagtaggctccatccctaggtgagccccaaagcccacttgggccacagctatagcctggctgggagaccacaaaagggaaggaggaggtaatttggactggcctgaggtaaaaattgcagagatttgcaagtgcaatcagctcttcaactccccaccacttccaaggcagagtgggtgggaccagactcttctcttcctccaatcccactccttccaggctacaaggggcccctcaaggctgcccttctcattcggttccagctgcctgatttccctggagaggaggttgtggaggtggggctgccagtccctacatccctagcagacccacctcttcacgggaccatccggaccctgtacacgtggaccctggccgtgtagacacacctgagtccaggaacgacacaagccgcagggatcccagcctaggcacggaggtaattaggcccgtcttctctgctcctgaagtaatgtttatttgtctttcaaattctgccaaccaaaatggcttaggctgtgatttaccgtcacaccattatgtcatacttccttactgcttttatgaccaagaaagactccaggcacagtagccatattatgtcccagcgaactcctgcccaaattaagtcactgtttctggtccctatcgctggtcaaatatgacttctaagggtaattgctgttttaggggcacattttaaagcaaatgcaaaaaataatgaatgtacctattttgtgactgaaatttgcatctgtctttttaccctctcccggcaaatatgttttatgtttatttaaacagtctttaataaaaatctacagctgcaaagcatcttactactcaatgctttctggttaagaaaattgcccataatcacagtggactttactattcataacagaatattatttttcatcggtgcatggctgcatcccaatgtatgagtgttgcaaatgcaatgtgaggcttatctgaggtcggaagctcttcattcattcatttattcaatccatcaacaaacttttttgcggacttaccatatggggtttgggacctttggggaacagggggcaagcatgggcagaggcatgagagagcaggtcactgataggacaaaggtagccattgtcaaccacagttgatgtattgtgattggttggaaagtgtgacacaagtaatttgttactgataataattaatgtaccagagttgctgaataatttactttagttgtaagttagagtggattcaaggttatctttacaataatagcatcactctcacctgcttgcatttcagtttgttttgatgagagttagagaaaagggtccaattaatagctgcggattccccaaggacactcatgggagtgtgtcatgcatgtgcacatcatctgtcagttatatcatagttgaggattatcagagtggcctacaaggcgtgtgttatgtgggagagtggagagagatgaaccgggagaggcaggatgggtagatacggcttttcagagcttgcataaacacagtttcaggtggattggcccccaaattttgcagatctaattgtcagtaatgtagagctactgcttgtttatcaggttccagtatttccccaagtacagagatgtgatcttaggtaaagtagtgactgtcaactcatacttgtgaatttgacctgtcttggagaacctgtaattatacttctcagaatcaagtacttctagcactggctgtgttgcatgttgagcttcttagaaatgagaatgtgacccaagaggtagcttccaggttaggtttcgtggggtgattgtgccgggaccacatttatctgtcttgaaaaacagatagaaattctcggtcatgagtcaaactagaaaaaggaacttactaataatggatttgatatgctatttctactgggaagtcagatggggtatggggagctgttggggtacagagaaggagtgtctacttttccttacctttccaatataaaatggatttctagaatattggaaatgacacctttcatgaaaatagaataaatgatgagcttggtgttctgatttgaagggtactagaactgtttccctgctcctaaaaatactctcccactgctgcttgattttctaatattagaaattgtggtagaatctctttttatatgtttacaaattatgctttgctctgttcaactagttttcattttctttttcaaatgtatgctggaggaaaagaggatagttcttctaaaaataagaagcacattcaagaatgagctggaagcctgctggaattgttaaggaaaccaattgtgtgtagatgcgacctcagtaattaatcagtgaacatctagcagccaaatatctgatgggagggaggaggccctctccttagagagagggaaaatgactactcccttctgattgaaaaagcaccatcccagaccttcttgctgctgacatgcagatgtacatctggctgtaatctctcactccctgctagcctttgccaaactgtgtggaacagaaatccagtttctcctccatgtaaagcgacagagagaaattgaatagttagatagttaaaattctgagcactggctaggaaaaggaacatgcccaaagcaataaaaagactctcacttaaaaaactgtggctgaagaaagatttgagcagtttaaacaactagtggagttgattggggtgaagggagtagaagtctcaaagccacagacaagccttgatactctgcagacaagctaagaaatatttaaattgtgtgaaatctactcaaggctgatgaataagatagaataagagcttgataacatttgaaagaatttatttgcacttaagtgtctgtgtttctataaatcttgctctaaattttattttatgtggtgttgttttaaaaacagagttatttataaagaatgaaagcataattgagtggggaagtgtgctctgttccctttctccgagctgtccaacctaagggaagactatcattctgtcaaagtggtggtaacttaatcaaattgcaggactagtacataggaggaaaatgatgccctttgaagctttgccttggaaacccacacttcataagtgacaacaaatacaacagtgcctcaacttttggattaaatattgcagccttctttaaaaataaaaaatgcctctggataggttaacatatagagttattagtatcttagtacagtggtttcccaaactgggtatttaacacacgtttcatttatattgagaacttttaaaattcagaaaagtgcagagaagagtatagcaaacacttgtgttctcaccatgcagaggagaaatacactactgtatttactgtgtcttccattctttttaaattaaaaaaaaagtgctacatgaaaagttgaggccccctttatctcctgcctccagtcaactcatttttattaatttggtatgttttcttccaaactatgatatacttttgtatttttttaaacttagcattatgttcttgagatcagtccatgtgggtgcctattggtctagttcattcttactgctgaacagtaacctatagtaccaccacagcacatttaatttattcattcctcctttggtggatatttatttccaaatttttagtattagaaacaaacaacttgcaataaacactgagatatctgtgtctttgcacactggattggaatttctctagagtatgtaccttctagaaagtaagatttctgggttaaagagtacatacacttttagtttttctgggcactggcaggttgctctccaatgtggctctaccgagtaacagtcccataagtcgtttatgagctcccatgacaccataccattgataacttttgagttttaatttttgcctgtctgatgagtaaagacagtatcttgttttgttgttgtttttatttccttgagtactagtgaggttaagtatctttgcatatatttctagaccattccagtgtcttctgccagttgtctgttggtattctttgctcctttttccattgtgttgattgccttttaaaattgacttatagcatttattttatgtcttttttgactctgtttctttttcaattacatgtgtggcaagtgtcttctcccactatatggcttatctttaactttatactgtcattttttcttatagacattataatgtttaatgtggtcacatttaccagtcttttctactaaaatttgtaagttttgtgtgtgtgattaatgaattcttctattctgaggtcataaaggtattctatatttgcatcaaagtgttgtaaaattttgcttttaacagttagatctttaattcattttgaattgatttttatgtagggtttgaataagttatctaattgtatcttttatcatatgaataattttaatgccatttattaaataatctatatcttatcctccacgatttataatcaatctctgtcctttacctagttctcatagacttacctgagttgtttgtaggccctttttatattccactggtctatttgtttatccatctgccaatactatatagttttattttttattttttgagatagagtctcgctctgtctcccaggctggagtgcagtggcgcgatcccgggttcaagcgattctcctgcctcaggctcccaagtagctgggactacaggtgcacgccaccacacccacctaattttaatatttttagtagaaaccaggtttcaccattttggccaggctggtctcaaactcttgacctcaagtgatccgcccgccttggcctcccacagttctcagattataggcgtgagccactgtgcctggcctacgttgttttaatgccatgacattataataagccttaacaatgtgcccttcactactcttcttcacaattgtcttgtatattcttgatgccttactattctgttacaatcttattctctgtgtaaatcttctgtgtaaattaccttgtcaaaaatccagaaaaatcctgttgtgattttggttgaacttgcatagaatttacagaccaatttaaagaaaattgccatatttgtgttgagccttcccatacatgaacatggcatatatctcctttttgaggttactttattctaaactttttatttcaatataattatagattcacgggaagatgcaaatatggtacagagaggccccctgtaccattcactgactttctcccatgattatattttacataactagagtacagtatcaaaactaagaattcgacattgatacaatatgtgtgtatataattctatgccatttttatcacaggtgtagatttgtgtaagatacagaaggccagacgcagtggctcacacctgtaatcccagcactttgggaggccgacgtgggcggatcacctgagtttgggaggtcgagaccagcctgaccaacatggggaaaccctttctttactaaaaatacaaaattagtcaggcgtggtggcacatgcctgtaatcccagctacttgggaggctgaggcaggagaattgcttgaacctgggaggtggggttgtggtgagccgagattgtgccatattgcactccagcctgggcaacaagagcaaaactctgtctcaaaaaaaaaaaaaaaaaaaagatacagaatgattccatcaccacaaagatgtccctcatgctacctttatggttacacccaccccaccctatctctaacccccagaaatcactaatctagtcttcatctttacaattttgtcatttcaagaatgttatataagtgaaataatacagtatgtgactttttgagattacctttcttcattccctggagattcatgcaagttgctgtgtgtgtcaatagttactcctttctattgccgagtctgctagtgacgaattctgttagttttccttcatctgaggatgtcttgatttccccttcattttgaagaatatttttgctgggtgtagaattctgtgctggcagttctcttctttcctggtatggatgtaccatagttggtcgaacccgttcacttgttgagggacgttttggttgtttctggtttgagtgttttctgtttgttacctctgttttttatttctctgttttcattttcttgccttcctgtgtgttacttgaatattttttagaattctattttggttcacctacaggatttttagagttatgtctttgtgtagctttttttgtggttgctctaggtctaacgtgacatacacataacttattacaatctactggtgtcatcattttaccagttaaagtatagcaactttattcctttactttctccagtttataattatcttaagtattttgtttacatacattgagaaaactatcaaacaatgttttactttttgctttaaccatcaaacataattttaaaaaaaaatcaatagaagaggacagcctattgtatttatccatattttttgttctttctttgttctttctcattcctgatgctcaaagattccttctatcacttgtttctgtttggagaacttccttcagccattctttaaatgttagtttgctatcataaggacagaaaaccaaacaccccatgttctcactcataggtgggtattgaacaatgagaacacttcgacacagggcggggaacatcacaccccgtgagccactgtgcctggcctattctcttggcctgtcagaggatggagggctgggggagcaatagcattaggagaaatacctaatgtaaatgacaggttgatgggtgcagcaaaccaacatggcacatgtatacctatgtaacaaatctgcacgttgtgcacgtgtaccctagaacttaaagtataattttaaaaaatgttagtttgcaagtgataaattctgttagtgttcctgcatctaaggatgtcttgattttcccttcattaagaaggatatttttgttggttgtagaattctgtgctggcagttcttttctttcagtacttaaaaaataccatgtcatttccttgtaacctccacagattttgatgagaaatctacagtcactgggttttggcctggatttctttgggtttaatgtatttgggatttactcagctttttgaacctgtaggtttgtcttttgccaaatttgagtaaatttcagccactgtttgtttgaatacatcttcagcctcaccttttattccctctccttctgtgactttgatgacataaatgctttgttatagtgccacggatccctgaggctctgttcatacatatttttcagtctactttctctttgttgtttgtccttggtaatttctatttttgtatcttcgagcttactgcttcttttctctatctcctccattttgctattgggcccatccattgaagttttaaaattttggttgttttctcattctaaaatttccatttggttcttctttatatctcctattttctttgttgagattttttgccctttgtttcaagtgcatttataattacttgttcaaaggttcttatgatggctgctttaaaatcgttgacaggtaattgtaatatctgtgtcatttcagtcttggcatctgttgaatgtcttttctcattcaaattgagattttcctggtttttggtattataagtgattttttattcaactttgacattttgggtactacattatgagactggttcttattgaaatcttctgttttagcaggcctcctctgacgctgctccagtggtggaagaggaggcaccacctcattactgccagctggagatggacgtacagctccctatgtggtcgctactgtcactgtggagaaaggagatttattacagtcacagcttcccacttggccctctccaacaccacactggctaggtgattgggatacttccttacagcctagggaggggaaaagtcagcctccccactcagcctttgctggcatgaataggagtgtttttttctgtagatatttgccgggagtagagagcagttattgttaaaggtgttctgttctacacggttgttctttttctgatacactggctagcgaaagcaggcttatgttggggattttttttgtctgtgcttgttggtattactgggttgctagcttctctagtacccagtctgggatatatgaggcaaaaaggggacagaagaaactcaccaatacgttgcctcagttcccaaggtccctagccagtctgcccttttttctctacctgtcagagtcatcttatatctgccttatacataatgttcagggtttttagccgtacttggcagaaagagtagggaaaattacttttatttcatcttgtcttgaaactgaagtataagatcatcttttatgacgttcaaaaattttaataattttctccataaaggtcttatacaactgttgtgtgtgtatatatactatgttgttaacagtgttaattcagtgaatggaaatggttaccactctgtaatgcatgtaataaagcacttacatatacttgtttaaaagctgtttcttggaatgctactcacacactgctcacgctcctagctctttgctaataatatgtattttggataatatcactcctctttaagaattacatattctaatttattgtttctggtatatttaaatgatactgatttttttcatattaatatatccagcacttttgttgaatgctcttattagttctaacagtttctagatactcttgcttttttttttttttttttttgagacggagtctcactctgtcaccaggctggaatccagtgatgtgatcttggctcactgcaacctccgcctcctgtgttcaagcaattctctgcctcagcctcccgagtagctgggattataggtgcctgccaccacacccgactaactttttgtatttttagtagagacaggtttcaccatcttggccaggctggtcttgaactcctgacctcatgatccacctgcctcggcctcccaaagtgctgggattacaggcgtgagccaccgtgcctggccgattctcttgcattttctgtataggcaatcatatcatctgcaattatgattttttcctttttctaatatatatatattatatatttatatattttatatattagtgtgtgtgtgtgtatatatatatatatatatataatttttttgagttggagtctcgctttgttgcccaggctggagtgcagtggcatgatctcagctcactgcaacctctgcctcctgggttcaagcaattctcctgcctcagcctcctgagtagctgggattacagacacacgccaccacgtctggctaatttttgtatttttttggtagagatggggtttcaccatgttggtcaggctggtctctaactcctgacctcgtgatctgcccaccttggcctcccaaagtgctgggattacaggtgtgagccactgcgcccagccatatatatatattttaatatgtttaatactttatattatatttcatataatatataaatattatataatatataaatatatattaaagtagaatactttaatatgtttgtaattattgtgatttctgttatgcttagatttattttttcattttgttttatatttctattactatgttttatttttttttgttgttgttattttgtttttttttttttgagatggagtctcactgtgttgcccaggctggagtgcaatgttgcaatctcagctcactgtaacctctgcctcccgggttcaagtgattctccttcctcagcctcctgtgtagctgggattacaggcatgcaacaccacgcccagctaatttttgtatttttatagagacagggtttcaccattttggccagtctggtctcgaattcctgacctcaagtgatccgccgacctcagcctcctgaagtgctgggattacaggtgtaagccaccacgcccagcctatatttctattactatgttttacattgcttcttttttatttttttctgccttgattgagttgattaatgtttttatttcccctgccttcttctgaaattttggaagttgtatttctgttaatttagtggtcacctttaaaattttacatacacccacggactgcacacacacaaaaattcaagttaatgtgtatattaacttgaatttttgtgcagtccgtgggtgtatgtaaaaattttaaaggtattaaccagagagagaaaacagattgcatagagatatatctccatttagagatagagatagagatatatttcgatttatcctttgagtaataaaataagctaaatatgttttaactctaatcttctactctctatcttaagtgggactgttgggccacattttggtggcattttcctcttcaataccccccggaattggtcattgtaaccttattattattgggattctttttttaagaaaaaacagctttattgagatatcaattatcaccattttagaacatcatcatctcaaaagaaaccctattttttacagttgaggtttatttaaatttatctatatgtttaccaagttttttgctccattgtttcttgaactccagtcctttattgtaggttcagttttcttcttgatgtacatcatttaatatttttttagtgaaggcttatcactgacaaactctcatagtctttgtttaaaagatctcattttaatgaccctcagttgtgaatgataacttctgtatgtaaaattttaagttaatgggtattttccctcaactttgtaaatattattccattgttttttgagttctattgttgctgatgggaagtgtattatttattatctattgtcagtctattttttaatgttagtttttgaatgccatctgtcttttctctctggttaaaaattttctatttgttttcactatgatttgtctaggtttgtatttatttttattcatcttaagatctgggcttcttcaatctgagttcctattgttttacattagactacattcataatacattgctttcaatttacagtttctgtttttaaatagtggatcaagatctaaagacactaaccatagcagccttcccatcgttgttattccctcagtcttttatggccatcttgcctatacacaatttaacaccttttttggttgtgttcttttctattatgcctctctaaagtattcaactttcttagaaataactcttcattttcatacccatatatcatctgtttacagaatatttatttaaattacatagcaaagctatcataaacaagattaggaacaaataaaattggctcttagtaaatatccaacttaactggtgtgagcaaaagtgcatgggatgtactagagaatggcctactagcttcgagcattcacaatgttttctaaataatttcaactcttgttttagattcagggggtacatatgcaggtctgttgcatgggtatattgcatgatgctgaggtttgggatacaaatgatcccatcacccaggtagtaagcatagtacccaacaatttttcaacccttgcccccctctctcactccccactctagtagtctgcagtgtccattgttgccatctttatgtccatatgtactcaatgttttagctcctacttataagtgagaacatgcggtttttggttttctgtccctgcattcattcacttaggataatggcctcgagctgcatccatgttgctgcaaaggacttgatttctttactttcttatggctgcatagtattccatggtgtatatgcaccacattttctttatccagtccaccactgatgggcacctaggttgattgcatgtatttgctattgtgaatagtgctgcaatgaacatgcaagtgtgtgtgtcattttggtagaacatttagttttcttttggatatgtactcattaatgggattgctggacaaataaatggtagttctgttttaagttctctgagaaatctccaaactgctttccacagtggctgaactaatttgcattcccaccaacagtgtataaatgttcccttttctccacagtctcaccagcatctgttactttttcactttttaattaatagccattctgactggtgtgagatggtatttcattgtgttcgtttgtttttgagatagagtctcactccatcacccaggctggagtgcagtggcacaatcttggctcaatgcaacctctgcctcccgggctcaagcaattctcgtgacttagcccccgcaagtagctggaattacaggtgtgtactaccacgcccagctaatttttgtattttcagtagagactgtgtttcaccatgttggccaggctggtctcgaactcctgacctcaagagatctgcctttcttgggctcccaaagttctgggattacaggcgtgagccactgcgcctggtctcattgtggttttgatttgcatctctccagtgattactgacgtggagtattttttcgaatatttgttggctgcttgtatgtcttcttttgagatgtgcctgctcatgtttttgcccactttttaatggcgttatttgttttttgcttgttgaattgtttaaattccttacagattttgggtattagacctttgttggatgcatagtgtgtgaatattttctcccattctatatgttgtctgtttactttgttgataatttcttttgctgtgtagaagctcttttgtttaattgggtcccacttgtcaatttctgtttttgttgcaattgcttttgaggacttagtcataaattctttcccaaggcagatgtccagaatgatgtttcctagattttcttctagaatttttatagtatgtggtcttgcatttaaatttttgatccatcttgagttaatttttgtatatggtaaaaggtaggggtccagtttcattcttctgcatatggttagacagttatcccagcaccatttattgaatagggattcctttccccattgcttatttttgttaactttgtcaaagattagatggctgtacctgtgcaactttatttctaggttctctattctgttccattgatctatgtgtctgtttttgtaccagtaccacactgttttgattactgtagccttatagtatagtttgaagtcgtgtaatgtgatgcctctggctttatcctttttgtgtaggattgctttggctattcgggctcttttttggttccatgtgaactttagaatttttttctaattatgtgaaatatgacattgttaatttcacaggaatagtgctcaatctgtagattcctttgggcaatatggaaattttaaagatattgattcttccaatcctgagtattatatgtttttctattagtttgagtcatctataatttcttttagcagtgttttgtagttctcattgtagagatctttcatgtctttggttagatgtattcctaggtattttattttttgtggctattgtaaatgaaattgcattattgaattggctcttagcttggacattattggtgtatagaaatgctactgatttttgtacactgattttggatcctgaaactttactgaagtcttttatcagtttcaggagacttttagtagagtctttagggttttctaggtatagactcatattgtcagtgaagagagatagtttgacttcttttcctatttggatgccatttatttctttctcttgcctgattgctctggccaagacttcctcaagcattcatagtgtcatacaatgtattttacaggaggaatggaaagagttgattaatcaggagagtaatgagtaaagaagttagataaaagaacttctactgtattgagcatcttctatgggccaattactgaaatggtatatttaagttataatagtaaataagatagacaaatcttttgctctcatggagttaggggagaagaaacaagtaaatatataaataaaccagatagttaatttcagataatcataagtatgatgaaggcaatcagacagagctataaaatagagggtaactgaggggtggaggctagtctatatgaggtaatcactaaagacctttctgagcagtgatatatgaggtacaatctgaaaaattaggaggcaggaacctggaaattcagaaggagagtgttctgggcagaggaaacatttctggtctgaggcaggaatgagcttactgtgctgaagaaatagaaaggactctgtgactggtgtttcattagcagaagagagtgtacatgagatggggtagattagttacaccagggctagaagaaacagggggtttgtagacttgtaatgattttttatttgatcttgagtgtgatttgaaatcaagggatttcaggatggggataacaagaactgatttatactttttaaaagataacgttggctaatgtgtagggtcaggactctagaagggcaacaggtgaagccaaaagaccagttaagaagctgtcttagtcagtttgcactgctataacaatgtactgcagactgggtaattaaccaacaacagaaattttaaaaaataaattttattgtgtacatctgaggtttacagcatgatgtatgggacacatatagatagtaaaatggttattgtgatgaagcagattaacatatccatcatctcacgtagttactttttaacaataggcatttattctcacagttctggagactgggaagtccaagatcaaggcactggcaggcttggtgtctgtgaaggccttttttccacttccaagatggtgccttattgctgcatcctctggaggggaggaatgctgtgtcctcattaggcagaagggcagaggaggcaataagggacaaactccctctatcgagcccttttttgaaagtatttaatcccattcatgaaggaagactcctcatgactcaatcacctcctaaaggccacacctcttaatactgttggattggggattaagttcctgcacgaattttggaggggacaaaaaccattcaaaccatatcagaggccaatgttgtagcctggatgagagattgaagtggcttggattaagatgacagtaagtgaatatcatagtaaatgtagacaaaaaggtagagatttgaagtatattttggaggtagacttgaaaagacttgatagattcaatatatggaggctgagggtaaggaaaagaggagaaaccgggttggtgccttattttgggcctaagtgggtggatggtgatgccattttctgaattatggaagaccagcatgggaatatattttaggggcagaattaagggttctcttctggtcacattatatttgaaattctgtagcagctatccaagcagatattttaagaagacagttggatatgtgagtccagagctcaaggggagatgtcaagattgtaaatatcaatttagtagtcatcagcatatagataatgactcaagtcatagaattgtatgagatcatctagggtgtaatgacactagaaaagaaggctaaggacttagccttggaatactttaacatggagagatcaagcacagaaggggaagatagcaaaagagactgagaagaaacagcaagcaagataggatagaaccagcaatttatcctaataagatgactggacaagcatgtaaagatataaatgcagaagtgtattcatcacagtatttttttcttttttgagacggagtttttgctcttgttgcccacgctggagtgcagtggcactatctcggctcactgcaacctccccctccaaggttcaagagattctcctgcctcagcctcctgagtagctaggattacaggtgtgcgccaccacacccggctaatttttggtatttttagtagagacaaggtttcatcattttggctaagctggtctcaaactcctgacctcaggtgatccacccacctcagcctcccaaaatgcagggattacaggtgtgagccactgcacctggcccacagtatttttataatagtaaaaattggaaataaatgtctatagagagatagttaaatcatggcatgcatatatatatatttataacagaatatgctaggcaaacattaaaacgatgataccaatcaatatttattgacatataaataagtccataatacattcttacatgcaagagcagattacaaagtagcctatatagtatgaagacatcagtgtaaaattatatgtgtgtatgtgtcagagcatgtatgtaaatagggtcatgatggtagtttttgtttttttgttttttctttttttagatagagtctcactctgtcgcccaggctggagtgcagtggtgcaatctctgctcactgcaacctctgctgccccggttcaagcaattctcctgtctcagcctcccaagtaactgggactacaggcacgcgccactatgcccagctaatttttgtatttttagtagagatggggtttcaccatgttggccaggctggtctcgaactcctgacctcaagtcatcctccctccttggcctcctaaactgctgggattataggtgtgagccactgtgcccagctagtgttttgtttttccactttgtttatagatgtatcccttgagcctaaaacagtgttaagtatccagtagacacagatgaatatttgttgaaggaatgaataaatgaatgaatgaacgaatgaatgaatataaaactttaaccaaaatattaagagtggttatctctaggtcctgtgataaaaggtcttctattttcctttcttttgtattgtgttagattttttttttacaatgaccatacattctttttatcaggaagaacattcttttaatttttgaaaccatcctcacctttatcagttacctatgacttccaagtacccctatttggctgaattcagagcaaagcaattgctttgctactgaaaatccatatttaggcaggtatatcagaatgataacagggagatatgttgtctcttggagagctggaggcagaaaaggtgaactaggagtgaaggtcaacagcaactgtgagaaagaaagacttgtgccttggaagaaagttgagctgagattttctttctttctttctttcctttttttttttttgagatggagtctcgctctgttgcccaggctggagtgcagtggcgcgatctcggctccctgcaagctccgcctcccgggttcacgccattcttcctgtgtcagcctcccgagtggttgggactacaggcgcccgccaccccgcccggctaattttttttttctatttttagtagagatgggttttcacagagttagccaggatggtctcgatctcctgacctcgtgatcctcccgcctcggcctcccaaagtgctgggattacaggcgtgagccaccgcgcccggccaaacagacattttcaaagcagaacaacatagaacaagaagctgagggccgcttgcaagcctgaccttggggagaagagcctgtggaacacttagagcacagtaaattttgcaatctaaattcttgattctcagttgtgtattgatacaggagttaataaaggagccaagctacgactcccagattgtgctgtttggtatagaaatgcctaattccctttggtggttgcagtggaaaatgaaggcagtcttctgtatgaagaagtccctggttttctatttttctctgaggctgtaagaaaaacaagttggattatgttttttgaataattgattggatattctttgggattccacgtatgtgtttgcctaatctctctctatcctcccctccactccccctcattacccacccactccccatcaacagaaaagacttagatttctccagtatgggaggttagtctcctgctagcatttctcctgtactgtaccatgcaaaatgagtgctcatttccttcctggccttgagttacaaaagtccctctgctattgcccaagtcttggaaagtgcaggctccaggaaaagggtggtggtagatagagttgccagataaaatacaggaaagccagttaaatctgaattttggataaccaatggattttttttgtataagtatatcccaaatattgcatgggacatacttataccaaaaaaagtcattgtttatctgaaattaaaatttaactggatgtcttttttttttctaaatctggcaatcctagatggagaaaaaaaatccctcttgtgatacaagggttttctcagtgcttttcatctaaaacttaccagatgtttcttagatggcctttcagtttacaaaaggggaaaataactaactgattaagtcaaggttagactgcgaatcagtgctagggctgaaaatttaagttttcaagttttccagcacatgatctaattcagcaaacttttatcaataatttattggctgtaaggaaacaggattagaatgatcacaaaggtacatattcccatgaaaagtaaatttttaaaagattctaaaggtgacaagcattaaggttttactttcctccatggtcatgactgggcttagcctctaaagaagtgtttttcacagtgtagtctttattctacctgcatcagtatcatctggaaagcagtctgtagatacagacagaaagtgaaggtaatgggtcctttgaaagtttgagttcctggtctttgtcttgtaggcaccacaatcacttcctccatttccacagcctttagttccactaacagcttgtatctggagggtctcaatgctagagagctttctggttattttagtttttgtttctgccattacatattataaaaggtaatttattaaaaggcaaaattgaagagggatttgatatcccccccagcacagccaaataaaggcatccaaaataagcattagatgtaaaagaaaaaatgattgacctggcctctattaaatcaccaaatttaactggatcttggaatctgaagaattctctatcacctatatctcttgcattggggccttgccattccacaaaatttattctctacttttcctgggcctgactccaagagaactaatcatatcttaataatttggtacagagtcacagtgtaattgctccaggtcagtattgtatcctatcagactggagtacagaaatgattatcaaacattaaaaagaatgaggtcaagaggtacaacctgactttcaaaacatccttaggatgtatgtatagccagaatgacttttttagttgaggaattatgatgatctctaataggacaaagcaaatgtattcagtcagtctgtcatttcagatttatagcaaacaatctcacatttggtcaattcctcaatcgtatgctaataaaaatgatataaatagtttggtaactcaccctgtggtactaaaatgcaagtaacccaagatgggttggctatgttgttctcatctccctttatcaccagagacttgattcttcttagctggcattatatgctgccagttgatacttgcctaaatatttccttcgtactcagaacattatagttactttttcaagcttcaaatatttccgactaattctagaaatacgtgaggtatgcctgaaacgctgacagctgtagcttacacccaaaatagtcaggcctgctcaaggagatgcattgagcaaacagaaccaggagtttgaaggtgacagctgaacaggcatcaataggaaattgccaggtgctcagctgatccagctagggatgggaacagacagattccatttctagaaatagcacagaggatgccaacaggtcataggatataagctattgcacaaatcttcccttccatcttctagggagcttggagggtatcttaggaaccttaaacttgctgaaaaaaattaacatgtctaatgaataatttttgatattgacttgttgagcccctattagtttcaagttactttcctaggcactgttaggggcagggatacaaagaagtttagacacaggctctactcacacagagttttcacaccagttgaggaaacaagacccatatggcaaagtcctgtcttataaggggttagattcttgatgagaaaaaaaaatcatttatagacaaaacgcacctcgaaaattcctttgagaggttcaatattagagacagacataccatttttcaataagtcaaacacagttgttttttttcccctacaaccttgtaccagatcactttttctttaattgagaaccaagccaattggcttgcacttagaggctgtgttgaattttttaaagcgcacatatttaagcatgagaatctcaccatgagaaacccacaggaactgacaccatctgaaggaacatcagattcacgtctctcaactcaatttaactccagggcaaaacttgttgagtagaataatagttaggattgcccacataattttcaattgcttacatgatcttgctctctgtctctctctctctctctctcaatttcttctgtatatcagccaactcatataagaatggtgtacttgtgatgtgcctctccatacccacgtaacaagacaggagaagctatgcgaaggcgagcttcaccacttactgactgtatgacgttggcccagtgaaccctctgagccttcatttcctcactaataaaataaggataataattgcatcttccttgcaggattgttctgtggattaaatgcagtgatatttgcaaaatgcttagtctaatgcctggtagcataaaagcctcaatattaactattacagcaagtggtttatatgtgatgtgtcaaatgaaagagacatgccttatgtgttataacgtacataactgagtagtgtattggcagggaggggttcatgggtgagatcacttttgaacttggtgagatatgggtaatactggagagctggaggcaggaagggagtgatggtggaagcagggagaaagccaagacatggatgagtcaggatgtctagagacctgaaatacatgggggtgggcagtaaagcctgtggaagggaataataaaatatgctgttggaggaggaagccagggccatgtgattgaaggccttgaatgccaggatgtggtgctggaagcagtgaagaattgtttgagattttttactcaagggtgatgggatgataaaacagttagtatactttcaaattcagctcatctgtcaaatccagcttacagccacttccccctactgcatctcactcttccttttccaaacattgttgacaccgattgctccccttccccctaataattttgcccttaatctaccaccttatctcaaggctaaatgttttctctgagttgtgcgtgtggggggagagagagagaaatatttttctccaaagatagggtcctgcctttcacttcctctgtctgccacacagagtttagcacattgtggactctgaaggaataatttatgagttaactcaatgattgattatgggcatgcctaattggagcaccaaaagcaacgtgtcccttagacaggatgagtactggctctgtgaggaatgtagtaaaacgaaaggtggacagggttataggtcataggctcattcctgaagccccagaatcaagttttttgaacattttcctaaatgtctttgcctaaagacatttgttaaccaggaatctgccaagccaaacaaaggctggctggctggctggctgggctaactagtgtccttaccaggaaatgcaggaaatggaggactgtccagaaggagatgccccaaatgcagccctgtggggaagaccagcttcctcagagcccagagaaggaagagaaacagcctctatctttaatcacagctattcaagaaacaggctctgctgagagcagcagtctctaggggggaaaaggacagtctttgcaaaggaaactttttttctaacctgaggtcaagaccaagtagttaaactttgaagggactgggaaggatagcctgggtatgtaatgaatggaaagagcctattacaccctggttcagaagaaccacaactccatgcctgtcaccatccgtcttcccaaatgctcatcaaatgaaataacccatctgtgacaaatcttcatttgtccaatgtggaagtgcaaagcttttctaatatacatctgcatgttatcctggtttgcaaaagcctccaagcacatcaacaaaagaagctgcttgaaatggattctggttaggacttgtcccttgctcatgttcaaagtgatgtcgttgctgacaattcagaactctcccacttgccaccttctccaggctcccaggctgttttctgaattcccagaagaaactgtttccatggctcaaaatgaccccttcttaggcctctaccaatcagagtctcatccctcagtgccccccatctcatctagctgctagagagaacgcattcttatttaactaatgcacactaaggtgtaagtgaggtcatacacgaactagccaggtgtgtttacatttccagaagggccgtcctaaggaacagaattctaaacagtcaaatttccagagttatttcggcatgttgtgtgatgagacaagccttattgggccaactcaaatataccacatgggtaaccgcctcagccacgtctgatgccgttcctttctcttggaatattctggcctctcctgcttctctctccaaatcttatttttccttcaaggctcagctcaagtcttacccatgaagcttgcccagagcacacctggcttgaattcctgccctgctcggaagtcattgctcctcatttgttccatctgggttggtttggtttcctcgaacagatcctgagctctgtgagagcaggaatcatgttttaaacttcttgccactcttccacaactcctggcatgatgctggcctcagaggatatgtacaagaaatttttatagtaacagccatagcttctccacatgtatcagatttgagtcacagcagccctgtaaggtaggtggtattacccccattttacagaggaacttgtgaaaaaaaaaaaaagaaaaaagaaacactgctcaaaagaaagaagttaaagtcttgtctcctttctatttctggagattctcaatatatcagtcaatatgatatatacatatatatatatatatatatatatatatatatatatatatatatatttttttttttttttttttttttttttttttttttgagacggaatcttgctctgtcgcccaggctggagtgcagtggcgcgatttcggctcactgcaatctccgcctcccggattcaagcaagtctcctccctcagcctcctgaatagctgggactaaaggtgtgtgccaccattgccaccatgcccagctaattttttgtatttttagtagagacggggtttcaccatgttagccaggatggtttcggatctcctgacctcgtgatccacccgcctcagcctcccaaagtgctgggattacaggtatgagccatcaatatgatatttttgagtgtgacctctgtgccctgcactattggaaatataaaaaaggtgtagacctggagccctgtcttcaagtcagccatggaacagtgacttccaaacctggttgatcaccaaaaatacctcaggagcttgttaacacagagacttccaggtcatccccagagattctgactcagcaggtctgggatattgtcttggtattttctcaaagccacctgagggattctaataatcagccatgtttgaaaaccactgccccagtgatccatatcttctcatatatgtgaacaagtcaggtgtttctggaagagtgggaggcacagtactcttgggactgggaacacacaaacttcatattttaattatatgtttattttagtgtgtattagaaagaccataaccattccacaaaactatgatttcccagatatgatacttttctttcattaaaagtgtatttaattctgacacatgctacaacatggatgaaccttgaggacattatgctaagtgaaatataccagacacaaaatactgaaggatctcactcatatgagatacctagagtagtcaaatttatagagacagtagagtggtggttgtcaggggctgcagggagggagaaatggggagttagtgtttatgaagacagagtttcagttggggaaaataaaaagagttctggagatagatggtggtgatggttgcacaacattgtgatgtaccaaatgccactgaattgtacacttaaaatgtttaaaatggtaaattttatgttatgtatattttaccacaataaaatgtactttaaaaagcaagatagagaagtttaaagttggtaaaagtagagacggactgcagatatggcaatcaggaaagtgctgtgcaagtgactggtgtttgagaaatgattgtagtttgactccctcattttacttaggagggcaccaaggctcagagaagggcagggacttgcccaacatcacacattgagtcagtggcagggccagtactgatatccaggtctcccaactctgtcagtattttcaaatttatatcatctgattcattgctcaaatatcacggtgtcggcaacagacacaggagacacccgtgggtgctagagaagttggggagggcttgatggaggaagtaggacttgatgaaggcccttaaagatggaaggatttgtaagtcagaggagatgaaaacgggcatgaacacaaaactctatcagcaaaaatgaatttggtttctggtttgtatggagatagtgaaaatggaaccctaactggagcagttatgttttgaagtaatagaagcctctcgaacaatacattaatttggacttgatatagtaaacaataggcagcccttgtagaattttgagcacaggcgtgacatggtgaaagcaggcttgtagaaaggttaatctagcagtgaccaacaggatgcatataatgaaaccagaccagtgagtgggctcttctaggaatccagccatggtatgacagggaccagaactgggatggtgggaataagaataaagaggcaaaggtaaatcagtgactcattcaaaggcaagtcaaaggcagaacagccagaacttagtcattcatgaaaggacagattcaagattcttaagcctggacgatagagtcatagtagtgcccttaactgaaatgaaaaacaaaggaagaagaaataatgtggggcaaaggtgaaacatttggttttggacataaagagttggaggtggtaaagaaacatccaagtaaaggtagtttccaagcagcttgaaatatgagattggcccttgggttacaggaaagaggccgttaaactctcattttaaatatggatactttacacaaggatggtgttctagtgacatattcatttttgtttagcattaatttgaaagacatattgttttcataaagaaattgtggtgtaagactttgaacgcaagagaacaagcatttaaatgccttaaaagccagaaaacatcaaggaaagggtggggattggcccaagtgagtaattataaattttctcttctggaaagaaaaaagagaaaaaccatggtgtaatttccagttgtcttttcttggagctttaatgcatagaaggatttagtgtccttgtcacccaatacaacctttcaaagaactgctggatgagtatttagtaatgaacctttgggaacaccttgtatggaatccagctcttctgcaattaatgcaggatggcagctgcctgaatgattcatatcaggacatcatgtaataccacataatttgacaaagtgagaacgggagagtggacaatatttgctctgttgtctgttacatacttgctcagtgaatgaaaggctatacctccttaagcataactgacaaaactcttggacttgctaacccaaaaaattcatctctgatttctatgagtcaaactacaataaactgtctgaattggcgaaaacagcaggtttcacagaggttctggacatttttacagagagaaggactgtgggagccttttcttttaattctttcttggagtctgagccggtcatcaggaaaacttgtgaagtttctcttttagcccttccaccattcttcctgtcttctctcttctcacagcacttttgatagtctacaggctctaagttcccagagctagcacagctccaggtccccactgtgaggcgtcactaagactcataataacgattgtgtattgagaattgacaatgtgtcagacgttgtgctaggtgctatatatatatatatatatatatatatatatatatatatatatatatatatatgttatctcagtcctaaaacaaacttatgaggtaagtactattattcccttcattgtacagattagaaaagtgacgtttaaagaggttaagtagattccactaaggcacaaacccgagtctggcactctttccaccacatcaaccttcatcataaagtgataggaaagacaggggtataacctagctagccaaaagcacccagatcaaccctagcaaccagcagactctcacatcatttttttgagcagtgaagttcctagaggcccttacatctgccccctaaggcagactccactgatggcctaaagcaggggtgtccaatcttttggcttccctgggccacattgaaagaggaaaaattgtcttgagccacatataaaatacactaacgctaatgatagctgatgagcttaaaaaaaatcacacacacaaaaactcgtaaggttttaaaaaagtttacaaattgtgttgggccccattcaaagccatcctgggccacatgtggcccacgaactgtgagttggacaagcttggcctaaaggaaactagaaagatgttttctacccttaacatgggcaaggggagagttttgttttggcaggaagtttacagttactctttagatgcttttgaattaagaaattgtaacacacatttttttcttgggcatttccaatgattttgaatttgcactttgattctatctagccctgccatgactgatctgtgacagagccatgatgctaatatccctttcataatatctttccactaaaacattgatcttaagagtggcacaggatttgaggggcaatgagaagctttatgatttgcatttaccccttgttagattgcaagtctcttgaaagagtagactatcatctcttcttgcattaccacccaattctgtgtcgggattaattcatcccattggtttccaagatgaaggctaagaaccatgattctttgtcatattggaagaagaaacaggacaagagacaagcagaaattggggctctagaagggagcaaccaagagaagcctgggcttcttcccaaatttatcaagcctcggcgctggccctgaacacatggcagtctgtacaggtggccaatgcagagacttaaactaagacccattgccttctgctatgattcacaagaggttgaaggaggatctttaaaaagttacaataacataagtgctgtcctgccttaacaaagctaatcactgctgacctaccctaagcaggactgggtttcaaggggtttttccattggtggacaagactcagactgagcacgtcacactctctcacctagtattgcccgtaccaaacaagatggctagctgagatgaaggagggtttctagccagggaaacatattttctttgtttatttacttttcatgaaactatcccacagaagagtcaaaccagcaattctgccctctttagtataccctgggtttgtcattataccctgcaagagatactcttgatcaccaactttcccatcttcaaaccatagaatgacagaactgaaagagaattccaaacgcatctcttctcacacttagttgcatggatggggaacagagaggcctagagaaggagacggattttcttaaagtcatgcagtgacttagttatgggctagaacccagatttcctgattcctggatgagtactcttccaccccaccacaaggtgactccatcaatagccgacatccgattaaggacttcttggcttacgtgtgtgtcaggttctaaagtattccttcattggcttttcggcctcacttgataatccaaggctgtgtggatagtgcctaagtgtcatcctagattgttctccccagatcagttgcaatccaggccaggatggaacagtgccacaaaatcaatcctccctggcctctgcactgtgagtaaacgaaaatgaatgtctctgtcttctgtctggggctttcggattgctgagcagatgtctgtctcaaaatgactccttagatactggacaagaaaaaatatcagttacacaagccccaataagggaacacaagcttttagggtgtgaaaaagctattgttgcctagttcctgctccccgacaagagcaaatgcacaaaatattgaattttcctttttaaagaagatgtacatagagtccccgacttgaatagccttttaagccttgcgtttcttagaaaattggcttttaaacccaagcttgagcttctctgaggagctcttaacctgttcttccatgaggcattagattctggttaccattttttccattcacatgaagtgagcactatttcctaagtactaaccaaaaaaaaaaaaaaaaaaaaaaaaagggacgccattttgtccagcctgctgtattccatatatttccatgttttacctccccttattcaacagactgtgacccagtgtgggcactatttttggagctaacctaagcagtagaactgtggcattgggatgaggaatttgagaagggattcctatgtatctggtgctaggctcagctcttgtttcactgcaagcctcagcccagtaaaagttatgatcttgtgttgctacctaatgctgcagatgtctagttcctgtttgatccactttcaacaactcaaatatagcaggggacacaagttggagcatgttcctcaggaagggaacatgacacacagccactcactcagcagggctaaagctactcctctgtagagactgacagctgctctgctgaggccctctggagcagctagtcagtctcccaagacagggaaaagccatttattctcctttaccaccttttgccatgaatagagaaaatcgggataagactgtctttcttctgcatagtccaagtcagggataaccttgtgtacactttatgggatttgagggatatgcctagggccagctttaggcgtagctgaaatagatgaccatgtccacattttaatgcaagggctgtccaataaggctctaattatctcccccctccagccattatgctggcagaaatcctagaccagtcatgtcaatcatggagactaccatttctaccatttccttctaagggaaactgcacagtcccttgctgaagaaaatagccctaaattattacttgagaatgaagtggtaacttcttagattatggatgagtacctgacccaagctgatggatgacttttgtatgaagtggcctagcaagaaaaaaaactgtacttagtaggacaatgggaagtagctaggacagatgacctgtctttcgaggatgtaagtatgaaaatactgagattttcagtttgtgggcagcagaaatgtaaatgaaaagacactaaataaaaacctagagtgttttttttttttttttttttttagtggcagagcactcagtaacattcaggatattgaggagatggtaagattcaatccctagaactctcttccttcctgaatgatgccaattcctgagtttctactaggagttttagaaggacattcatttgccttcatatagttgggggagaggctgaactatgcaaaaggtagtttttctattgagggttatatggagaaatttttagcaccaggtgggctcccttcctttggaatttgattgagactttggtaagcctaccaatctctttcacatcctgtagaagagtcccattctcagtctccttctcccatttcacccctcctcccaaaatgtagtcccagattgatcatcacttgatgtggccagcttcccattaggaccacaaaagatcaccccctctctttctgactgggcgttccaagccagaccagtctagctagagaatgtgcaagggacttctgataccttgcctgtagtggacatgccaatttaactttttctttcagacctagtctaacatgattgcagatgcccagctcaattttcaggccttatgcatggtacccacacagactgatgttggcacaaagtgaggttgggcacagagccagtattgactttgtggcagctccggaagcagacagcctttcatggaagtgtacatcattccaagtctcttgtcacaatgctagtgtggatggtttcacagtatttttcaagccacatagacactccatgtttgggctcagtgtcagggacaacactctggaagaaccacatccctgactttaccaaaagccatccccatcatctgttttcaatctgggccgaattagcctgtgatgggaagcagagaaagataaatggttcaaggccactgtttgcaaacccctggcaatctatgatggaaaagatttgtgacactcagatctttgtgccatcacacagtgagagcagaccagagtctcttctagtcttcactgagtagggccatctgaaccagtttgtggaattcacctctctatttttgttgtttatgttggagataagtaggcccacaataacagagaaaagataccctaactgacatctctaggatctctgtagatggaggcagaaatggccgtggaaagcctgagatgattccaaggcccactagattaagccaaatctcattttattgctcaacccacacaccccaaatcaatcaattgcagcttcaatcacaggagaaaatgaaaactttaaagctatctacttcttgatttttctttgtgtactgagacttcacagaaaattctggagatggagggaaggatgaagaaagtattgaaattgaacaaataaatcacacacaaaataatattgcacatatttcctgggcttgtctctaccacttataaagtgaacagggatgaaatgacatcttggtttcacagttgaagagtccatatgctcttttactttatctccacttactgagtttggcttttaaggggcacttctcctaggccatctgattagctgacatcctctagtcaagagcagatagaggccgggcatggtggctcatgcctgtaatctcagcactttgggaggccgaggggggcagatcacctgaattcaggagtttgagaccaccctggccaaaatggtgaaacctcatctccactaaaaatacaaaaattagctgggcgtggtggtgggcacctgtaattacatctactaaggaggctgagacaggagaatcacttgaactcaggaggcggagggaggttgcagtgagccgagatcgtgccactgcactccagccagggtgacagagcgagactccatgtcaaaaaagaaaaaaaaaaagcagatagagaggtacttgagacacccatggcaagaccaggatccaataactgtgaagaaaagagaaggagtcatttggccaaaggacccttcctttccccttgagcccctcagaacacacctaagcttgcttgtctccctggctggagcagaagccagggctccttgccccatccagctgccctgtgaagagcataatttgtcaaagttcctattcttcaaagttcctgctaccagacaaactaaatccggtttaattatagaagcacagaacatctgagtcagaaagggccttaaaaattactttgcccagaagaatgccaaggcataaatacagaaggaatcatagaattaaaatatcaccatttcgcaaccatcatcttaataatggatttagacaatgatcatcaacgtatgctgaaactatagggtgcaagtctacgttagtttgatttcttggttatggtggtatcggctcaatttttccactataaaactatctttttcccctttgaaattacaaccctaacaacaataataaataagcctacaatggagcaaaattacataatgtgtcttctgatgtgactcaatatgaggacacaacatcattttaaaacaaaaagctggagaaaaagcatcttgtcacacaaattgggaaactgatacacaacaaggagaaggaactgagtctgaaactgggattagaatatttttccatggtgtcttggtgcaccatctagttccaaccataatgatgttggtgatgatgataccttcatgttttttcaatcaatttttttttcagtttctactatgtgccagatagtgtgcttggcactcaagagtcatcagtgaattaagcaaaagatctctgccttcatggggcttatatttattttcatgctttttcatctttaccttcttcatcctcatcctcatcattaccatttcaccttttttaaaaatttgtgctcctttgcacaaagactcctaaatagctatatctctaggacctggcacagcatagctttttaataaatagttgttatcttcaattaaggaatgtgtatgtgcacatgtatgtatctgtgtgtgtgtgcatgtcgtgactgtgtatataatgccatttcacttctacactgtagctcagtctatcccccactgcttgaaatagcatctccacttctctcacattatccttcaaggcagcctcatttccttagtgatgacttcccaggaggaccccctcctcttaacgaccaaagtgtttaccactcatttaaatctcatcatacacagtatgtgacagcttggggactgtagtttattcatttaactctgttaagggccactaattaatatgggtaggtaaaatgatttccagtttcccaggggccctgtgaaaaccacgatgccctaacaaaagagcagctattacaattttaggccctgagaagacagatgaggccccttctctgatgagcaccttggtcatgcagaatcttcctggcctggtcacatgagcctgattgcaattctgcccccaatctgccggtatgattctggtcaagtcttagccccttgaaattcactggactcacctgtacaatgaagcagttgttctctgggcacttgggtcctttgcaattttctatctattaggcttcattcttcctgacttcaggaagagaggatatggccaggatgcttgagaaagtacagtgccttctcaaatggccccagcactaccatgtctgccctgctctaattaaaagtgcagtgcacagacacttgaatattggccttaattaaggcacccaaatgaaaagcctagaattgcagcgaatgcaccacatatagaactgattttccaaacccttagctgggtaatgttctcaagaggctacacacaagtgacgaagggatcagggaaggaaggtgtttagtttagtttagtttagtttagtttagtttagtttagtttagtttagtttagtttagttcagtttagtttagttcagtttagtttaggaatacttgctcatacagaagccctttcaaaggcaaagaaatggccagtatttcaggcaggaccctcttcttttccctctattcactgcttaacagctccagggcacgctggcatgtgatgtgacagccagtgtgatagagtagctatgatggtgtgctctggcatcagggatacctgggtcttagtcttagctctgtcatgcgctggctgcatgactttagccaggtcacttaacctctgatccttagtttcctcatctgtaaaagggaataataatgatactacttcttagggtcgttgtgacaattaaacaaagggatgcttagaacagtgcctggctcttagttggtgctctgtgagtgttaggagaaaaatgtccaaattgcaatattgggacacaagagtacccatgtccttctgaagattcagggtggtagcatgtttgaaactggagctgtcctacaaaattcagtctctgcctaggaagcagtttgcactctgctctttgcctgaaaactctgctcagtggcttgatcaagtgggaatataccactccatggcggaaagaacagagacataaactctaagctcagagagcagctaattcaatcaccctcttgctcaccttcacccgccaacaccaaacggacccagaaactccaaaaaaggaagtgaatctctgaaggtcacacaataaactagtggtggacagttctacctcttgatctttttactgcttcttttatgaataagagttgagaaacaaaatgtgtgcagtatagaacagattcaaaaacaaactccatgaatctaggagacttaagctagtctctgtacaccagggtttctcaactttagcactattgacattttgagccagatcattacaaattattaccacacattgcactgtagaatgtgtagcagcatccctggcctgcttgctcagttgtgtgacaacgaaaaatgtcttcagacattgccaaatgtctgctctaggggtaaggtggggtggcagaacttcatgttgagagcacagctgaataggagcagcactgtaaatgtagcttgctcctcagagttcttttcagcactcttctccactatattgtctccaatggtgatatcatccaaccccgtggctgatggcttccagatgtggagctctagacttgacctctccagcccactcctgtcttatatatccacggcctactcgacatccctcttgcacatgttataggcatctcagacaataccgaactcctgattcttgagcctaccctttctccaactcattcttgccttcattcattcattcttgcattagacaatattgcacacctagtgtattcatttcctgtggctgctgttacaaactaccacaaacttggtgtggtctaaactacagaaaatgttttctttcatagttctggaagccagaagtcccaaatcaaggtgtcagcaaggccttgcctcctccaaagattctaggggagaatctttccttgcctcttccaacttctgctggctccaggtactccttggcttgtggctgcatcactctgatctctgcattggtcatcacatggtcttttcctcttctctccctgtggttctcctctgtcttttataaggacactcatcatttgacttagaggccacctatataatccacaatgacttcatcttgagatccttaattacatctgcaaaaatccttcttccaaaaaagtcatgttcacaggttcctgcggttaggacacagatgtatctttttaggggccatcattcaacccaccactcctactatgcaccaggaatgttatagatgctggggatacagtggggaacaaagcaaagtccttgatctcgtggaaattacattatactgttagaagatagatagacaataaatggataactatataatatagaatgtcaggtagtgataagtgctagagagaaaaagaaaacagggtaagaagatagaaaatgatggggtatgctacttttgatagggcgctcagggaaatcctcttggaagaggtgatgttcaggtagagaaccgaagcactggaaccagacatgggaaggtcagggaaaggtgttagaggcagagggaacagaaagtgcaaaggtctttagaaaggattattcttgacatgtttgagaaaaagcaaggaggccagagtgggtgttgcacagacagtgaccagaagagtggcaggaaatgagtttggagaggttggtaggaaccagagcacgcagggtgttgtgggccatggaaagaactttggttttattccaagtgtgataagaaaccattagaccgagtctacagatgaggggagtgacatgacctgatttgcattttcaaaatatcagcctggctgtgatgtggagaaggaggcatagcagcagggcaagtgtataggcagtgagacgagcttgtggaaagggagaggcactgtctccatccatccccttgctcaaggagtcattcccgatttctctcttacccttatcccccacatctaatccactggaaaaatcctctcagcttcatattcaaaatatatccagaatttgaccatttctcatcacctccatcactacccctcagtcttagccactgttatctcttgcctggtccactatgatagcctcccaactggtctccctgcttcaacccttgcctcctcagtctatttgtgacacaagagccaaatcgaactttttaaagcataagtcagaacatgtcaccccccgggcttaaaacctgcgatggttttccagtgcacttaaaataaaatccaaacactctgccatggccgccattatgtgactctcacctatcctgcagccccattccctaccactctccttactcactacgttccagccactctggccttctttccttaaacccttccagtttgttcctacctcaaggactttgcaccagctgttcctctaggtggtaatatggttttttccagcggctgtcacctcctccaggaggcctccctgattaccctcatgaaagtaggatcctgattgtcaccctgttttcttttattttcttcagagcatgtattactctctgaaattatatcaggtatttgtttgatttattatgtgtttatatggtggcttatttactacttgtcttttcttactagaaggtaagcttcctgaatcagggctcatgtctgacttgtttgctgctatgacctcagcagctagtacagtgcctggcacacagtagcccctcagttaatatctgttgagtgaatgaacctctctcccagtgcacaactggacaggagcttaaggactatccagcgagtggacgtcggaatcacccagagggcttttaaaacaatccatatttccagggccccttccaagcctactgcatcaaaatctcctggggcgggcccacaaatctacattttgaacaagttcagtttgtaacaaacacttatgtagcacttactgctactattctaagtattttacatatattaactcattttatccttttaatagtaattttagtattacagttttactgccaaggaaacgaaggcacagggacatttagtaactttgcccaaggccacccaggcaggaagtagtagagtcagaattcaaacccagtcagtatgtcctcttaaccactactctgtgctgactctgcacaagaagttctgtgatcagtgctgtttgggacccatacataaaattggctccaataaggacactgagacccagactagacaatggacctgattaaagccacaatcagaaatgagataggttttgcgtctttccatctgatgagcattccattctgtccagtcattctgtgctctgtaaagggcagggccggggagtatgctgcctacataaaagttaagtcacaagaagttgtctagaaatgtttttgctgtcagcactggttgtcagggaatgcaggaacacatcctggtattgggatctcttatcatctctgggacaatacaagcttaaagtgggagaccctcttccctcaggagacagttagcaaagccacgggcgacgaagcctgctgctgctggcctagttgaggatggaggtgtaagagaagcccccataatgtcagcggagggagcagtatgtgcggcggagcttatctgctccggtcacaaaaagtgcaccaggcctcggcaggcagcctccactcccctattcccgccagcccccactgagagaaccaggggatggcccagccagatgacatgcctcagttactctccaatgaggccccgggccaaacaggcttttcaatttccagatgctttttaattaaaataaaggccactctgtaacctaacattgaatagacaaagtttccttagtagaatgactgtacgagttcaccctttttccattacttttcattgagcaactgaacgtttctaaccaataaattatgacttgagtcacatgacagcaaggggcatggaagggttaagtgacttatggaaggtcactctgctaaagaaagactcctttgttctagcctcccctcttgctcctgcctctgcgagcccgtattctaccttttggggagacggaaagagggctactctagcctcgctcagaacagcagagggttgagcaatggtgttgtgacctggtccatctgggaattcagactcttcatctctgcttcaaaatggatctcaagagctcagattttctgtattggttgcccacaccatgagttctaactctgcctccatcctttggggacataaatggcaggagggaaaaaaggccactttctttttttttttttttgagatggagtttcgctcttgttgcccgggctggagtgcaatggcacaaacttggctcaccacaaactctgcctcctggattcaagcgattctcctgccttagcctcccgagtagctgggattacaggcatgcaccaccaggcccggctaattttgtatttttagcagagacgggatttctccatgttggtcaggctggtcttgaactcccgacctcaggtgatccacccgcctcggcctcccgaaatgctgggattacaggcgtgagccaccacgcccggccaggccactttatttctatccaggtcacgtggttagagatgtttggggaggcctgtggggggacaaagcaatctcaccaacttctgtcttggacttacctggtctagaatactagcacagaaaaggagcaagaggcctgacgacaggtttaggctctgcccaggtgtaatagcttactttttcttcttaattatgagccaactcagcctttagcagagttcagagacaatgaggctgtctatgggctcagaacaaagcccactgatcctagactccagagttcgatgcattaagtgacgactgattgagctcccctgcctcacatggatcactgttcttgttcaccacatactatgattaggacaactgaggtcccaaaggttacatttgtccaaagagcctcagctaagaattgaagagaataaagaacgagtgttttctcaatgagttttctcttcccaaactcctgtcctgtgttctttttgtgaaagcagagcttaggccgagttctttcttccctgttctgctgaaagattgggtctgatctgtattgccagctgtaaagacaggaagaggaaggagtgagaaaccaatgagaacccatttcaagttttccttgaatactccaaaatagtttcttccacatcctggaagtaccaaagcagttagtgtggtctatcttgggccacatctacatgaaaccaacatagcccataggaaagtggaggacccagccaaccactgtttgagaggctgttgatgtttgttttctacagttctaaattacctacgtctgtgcaccacagatgcttgtgggtcacagtgcatgtgattgaggttatgtatgggttgaatgctgtaggaaccaggtttattttgtcctgggtcctttctcactttggccttcttttattgcctgtgtgaacttttcttatttggatctactgaagacatagaaacatccctgcccttaccccaacccttccatttcattcctgagtgaccttttggctggaggctctcttggcattgcaaagattaagagtgtctccacaggtctgtttcaggattcccaagagaatttgaggcataaggctgagaaaatgagttttaagattcagtgcttggaatatttttcctcaacatgtcatcctgaatctagaatttctgaagaagatccatgatatcagctaatttgggcaaccttggtatcttcctttaccattcaacttgtgaagtgtcataaaagggccatatcctaaatggctcccaagtgggctgttgggccaagattttggtgttcaagtaggccatcttgtgtttcactccgtagggaattgtgatcatacccaacagatgtgtagcttcaaaaaagcaaagggtggtaggctttagaaatatccatctgttgaacatttttcctttcatctgcaggatagataaagaccgtgtgaacggtcctacccagccccacacaagattatagccacatttcttctcatgaacagaagagtgaaggcaagtgagggacatttgaaaaatggctggcagtacctaggtcaggttgttggaagctttttgggctctcattctgggattaagttatgttggaaagcaaggccagcccctttcctccctcaacagatggagatcaaaagacagtgtcagcctaaccatccacaaatctctccagtgtttgacactcactatcaacaaattccatctctctgtgagggaggcagcaatctgaaacagccttattaggccacagggcttggggactggggtggtctctgcatcctatggccacttttcatttggaatcatttggtctactaaacctctccatttattaaaaaaaaaaaaattgagactatgatgagactttcacatgacagagtttctaggctgaaaagaaatggccacagaatgatgggccattttcttcctcacatcctgtcacacaaatacactcaaatttcccttttccctgtctcccctctctctcccttctgtctcttccttccttcctccctccctccttcccttcccttccccttccctccttccttccttctctccctccttccttccttcttcccttcctccattcctccctccctccttccctccctctctcctttcctccattctttcctttccttctcctccctccctctttcctcttcttccttctctcctcccctgtcttccttctttcctttctctttttctttcattttaaaaatactttagcctgcagaggctcacccagtttaatttcagcaagttcacaagcctgagatgtttctctctttctcaccttttcccctgttagcacttactggattctccaaaatggctattacagtttaagcagacacagagggggaaaatccatatttttgtgacttacataaggagtttgagccttgacaaagtactcagtaagtcttgagtttgcctctaatagtatatagctgaaggagtctctgaaatgacaggatttatggaggtgcctagaagtacattcaataaggaggaaaaacaccagatccattctgaaatcttctcacccaccagccggttgcctattacagggcattgttagtgcagcaacttatgtatagtaaataatcagcccctaacttgttcaatagtatattgtggattttttttcaaatggagcccccttttggggtaacatttatgacttatgaaagaatcctttgctctgtttcatcagaatcatcagttcttattgaggttcatattgatcaagggtatttttcttcagagagtggggatgtacctccaagcagctaattagattagtagcaccaacattaccatcaaagaggaagataactgagtattgcctgattttagtacagctaccacaggatgctccagagacactacttaacgtcaaaatagaagggaagagagagcaagagagagtatacaaggaagtacacaagagaactcaggcttcatggacttctgagcacacagctagctagggtattgggaccacccagagataccccgtcagcccctgcattccccacaaaggatgttatgataagcccttggaatttgtcaggggaccctgcgaggttatctaatgatcctggaatcccctgtacagttcccacaccaaatagctatacttcctctccttggactattccaatagtagggtcgtcaccaccagagatggtttcacactcttgaatggctctgaaaaggattttttttcatttattcaggctctcagtttcatttattgagcttatactatatgacaggcagtgtactttgtactggggatacagcagtggatgaaacaaatgggttccctgccctcctggggtttccattctagtgaggagatagataataaaggaacagaactttctccacccagctctatcactctgtatgcctttgcccatgggtttgtggtgcccaaaatgtaacccaatgacttgggagggttttgcttgatttatgaggtcagggcagaactcctttattccgaagactagactcttatgaatgcaacttacaacaatttttgctttttgtttcactggtgatatggtttggatttgtgtctctgtccaaatctcgtgtcagattggaagagggtcctagttggaggtgattggatcacgaggtggatttctcccttgctgttgtcctgatactgagtgagttctcacgaggtctgatggtttaaaagtgtgtggcactttccctgttgctctctctctctctctctctctctcctgttctaccatggtaagacgtgcttgcttcctcttcaccttccgccatgactgtacgtttcctgaggcctcccagtcatgcttcctgttaagcctgtggaactatgagtcaattaaaccccttttcttcataaattacccagtcttaggtagttgtttatagcagtgtgaaaacggactaatacaactggtcgcatcatacattgacttacagtgacctgactgtcaacagacactcctaagccttcccccctgttccccacttttaaacatgttttaccattaggtcagttttctcctgttttatattagtgcaattgatttttttggaccaaattataacattttacatttatttctgttaaatattattttgctaaaaatactctgtcatgccagtctattgatctagtttgtgatttaggaggacagaaagtcctttgcatttactcaggggtctgtttataaaacttataacactgggctatcacagagagaaacttggtcttagccaaaagttgaaggcctgacacccaagatgtcataggagtttcacctcatggggttaaaaatttttttaacaaatgaagaagcaaggcaatcacattatgctttggctcagtaaaataatgcaaggaactcccaagcatgttacagataacagccttctcagaaagatccccaactgctcaccatatggttgaattggggctgggaacttgaaacctgcagggtctttgttaggttagaatgggggaagggagtttgcagagaccaaatcctcaaggcaatgggtcatgattggcaaaggtgcccgtgactgcttgctcttggtatgagttgcatgagctaaggcatctccttgtcttatttgcatggcagggctggaggctacactgtgacttggcattcatgggacaacaaaatgaccagtcattctgtgttccatggaggccagtcagagcaggttccttggtggtgtgctcagggactgggatccagtggcttgtgaactcagccagctaggcaggctggcaagatgggcaagcaccccaaacctcacccactcccattcccacccccacccagctccacattcttgaggttttagttcaccagacctgaatgagagactgactgcctgactgctaattattcctggaaatggcatgatatgaagtctgcaaacattttctgcaaacattgacccacaagaggcaagctgttgagttctggaagctaggaggcaggaggtgggagggggcttgggaggcattcctcaggcatgaggcagttgggtccctttgcctgctggatttctgctgtaaggtcagcaggaaacagatgcatggaggacagtccccagggtggcatgggaccacccaggggtgttgggcttttcaggtgaacatagaaggctgggctgggagctcccaggtagcaagagccagattgttggtgcctttctgttgtcaaaaaaaaaagtttcagctgccacccagccaaactttgcttgcacacatgttttccagagacagagacaaaaatgtgtttctcagggtgggggtggggtggggagactggagtgacagttacattagccgtatgcagagccatcctcatcacctcggcatttcctggagatggttgcagcctcctgtgaaccccagccaaggttctttcgagatccagggcaagccccatggccaagagcagactggcctgactcagagggagaaacaggagacttcggggagagtagccgggctgtgtacggcccctccaccgccaagcccaccacccgcttcagccttgtcttccgctactgcggacctccagctccagaaacaccaagctgccccagcatcccgctcacaccaggcagttctcagccactctaccactgctcatgcccctttccccatcccaagtgctctttccccactgcttccctctcctaactcctacccattctgcaaggctcccctccgggatcacctcatttggaaagccttcctgtattccgtctgtctgagtttggccttctcctctgtgctcccccaccaagtgttgtgttttctccaaccacagcatttctcactctagagaataagagctcacacccatctccagcttacaatgcgcaagtcactgttctaccttctttacacatattaacatcagtatcttgattttattgatgagggccctgggaaattcagaggttaagtaacttgcccaacatcacacggctagggaatgatgaaatcaggatttgaacccaagctttctggctccaaaatatatcccactggaaagtgaactctttgagggcaggtgagtcaaatcatccctgaattctcagagtgggcactccagagatgtgggcggacttaattgaaccacatgaaactaggaagaccatagggaagatcctggaaagatgggatgggccagaaaaagaggtaacccctaataactcacacacctctccctcctgcccttgtggatgggtattcaggcctaacagatcctgctgtgggtgatttccaggaaccacaaaggccagaacaatgccgaaggccccacgttgggaggcagcctctgggaggccattttcaaaggccagacccattttcgctgggcctgcctgctctgttgccacccagtgtagccactacttctcatttggttttggttaaagaccacaatgtacttgctcactgggggaggtgggtagggtgggagagggcttggctcctctttgtgtggagtgttcacacttagcccatcctgccccaatctcagggaaatttggggaggccagaaggaagtctttcccggtcctagaattttctgtcttcagccttgaaacctttgtgtgaaagcttcacctgtgtggaattcctatagacaagtgtgagctggccattatggccggatttagacccatcactagtccttcccagggcccttagaggcccttttgaggaaaaaagcagacatcccttaaaaaaataaaactagaacatgatgcccaggatccagaatactgaattataagtctgagcatccaactctagacagagtgactctgggtgtgggtgctggagtaagactgaatggactgacatcttagccctaccatttcatagatgtgtgactttaggtttagagttgtgcaaccatcatcactagttccagaatattgtcattactccagaaagaaactgtacccattaaacagtccttcccattctctccccactccatcctctggcagttcctaatctctttctgtctgtatggatttgcctattctggatatctcatataaatggaatcgtgtatatgtgatctttgtgtctggcttctttcacttagcatcatgttttcaaggttcatccatgttgtagtatgcattagtccttcattcctgtttatggctgaataatatgactataccacattttgtttatccatttgtctgttgatgggcatttgggttgtttccactttatggctattgagaatactgctgctatgaacattcgtgtacaagtgtttatgtggatctatgttcaattctcctggatgtgtatgtacctaggagtggaattgctggatcatagggtaactccacagttaactttttttttttttttgagacaaggtcttgttctgtcacttaggctagagtgcagtggtggggccttggctcactgcagcctcaaactcctagtctccagagtccttctgcttcagcctcctgagtagctgggactacaggcatgcaccaccacacccagctatttaaaaaaattttttttttatagagatgggggtctccctgcatagcccaggcggatctcaaactcctgccttcaagtaatcttactgccttgacctctcaaagtgctgggattacaggtgtgagccactgtgcctggtccatgtttaactttttgaggaactgccaaactgtttttcaaagcagctgcatattacaaccccatcagcaatgcataagggttctgatttctccacattctcaccgtcagttgttattttgcattgtattttttattacagccatcctaataggtgtgaggtagtacctcactgtagcttggaattgcattaccctaattattgatgtcgagcatatttttatgtgctccattggccattcatgtatcttctttggaagacagtctgttcagatcctttgatcatttttaattgggttatttgtctttttgctttatggagtcttaagtgttttgcatgtaatctagatacaagtctcttatgagatatgtaatttccaaaatttttctctcattccatgggtggtctcttcacttttttggttgtgtgctttgaagcagaaagccttttaattttcatgaagtctccatttcatcaaagaaaaaatagatgtactttttccatggttgcttgtgcttttggtgtcaaatctaagatttacacgtatgtttatttctaagagctttatagtttgggctcttgcattttgacctttgatatacttttatttaatttttgcacatggtgtaagataaaggtccagttccattcttttgcatgtggatatccagttgtcccagcaccatttgtttaaaagactatcctttcccctattgaattgtcttgatgcccttgttgaaagtaaattgaccataaacgtgagggtttatttctggtccacaacatttttaactgacagaaaagaatgatcagatatggagggcctacaatagtcccaatatctcagcctagcacacccagaagcctcttatccctccatccactcagtagagaaaggatcattgcccagggaaatggtggtcaccaacattaggtctaatgactcaacctggaaggagatcatgtggaaaagttacacgtatttgcagaaccaaccttcctttctctggaaagttaggcttcagtgtagacctccattcctctttctgagcatgccgtcatgagtttaagaaaagtcttttctcctttccccttagctgggaagttcatcccatgttcaccctcctaagactgcccactctcggtttaagctatagttagagcccagaatttcagaaatcagagaggtttggtttcattttttttttctcgaaggaaaaatgctcttgcttgcatcttctttgccggtcacacagcttcacactttgggcagtcccccagcaagttggcaatggacttattctggacacgtccttcctgcttttgctgggaagtgagcacctcacagttgcagcagactgcccaggacagaaagggaacatgacctcccactagctttggccctacctagcaactgacgatcctgactcgtgccttcaggagattcttgacctcttgactataaggtttcctgagttagggaaggcagaatggcagagtgcaaaggagacgagctttgataccagacagcctgggtttgagtccccgattctgcgtttgcttgctatggcagacacagagatgcactgcttagatcccctgtcaagaaagaacccgttgaccagctgaaaggagtgtggttacttgacagtctccagctgttagctccttcagggtctgcctcagcttttgagccaaggtcatgctgttcttgaggtggcccctagccaatgactgatgaaggaggtgatacaaggcccatttccaccacccagaagactcctctaaaaggcagtatttgctccagagctccctgttgggcacagactttgacaggtctgcatcatgctctgggctcctcttgcctggtcctgctttctccccttttctttcacaggtatttcccgctaaacctcttgcactcccacctgtcagagcatctgcttcacagagaactcaacctgtcgtctctcagcttgtgtcttctcccctgtgacaggggaataatggcatcatcccacagggttggtaaaaagattagaactaagtaaaatacctgccacaaaggaggcattccatcaaagggagctgttactactagggaatctatcatttccatggctatatcctaacttttaaatgaaatagaagtacccattataatccaaacctagaaatagtctcaatgcccatcaacagaagaatggataaatacattgtgctgggtccatacaatggaattctaatcagcaataaaatgggtaaatctcatcagcattagattgagctaaagaaaccagacacacaaaaaatacatgttgtatgatgccatttctctgaagtgcaagaatagacagaactaatgagtgatgataaaggccagtgactcagtggtgacccttaggggataatgaccaggggcatgagggaaccttctaagaagctggaaatgttctctatcttgatctagattctggttatatcactcacacacacacaaacacacatacacacaaacacacacacacacaaacacactcacatacacacacacacacacacacacactccaaaatcacaaagcttgcaattaaggttaatacactttatgcacctacctatgtatgttatggctgcatttttacaaatggaaatatagcggggagttttttatttttaattagcatatgtacaagttaagttttttaaatttagaaaatccagaaaaatagaaagaaaaaaatctcctatggccccatctcccaaagatacccagtagagacattttagatattgcattgcattctctagccctcttggctctacttctctatggtcctgctctggctcatggagaaaggaagttccaccaccatttccaccttcttggaaatagtgcttctcacctctctttcactccttccctcagataaaacctgaagcttaatagtgccaaaatgtcaacgtcctcatctgcacatcaccttgcactgcatcttctgggcctctggctccctttctggacagccaggtcaggaagccaggttcactgtgtcttctgcttttgcaggagttgacatgctaactcaggccccaaaggactttctgatgggaatgtacctgatgctccccaaagctgaagtggtgcaggctcagagcagtcagagcagccaagctttttgcctggcagttgtgtgaattatgagagaaaggcatcttccagcttgcttagatgaccacaagctgtcaaagtgaccctgtaggaaatgtctcaaggcagaatataatcaaaaccaggcatgtaaaaaactggggctttctttctagactgctggttctcaaagtgtggctcccagaccaacagcatcagcattagcatctccggggaactgattagaaatgcaaattggggcccccaccagggacctagtgaaagaaactctgggagtgggacccagtcatctgtgttttaacaggccctccaggtgattctgaggcacccttaagtttgagagcctctgttctagaggtttctaaattccactgccagagaaagcaaggatgcattcacatgtgctctgctcatgtgcataaccagtgtcctgtgtccttggtatgacttagaggcacacgccaggtccatataacttcaaagtctcttgttctttatatcctgaacccaaggaaacacatttcttttctttttttttttctgttagcagagcaaagatgaaatatagcccaatgttccctcaacaaaaagatttattaatttgtactaatgactgtttagagaaaaacataaaaaccaatgtccttgttgaatgctccttgatggcaaaatgtggatgttatctgtaaaatcaacaaatttgtcaccaaagtgaaatgttatcttttcctgaagactttcccaggcagctgaaggcctcaaggactagacagcctcccccatcaccatgatcaaatgaagagggttagaacttgcagccgtaactcaaatgccttaagatggctcagatgtgtgtttgttttcaggttaggaactttgctcagaacccctgaagaaaaggaaccatgaacctattcaaagactcaaagaatcctctcagacctatgccccttcttaccagtgtgttctggtaaatgcttaacaatctgcacgtgtgcacacgtgcacgcgcgtgcgcgcacacacacacacacatatctttattttaaatgtgtggcacgtgatccaaaaataataaaatatacaatattcattcttgtaaatttcatacagctaattaacattcatactcatgccttagttgatttttacctaactcttgtatccatatccaacctaaggtggcaattaacaaacaagcatggttctgacataagtattggttgatacattggtttacatttatgaataagacaaaagcaaaacaacaaaatgcatgtcaaaatttctctgattcacatagtgacataaatgacttctttactaaatcagataatcatctttaaatactggaaggatatttcctcaaattttttgtgctgtttacaatgtaacagctactgagacaacacaatttttaagtttcagctgcactattaacatttcctccatctttcttaagcctagatcaggggtcgtcaaacatattttgttaaagagccagatagtaaatattttaggctttttgtttgtttgtttgagacaggatctcgctctgtcaccaaggctggagtgtagtggcatgatctcggctcattgcaaactctgcctcccaagttcaagcaattctcctgcctcagcctcccaagtagttgggactacagtcgtgcaccactatgcctggatactttttattattttgtagagatgaggttttatcatgttgagcaggctagtctcgaactcctgggctcgagcaatccacctgcttcagcttcccaaagtgctgagattacaggcatgagccactgcgcctggctaagcatttcaggctttgtagccacatagtcattttttttacaaccctttaaaaatgtaaaaatcatcctttgcttgtgggctacacaaaaacagactgtggggaaagttctcaactcttggtcaagacaatcaacacaacaatagattaagcactgctttgtagcatttgctagtttccctgacataaatagtcctaccatggccaacttcaggctacacaacttgatgtcacagaatgtggagttgggaagagatgtccagtggcagaacattatatagtatttccagtatactgatataaaagatataagtaacctcaagagcatggataatagcaaagtgtagtcaaataattagaaagggatgagtttcgcatatgtattagctttgtgggtttttttggttttgttttttgagacagggtctcattctgtcacccaggctggagtgcagtggcatgatcatagctcactgcagccttgacctcctgggctcaaacgatcctcctgcctcagctgggaccacaggtgtgtggcaccacacccagctaattttttaaaaattatgttttgtagagatatggtctccctatgttgcccaggctggtctggaactcctcagcttgagtgatcctcccacctcagcctcctaaagtgttgggattacaggcatgagccaccacacctagccaagctttgtttttcatataatttattttattgcaaggttatataatttaatttctaataatggctgaatttaacaactcagctctcaaaattaatttgtctcttgtaagttggtatgagcacaccattgtgaccataacaaatttcaacctgtctttttttgttggggagtaggtaaaaagagaatcttcactcaatttggtccattattccttgtaacaaaagaatttactacagggtttctttgaagctgggagtttccctggctcttctaaaataggaaatgattttagatgttatttttacgtattttcaaaaagaggtctgtctctattctcaactgcttcctgaccaccttttgcttccaaataatgaaaactatttaaaggaaaaaggaactactgtagtgtggttttaagaaaagcacatactttgctctttcagaagtagttacacaatacttctgcccataaactggggaagagttaaaatagctttccaaggctcctcccagggctgtgattttcctctcatctgctcaggtaatgccactcatggtgctcattcatttattcagctatttgagcatctaccaactgcccgccagtgtgctgagccccagggacacagcagaacgcgagagagacatggcccctgctgaataagtaattacgcagatcattatttacttatactttacattagtaccttaaaggagagcatataacatagcggcctgatctattctgggagattcaggatgtggcatttaacctgacacctgaagaatgagtagaaagccatgccaaggaagaggcaaaaagaagtagaacacccttccttccaggtgatggggacatcctataggatgcttgcccaaagcacaggtacacatacaatacatacacagatacacagcatctctttggtattaaaatttaatggggggagaaattagaaaaaaaaaagacgtctaaaaaggctcctgggatgaaggggatgataatttttttaaaacaacattgagaaacattggtttatataaacaacttggtgctcttgagctattatcacagcagtggcagagctaagaggctgactcctctcatgaggactagctacagacctgcaggctccagaggctgatactaagacaggaagttagaggactcatggtttcccacaactccagaaaatatcctctgttatctttcaaatactgcctcttctcattctctctcttccctccttctggaactccaactggacacttactggaacttctcattctgtcctccatgtagcttagctttcctttcttatttttcatctctttattcctctgctctgcatctggataatttcctcagctctatcttctggttcactcattctctcatcaactgtgtttagtttgttgtttaatccctctgttgagtgttcttttttccattgcaatgcctatatttcggttcttttttgcattcacctgtatttttcaaactattctattcttgccttctagtttctattcctttttaaaacctctttcggccaggcatggtggctcacgcctgtaatcccagcactttgggaggctgaggcgggtggatcacccgaggtcaggagttcaagaccagcctggccaacatgatgaaatcctatctctactaaaaaatacaaaaattagctgggcatgatggcaggcacctgtaatcccagctactcaggaggctgaggcagaagaatcgcttgaacccaggaggcggaggttgcagtgagctgagatcgcaccattgcactccagcctgggtgatagagcaatactctgtctcaaaaaaaaaaaaaaaatctttgaacattttcagcatacttattttaaaatcccttttagattttcttattagctgtggttcttaaggtatgaattcttccattggttgcactggtcttatggtggtttatttcctcacggacttagtaagttctagctatgcattcatcctgagtcatagatacaaacacagattcatgtgctatataccacctgggtttgaattctggctctgccacttagtacctgtgtgaccttaggtaagttatttaatctctctgttcttcagtttcagtatctggaaatcagggctgttctacaaatgagttattaggttggtggaaaatgattgcagtttttgccactaatttcaacggcaaaaaccgcaattacttttgcatcaacctaaataatataagccaagcacttaggacagcatctggcacataattaagcacttggctagtgtaattactgttatttggcaggaattgttttaccttggagtcttatgtactttgggttatgtgactgcctactctcagctcaaagtggccagtacacttctgaactgtgttttttcccccatccccacttatgggccagcacttaccactactgactttccataggagctcagattccactcccgttcccaccctgccattcaaacccttcgcccaggatatgtgaccacctttggttcttctgtgggctgtgtagttgctgctgtggctttgagctccctcttcatttctggcactagaatatgtttatttttgcttttgctctctacaacatatttaaatttttgaaaaaacaatgtgttttgagcaggggaggagcttcctgcaacagctcaggcaaccatactgaccagtaatccctaaaaattctttcttttttttttaaattttaagttccggggtacatgtgcaggatgtgcaggtttgttatgtaagtaaacatgtgccatggtggtttgctgcatcgatcaacccatcacctacatattaagcccagcatgcatcagctatttttcctgatgctttccacccgccacagccccccaagaggccacagtgtgtgttttcccctccctgggtccatgtgttctcattctccctgagcattcttcctgaagaggcttacctctcatttggcagtgggctccttgagagaactggggacaaaggctggattcctggtgggaagggacatatattatttgtttttgtattccctatgcctgatatgtgtttactgagtaaagacacgaaagactgccttggcaacagcaagcactacaagtggccagctcactgcttgatttctctaagaattaccaccaccatgttgtaaccctcctccccgcccttcttcctgtgaatgagttctgtcaaggtgacatggcttctaacacatgacagtaggtatcattcaatcactgatgatctcaagggtgagtagctttcttttactctgtaaacaaaatgccaaactgggaaatgctgcagaggccacatattattctgactttcagagtgttgtttcgaaagcaccagagtaaaatgttaagcaggtagctgatgcaatctggcaaagtcagtatatagctctatttatataaagacacacacatatatcagaccatcagaaggatttgtataaagagtgactctcctatgaaggtaaaggccacccctcttcagttccagtgactgagatacatttttccaatcctgggggcaaatacagacacagcaagttccttcttccctttggaaatttggcaggtaagtcaagtctgtctctgttgccacattctctcgagattttatgactgtgcacatggcctgtgtgaaagcttcgcttaggtcaccttatgccttggcagccagcatggtgtatgacgattcaggaagaccctggtgtttcccagatggggccagatctggccatgcaattattgccctccagctgggaaatgtgacatgggggtgatgaagtggctgctgagaaggaggcagttagactctgaatttggtctgttctttatttaaatctaaagattgaacacacacacacatagatctaaaatcaatatcatacattcacacacacacacactcacacatgcaccactccccaactgcacagggtattttttagggattcatgtgggattcccctacacatatttcccagtctaactgcctattctttcccctgtttacttgccatctcatcattctctcttcctttactctcctacttatctttatcattgcttttagctgtgtgttcctattaacccagatgatcagtttcagactctttgagaaagagacagggaccctaaatccattgtgagctgctttgtctcattctctcccatgaccacagagaggcatgtctctggaccttgattctgagaggaaacagattcacagaaactacaccaccactggtagcacaatgttactctcagggtggacattctcatttataaaaagagtagtagaataaattgcattctaatcccagcagctctaataacttgtccttctttctatcaatatactgatcactgttactacagaggcagcagggaacaaatatgggctctgtatttaaacaaacttgggttcaagttccagcttcagcagttaatagctgagtgacactgggcaagttgcttatcctctctgatcttctgtttctttatctgcttaattggcatcaaatagaatatacagacagtccccaacttgcaatggtttggcttgcaattttttgacattatgacgggcttattagggtactgaatgcatttttgatttatgatatttttgatttgtgatggttttatcgggacatagccccatcataagtcaaggagcatccgtatgttcaaggtgctggatacataattggtgctctataaataggtggaattactatgattatttggatgatggtcgcaacccttggtccttcctgtctcactggagttagagacaatcagagttaaaggaggactctaaagatgaacaaagcatcttctcacggtcaagtgacagctcggagctgctggatgctcagcatagcactagctctctaacaggctctaggagaaacaatgggtagatctactcctgctctcaaggggccctggccatccaaatgagcagataagatgaaaatgtctacaaatgttaaaaaagaaaaaaaaaaggctgggcatggtggttcatttctgtaatcccaacacttcgggaagctgaggcaggaggattacttaagcccaggagttcaagaccagcctgagcaatgtagggagacaccgtctctacaaaaactaaaaataaaatatccaggcttggtggggcacacctgtggtcctagctactcaggaggctgagatgggaggatcacttgagcccaggagatcgaagctgcagtgagccatcatcactccactgcactccagcctgggggacagagcacaaccgcatctcaaaaaagaaaagaaaaaaagaggaaaatgtaaatatgagtgggcaataagactagtatctgctaaattcttccctatagaccacaagtgctatggaaattcagagagggggtgctgctgtgaataagaagtcctcctggaggaggcaaggcttcagctgagacttaaagaaaggatgaggcttggagtgacccctagaaaaggtgggagctctgtgggcaaatgctggtcaaacttgagaggtaggcacaactgttatttccaatttacagataagaaaatggaaggccagataagcctagtgacttctctaaggccactcagcaagtaatggcagcactaggatttaggtagagatcggtctctgtctggtgttgaaggctacattcaaagctggctctgactgaagaaagatgagaaataggaaatagccattgatggttttccagataggagtgacgtagaaaaggcagtgtgttttctatattcacagtgcagcaggtgttcaggggacgattctggcactagaggggtcaattaggaggcagttgcaatactttagggctgaggtattgaaggcctgatccagggtaggggcatggtgggactagagaaggcattaagccattaggcatgtcaaagggcaaattcacagacttgggaactggctgaataaggagaaagaaggacagcgggatgattaaagaatctgatatgggaaccagaagactgggcaatgctgctactaggcatattgggatagcatactcattttaaggttgctgtttatataaaacagagcctggtttcttttattattattgctattaaatctttttatttttttaaaaacacacataccataagaaaacagacaaattcagaatatgagatattctacaagacaactagcctgaactcttcaaaaattcagtgtcacacacaaaaattaggagcatgcactgttctagattaaacgacactaaagggacataagtagatgcaatacacaaaccttggttttggattctggattttacaaagctatgaaagacatttggggaatattggggcaatttgaatatggattggaaattagattatattaggaattattgtttattttcttagctgtgataatatattgtggttaggagggagaatcttcttattctttaaagagtcattctgaagaatttagtgggaatgtgttatgatgcctgtgaccttcaaatatatgtgtgtgtgtgtgtgtgtgtgtgtgtgtgtgtaaatagattgactgatagaaacagaactacacagcaactatgttgaaatgttaattgtggaatcttggtggttatatgtatgttcattgttctacttctttgatctatttgtacgtttgaattttttcaaaataaaattcaggaaaaaataatgcatgaacattgtaaaaaacaacaacaacaacagtaaaaaagggtatggggggaacctttctgccccagacacccaatactccttcccagaagtaaccactggtcacatttcttgaaatgttatctgcattttacaagcctatgtatgtgtttgtaaattctgttaataaatagataggttcatgctatgcatctttttgttagctacaagtagactctcttatctattcaactgggagagtagttagttaattaaaaatcagtaaaagtggaagtgcttggacccactagggagtggtgaccaagtgcatccagaatactgtgggtatcaatcagtgcattttacacaggaaatggagagcatcctttaattgtgagagttggccccacagacgtcagctaagcgagcttccactgtaatggcagcagcctgcttttttgtttcacttcaggagccttcttggaggtgttaagaaggcctaggtctgccaacatggcctctgagccactggtagaaccttcaggaatgagagaggtgagccattgggcttggggagaggtgaagtcagcaagtgcatgaggggcctgggctaggactcttctcatctgaaccccacaggcacaccctgactgttccatataaccacgtgtagatctgtctcattctttcagtacagttatgtctcattctttcagtacagtttttaggatgaattgcttttaggatgagtatggttttaatcatattgtgctttgggagatggtggaacatctgggtagaaaaaacattgcctaggcttcctgaacttgcctgatcgtaagaatcatttgggtatttgtctaacaagctttccagctagggcagtgctgccatacgcagttggagaaccaggtctagggctccagcgacaggactgcactgacagatggaagctccactaatggtgctagttaaaggcctgagaatagacagagcaggcaagatgcctgagaaatgctgaagtccaaggatggagcccactaattcccatacaagcttcctcccccaacccctcccctccagagatgattgcctcctcttgcaatcgttggggtcacatttccaaagcatgtgcagctttgaatatgaaaaccctccctaactggcagcacctgggcaaattcaaatcacatacttggacataagactcctccttgcaaatgggaaggatgattggaaaaatgtgattccagaaaccagatctggactgaactgaaattgcctgaaaaatgaaagcactggcacaattaacaaaaagggactggattcctttatttattttatttatttgcagctaaatcctacacagcttgcagaccttgggagacagccatccttttatcattcctgatatggacttgaatttctaagaaatgacttttttaatggtctgtggaattgaactcctactagaagcggccctaggactcccagtcacaatgttttaagaacaatcctgagacaagagcaggagctctgaggggccttgtgtgcccacagacccatgaagccatatgctgacctcatattggtctcttcaggtgtcctagaaaacccagctctgcatctaactcaccctctgcattgggacaaggtagagcaaggcccaatgtcattttagggacccacaatggcagaggactgcattggcttgtcacactgcctgaaatgttcacatttcagtgtgaagcactgacgtcccctgtcttctctaaatcaaagtgtctcagaggtaaagacaggatctctaatttttttaagacaagcagcttttcacttaaggttaaaaaccaaatggagaagggtgggtagtgatgtgtctggtttttgttgtaagcctggagggtgagcaggtggttaggagagggaagggtgtcaagaagacccaggcctgccaacatggcccctgagccactggtagaaccttcaggaatgagagagatgagccatcaggcctgaggagagggcctggggagagtgtatgaggggcctgggccaggactcttctcatatatggccccacaggcacacctggactgtaatgattgtggaatcgggaagccatcaccacagtttccaattccttaccactattattaccatgactgtgctgagtgcatgtgctttgaattttcagtgagcctgctagcccagggacacttccacctgcgctgttatgcagtgacacagactgatggaccacagtagcagagagcagccgcggacctcacatctgggggatcaggcctcaaggattttgcatgacagtttattccagctctgccatgtctcttaagaaatccacagttttgattttctgtaactgcccccacccccgcccatgcttttaaaaacacatattatgtgccagatgctagagtaagcatattggatatatcatttatttaatcctcaccacagcactgtgaggtagatgttattgttaaccaattttacagatgtggaaactgaggcacagagagattaagtaacttggccagcactgctctgctccagcagaatttctggaagtcagctggccagctagactctttcagattacttttcctcacccaagcccacttctgaattttctctccctattgattcaacccctgtggtgacaggtttatcttcaaatgaggtttcctaggatagccctgctatggagtcaacctgaccaagggccagctgcaccactcacctgggagcagttgcctgtagaaccagagaacagaaataacaaacttcactagggttggccgcaaaccacaagatcctctagaaggaccccaaaatgtccgtgaagaccaatagtcagattactgaccatgccgccagagaagaaaagggcagcctaccaactatccatcctatttgagccacgtgacttgccaacgtgggtgttttctgaggaaaaccttcagttcacccagcaattccagcctaagctcttttccgagtctgcctgaactaactagatatttgcctctgggtcactgtaacccaaaaaggcttaattaaaatcaggaaataggctcaagttcctctgctgcaatactataaactttagataggccaaagtaggctgcaaggacacacagggataaaaggtactttggatacagcacagtcgtctgggatactcatacacacacccacatgataccctcctccccccgtagaaattaagaaatgagaaaaggaaagtatttggctctaggtgagcttcctttgtaaaggctggagacaatgcatttgtctactgaacacattttgtctgggtatgggggaagcaatctctccagcctgagggtctcaggcaggacttggcctggtgggtgactggggccaagtgggggatgactggcaggccgagggcatgaggaggacagaggaagaaaggggggaaaaaggtgagggggtgagagactagaaagtgaagggaacaggcacagaagggagagaagagggacgccagagatgtttggagtagggacagttgggagaacccatggcgctgacagctccgcatcttgataaagtcatttcctgtttatcagacatcattagggcattagagttctcataccaaagatttatccaagagtagacatttggcccctttgggtatcaatccttttggaactcagtttcatttttttgttgtttttatttgtttatttgtttgtttttactgtgaatataccttatttagtcatttttgtttacaagtgaaactctgggaattcaaaattaacttcgttacctatgagcttcttaaagacaccagaaaagtttcaaccttgtgtgccacattgttctgctgtgctttgtccaaatgaacttttgcgaggcagctgccatccagtttcaagtggattctcttgcccacaatttcacttggaaagaccaagtcctcaagatcgcatggtacgcagctatcagagtacagctcctgtgatgcttttgcttattttttgtatggctttttcaagttggcttaggcagaattctcctctgagcaataaagacaacatgcttctcactgaactttttctccaattcacatactagccagacttggattttctgggaagatttcagtcgagaaacaggaacaaagattatgatagctttctgactaccaccaacttcagtttccttggctgctgtgatattcagctccctgagctgagccttgaggtccacgttcatctttggctccagaagagcctgggagatgccgaacttgaacttgtctggcttcttgccgttgggcttcgtgatcctagtgttcaaactgaacgtggccttctccttgctgagtgctggcttaggaagaagcccaagtctcacagtttgggatagatagcttttgaaatgtattcacactccactgctttctgaaactaaacatcctgagtcttttttctggaaacagtggtaaaagaggcaaggagtttgcttgtgaatattggtttcattctttaaatagatatttgtttattcagggccttctgtgcactaagcactgtgttgggtgctgtggacacgacagacctggagccttcttatggaacttgttctgcctataatttggcccattttgagggggtcagagaatgaacacttccacttcctaaactgtgctgggctgtgatgcagtgaggtctttgagggtctcgggaataagtcgggttgtttacccttgtaataaaaggctccagattgtggtgccgagacttcccagtgtcagctgtctctccgtgctgctgtcaccgtgttgtttctgtaggagcagaaagatgtgatctctttcctaacccatcataagggtcatggccgacactcctataacaaaagacagttaacaagagaaaagcatttaacaaatttatttaatcaaagttttacatgacatgggaaatttcagaaatgaagacccaaagacccagggaaaattgagtatttttatgcttagattctataaagaatgtttagaaatgtgattggataaagggtatgatctaatggtaatagactgaaggcagagggtacccagtaaggcctgtctgtttagattcttcttggcttttctgtgtagcattccttcctccagggtatagggcaggaactctctggcatgagggtctacaaggaagaagtgacctttctagattgtatgggttgccttgggggagagaggttctagtttctgtgattccccccggggcgggagacaggagggtaggagaaggtcagagagagactttgcttctgaggtggcttctgagaccttccagtctcctttagttcaaagtactcagcatgccaaagcgccatcgtttgggttaccattttctgaggcccagcacttcttatctgccatgttatttaacacatgtttgcctaggctagggccttacagtggcttttctctcccacggagtataaagtggatgtgttttgtgataatggttggccatttggatgtatttcctcttcattccacatggttgaggttgctggaagtatagcttccaaggaagtggtgacttacattatagtatagtcagtggcgtgctggcctccctcagttgagcagggaggggaatgctggtttatagtgtttgctgatttccatggtgtaaatgctcccaccatggccaatttcaagctcccgacatgacatcactgaacaaggagtccggaatacatgtgcaacagcaaggcatcatagcgtatttccaccatacagatacaatagatgtaaataacctcaaaagcataggtaacagtaagtgtagtaaaataattaggaagtgatgagttttgagtattcattagctttgtcttttttttttttttttttgagatggagtctcccactgtcacctgggctggagtgcagtggcgctatctctgctcactgcaacctccacccaggttcaagtgattctcctgcctcaacctcctgagtagctgggattacaggcacccgccaccacgccctgctaattttttgtatttttagtagagatggggcttcactatgttggccaggctggtctcaaactcctgacctcatgatccacctaccttggcctcccaaagttctgggattacagacgtgagccactgcgcccggcctgctttgtctttaatataacctaattgtaagtttagatcatttcacttttaacaatggctatatttaacaaactggcccacaaaattcatgttgaaccatcgattctcactatctgggtgagtgtggtcctgcctcacttttctcttagcttaagcagtagagagtctgagtaaactgggtcccaaggctcttgcccccactttaaccagagcagccccacttgtattcatttcgtacataatggggttctgtgtttgaggagagggttccaatgttttttattttttaaccttttttttttagatggagtctcgctctgtcacccgggctggagtgccatggcacaatctcggctcactgcaacctctgcctcctgggttcaagcgattctcatgcctcagcctcctgagtagctgggactacagacatgtgccaccatgctaggctgatttttgtatttttagtagagacggggtttcgccatgttggccaggctggtcttgaactcctgacctcaagtgatccacccacctcggcctccccaagtgctgagattacaggtgtgagcacccagcctccacgttttttaaatgtttttttaaaaggcattggtatagatggtctatgaggttccttccgtttatggtatcttaagttagccatgtcttccattttccctttcattcccttgtcccctcttgtcactcaggcatcctattcctgctattcccagagatcattttgtcccatcccaggctctccatcttcactgaagagatagctgttatcagctgatagggttttaggtgatattcctcccaggcgtattttactcttcaacacatgactccagaagacacataaggtctttcaaataaaaggaatgaatttttaaaagctgaaattccaggcagggtgctgggggtgaggggtggggtgctatctgtactcagtgcccttaaaatcataacactgaacagtcagacctgattctactttgcagtatccttcaaaaatctcttgatttcgatgggttgctaggttacccccaaaaaactgcccaagggtgtatctctatttttctttacacaacacagttttcctgcagtgaaaactgaaaccttattctagcagatgtttggttcgtcttcccctgaatgcaaagttttcatccatggaaatgatagagaggctgcaaaggttatggatatgacacaatcctttctgaaggcaaattcaccctctttagcatgccagaaaaattatttttccaggaaaactaaacactaagcacatgcttggatgttcctttcaagcaagagaggagccctttctatcccattaaggtcaggcaattgcccaaatgatttgcttcactgcctatcataacggggagtgtgggatggaaccagcaggtgtttactctcatctctctccatccagcaggctagccaagcaaagttcataggcacaggcaccctctgaagcctggagtcagagaggctgaggctgggggacactcgggacccctccaacacacacacacacacacacacacacacacacacacacacagatgcatgcatgcccacacatagaagaccacaacattccctcagttcaacacagcagctcatgagagtcagtattatggaagcaaaagtagagcagagcagtggaataagatgcatggaacctggtggcccagaaggccacgggatggggcacaataatgagcttctcggccagctgcccagtctgctgggtgcatactgttcaaatgtagataggatagccagtggcccaggagctgtgggggacaagagggctgctatttcctgcctacacggctaccttcggaggcctggggtactttccatagctttgcttctcaggttctgtccccacttctgacaccagcagcaacctccctttggccccattttgctgaggacatggctcactatctgaaagcttcaactgtaaggaggtacgtatgcatgcccaacacacaaaacagacccaaagccaaactctgtccagttgaggccagcttaggcaataaatcttgctcaattccctggtcagaatacctctggctacctctgcaagcccggtctagtcttgatccagggccgtttggccaaggtccctgcacagtcggcactctttcctcttccctgtccaagctgagctcactctcccctggctttccccaaagtccttcactttcagaattggaatcttttgaaccaaaactttctttcttacaaaaatatcttctctaactctcacctctagccttccattctagatttctaggttctcttgtgtcttctaacacttgaattctgagggaatttggtctctccaggggaagcagagaggcactccttatttatccaataacattcagtggctaattatcatttatagaccatcgtggaagtcatcaatctcagagtgtgcttttcccgtatcacttgctcctgatgttggagagagattcgaaatctaaatgtaagtcaccagcaaaatactgtcttttcaatgcaccaaaaggagggaaagttagcttatcttgtagaatccttcaaagtactgtgaactagctgagtaagggtaattagaaaacggaaaagggaagtcaaggacaaactcccatgtagttggagaagtctcacaataaagtaaaatttcccaagaattgccggaaagcaagtcttacaaccactgggaaatgatgagtccaagaatttcagaagagcctccacccttcacctggccttgaaatcaccaaagagctcctactgctccactccaggctcaagaagcaagctgcttttcattgctactcttcaaaatgtgctcatatccattatctcatttgattctcaccatgaccctgtgaggtaggtaggacagatattagttttccccggctcacttctggaagattcccaggagtcagattttgcacaattgtaagttgacaggtttggctctatttgcacatgctaacaaaatctggcctggtccaaccgtatgtaaagggaagatttgtcatgcaacattgacctaagctatgcagagagaagcctgatcatcggggaaggggactaggggaaatttcttgggaaatgtaataattctactcctcctttcccttcctgggcctaaaaactcacgcttgaatgggaaggcttgcattatcctcaagctactcaaaaagtttcttgaagactggataccaaggccaaattcctatatatttagctatatttgatcaaccttaccaattaatcaactgtacatcgtgggcccagctcttgcagggaggaagagacagagaagtaggagatcagagtcaatggatcctgacctccaaaagcttacagttttgctgggagctaaacttgtacacactacacaacaatgcgtagcagccaaacaaaaggaagagaaggtcagagagggttgaggcagccaggggagacatcccagaaagtcagaacagaggggtggttaggagcatgacctctgaggttgggcagtaaacatggctttgaattccagatctaccattatcagcaatgtgaaccttgagcaaatcactatacgtgatccataaaatggggtgaaaatgaataagtactttaaaagttgctgagaagattaaatgagcacagtatggtatccattatctcacttgagaaaataaaatttggtgctgtttaagctaaccattaaaaatggggaagatttggagacactcagggggagagacaggacaatacgaggcgctgaattaaacaaaggtactgaattaaaaaggaaaggaggtggatgaggatattgagaatactggtattgctaaagcagagagtacatacatataaagggagtaggagacaataaactgtgttagattgggtgcagcaagatggcaaaaggctaccaactggaggagtttagactggatatgataggaagggagaagccaccagagatttttaagcaagagagtgacttgacgatagtagtcttcgaataggattggcctatggagcacttgatgacttggagagggactggaggatatccattgtttgaggcatgagttgacatgcgcctggactagagacatgagagtgagaatagaaaacatttgaaaagtattttgtaggaaaaactaaccagatagagtaggtaattggatatgggagatgaacaagaaggaagagtccaagagtcttccaaagtttttagtctaggtgacttcaaaagtggtggtgccattgttcttgcttataagtgggacctgaacaatgaaaacacatggacacacggagaggaacaacgtacactggggcctgtctcgggggcagggggaggagagcatcaggataaacagctaatgcatgcagggcttaatacctaggtgataggttaataggtgcagcaaaccaccatggcacacgtttacctatgtaacaaacctgcacatcctgcacatgtatcccagaactttaaattaaattttaaaaaagaaagtcgtggtaccattgacagaaaaatggaagtcaagaagagcagtagacatggaaggaagatgatggactcaatgttcaatttatagaaatgtctagaaaaaaagttgatactggaataccctagagagaagaatttccttcttttacttcttttctgacagacacagacctcattttttgttagatgattatattatctgcaaatattgacaattttgtttcttcctttctgatgctattaattctattttttattctatggcattggcttggagctctagtaaaatgttgaatagcagagtagcagtagaaatagacatttctatcttgttcttgactttaagggtgaaaacatctaatatttccaaatttgttaacaaacacttgtgtattgcttctgtgtgtgaaacgttattatgaacactttacaaatattaggctatttaatcctcctacaatgttatgaaatagatattattattattattattattattattcctcttttacagataagaaaactgaggcatagaaaagctaagtaacttgcccaaggtcacacagccaacaagtgttcaaagctccactgcttagctttggagactgtgttcttaactaccctgctacacttgctgcctctttttaagtatgaagttttctgtacctttctggaaagtactttttatcaagttaaagtttccttgtatttctaattttcttagagctttctaagagcaaatgagtactcaactcagttttatcaaacatttttgctgcatctattgaaatgatcatattatcttttcctttattatgcaaatataatgaattacattggtatattttctaatggtgaaccagccttgaatttctgagataaaccctacttggttatggtatagtcttctttttccaaagtgcgagatttgatttggtaataatttatttaggggttttgtatagagttagttttcggtcctcatataatttggcattggtgttatgatagctttggaaaataagttggaagtttctcatcttttttaatgctctgaaattgtttgtttggtaaagggattatctgttccttaaagctgttgtacactttacctttaaagactacttgtgtgtgttaagggggctgaggtgtacacatctttgattctatttccatttcttctctagttttgttgatacagtcagattttcatcttgctctcaagccaattttggtaaagtatcccagaaaattgtctatttcatctacgttccaaatttactggtataaatattaatacaaaataccaattatttataattttatacctgtaccaggacttacacaattactaagaataatattctcttatactttttaatatagtcttttttatttttattttttgtttagtcccacccttcatatctgatttttaatatattctaaatacagttctgtcctctctctctctttttcttcttcttctccctctccctatccttcttcctctccctttctctgcctctttttactcttgagtggttgttgatgtgttttgtttgtttgttttgtttcgtttttagcaaacttgctaatctttgcctattttcatggtcttcccaaagagctggcttttgcttgtattgatcaacatttcatttttgatgattgtgtattttgtaagtttttgctttaatctttcttagcaaaccttactcctgcaaagctcatctgtctagaatatcctttcccccttccctttcacttggctgactcctactcattcttcagtttatgcatcatgtctttcaggaagccttccctgacacttcagagtgatttaaatgctcatcctctgtcctcccccaacaacttccagacctcatcattccatgttataattagctgtctgctttatctctcttccctattagactgcaaattccttgagggcagggaccgtgtctggttcataattgtacccccaagctcctaacatagtattaatatttgccatccccaataggagttcaaatggaaattttattggaggtagcaacccacccataagctggtaggtagatctcacaaaggagctcctagtacagtctgttgcctgaagtttggggtctttttttaaaaaggaaaaaaatacccttggtagctttagtttcttgatttttaacataatcaaatcccttcaaatgtgtcattccatggtctgtctaccctttggggacgtgttctgcgcattctacctctgcactccagcatggatctagaggtttcaaccccaaagggcacaaggccaagagttggccctaaaggagctgagactgactagagttagagtctgcaggctgccccagggcttctttatttcaaagcagcttcctgcatgaaagccttttccttctctgtagttaaggttggggtacctcacccccacttccactcctcttgtttccaatctcatctgaaacacctttccctctatgttcatctttcctctcaattccctccccttatttgccattgactctgtagttttttattacttgtgtccaggaggtgtttcgagaatgtgaactgaagtagtagtttatgaaattggcaacatctgtgctctgctgccctcagttttcttctggaaacttatgtggttagcactcaggtccaaggaaagcagaacacagaacgaactgaaagagaggcatacccaaatcatggaacaccatcagcatcagggctggctcctgcccacgtctcagctcccacctccaccctaagctacaggctgatagaagactatttctagagacaaacatcaagctggtgactgagggttttcctgctcactgtgaatttacttcctgggaaagatggtctcacttcctcacatcatctgggttcctctttgaggaaggcatcatgaaactgaaatataaaaacacttctgaaagaaaactcattctgaaattgtagggaggtcagagaatacaggacccaaaggatacccactctgtgctacctgcctaagacagaactaaggaaagagagatggctacagggaaccatgcaggctcatggtggtgctaggaaaaggtaatggactgatgctgccaggcagcctatctcagtcttttctttcttctttcttcttcttctttttttttgtagagatgggatctcactatgttgcccaggctggagtacagtggtgtgatcatagctcactggagcctcgaactcctgagttcagtgatcttcccacctcaaccttctgagtatctgggattacaggcatgtgccaccatgtccagctaattaggtttttatttttttattttggagagatggggtctcactatgttgcccaggctaggcaaactcttggcctcaatcaatcctctcgcctcagtttccagagtagctaggactacaggcacatgccaccatcgacagctaattttgtacttctttgtagagacagggtctcactacgttgcccaagctggtctgaaactcctgggctcaagtgatcctcccacctcagcgtcccaaacctttgggattacaagtgcgagccactgcacctggccccattactcagacctttctaaggttgttttgttgacagcaaatgtgctccaggcactgtgctgggctctagggatatagcaaagaacaggacacagttactgccttgaggagcttatagtctggtatctgtgtgggacacagtgtccacatttggaactttcctggctactatgctatctggcaccttgacttgaatatgtaccatctcttcagcattttcagtggccccagagacagaaactgcatctcatttatctgtacccccaacatctagcacactacttaaaatatggtaggtacccaataaacatttgttagatgaataaaggaaggaaagaaaggagaagggaaggacggaaggaaaaagggctagatgaggtgtcccagaaatgtttcatattgactggagatgatgttgagtaactttcataggagccaatctcagggaaatgcttgagtccctgatgatcattgattggaccccccagaaacaaccctcccagtcaagatgtctctgaagcaactagaatcctgaagcagttcccaaagtcatgggacaaaagctcaggcatacctaggtcagcttcacagatgctagtgactttgaattggtcacttttattgtagtgtttattcatccttgaaggtattaaaataatagggtagaaaaatagtttgatggttcctcaaaaagttaaacatggaattaccatatgaccccacaattccacttctaggtatatactccccaaaaatcgaaaacagggactcaaatgagtacaagcacatgtgtgttcacaacagcactactcacaatagccaaaaggtgaaaacaacccaagcatccatcacatggtgaatagataaacaaaaaaatattgtatatctatacagtggaatattattcggctataaaaaggaatgaacttactgatatggattacaatgtggatgaaccttgaaaacattatgctaaaggacagaagccagacactgaggcctcatattgtatgattttatttacatgaaatatccaggataggtaaatttgtagagttggggcactgatgatttccagagtctgggagaaatgagaagaatctgcttaatgggtaagaggttttactttggaatgatggaaatgttttggaactagatagaggtgatggttatgcaacatgtgaatatactaaatgccacttaattattcagtttaaaatgtttaattttatgtgaatttcacctcagttaattattttactttggaaaaagtcaaagtagaacagcctcaattctgtggacaaactgggtagttgtgggaagggtagactagctgggtgtagagtgggaactatttccttccctacccaccaccccaccactccccaatgcttgttcctttcttcagctaagtcaagtgtttattcctatctccattcctgttcatatccaagaatcatctggaattattcttaagaatattctacttctctaaggactgttcatcagaaaaaggcagttgtaatttattgggagtccttctaagaaaccccaaatatcaaagattttaggaatatggaaaccatcatgtagacctatgtcagcttaagaagatggccttttgaggagagtcgtcagaaaatgttgatgtagccaaggtgatgggtgcatacaaaatgctgggtacctgggggatgctaggaaatgcttgttgattgactgattccttgattgagtaaaaaaagacatttgcattatcctaagtgaactaacacaggcacaggaaaccaaatactgcatgttctcactgataagtaggagctaaactttgagtacacatggacataaagaagggaacagcagacactggggcctaactgagggtggagggtgggaggagtgtgaggatcaaaaaagtacatattgggtactgtgcttattacctgggtggtgaaataatctgtacaccaaactcccgtgacacaaagtttacttatataacaaacctacacatgtactcctgaacctaaaataaaaggttttgtttgtttgctttttttttttttaaaaaagccagcaatggcaatagccaggaaggcacacccagcagagggaatggcaagagtaagagcaggaccaaagaattataccacccggaattatgctgcagatgttgacacagcagagagcttcaggagaaatagaggatgggaatctttctttacctaactctgctactgagatcctttggaaaagtagtgatgaaatgaaaaatacaaatatcaaggcaacaaaatctgaaaaaaatagaattagtgctgaaatataattaactgattttctatttgaatcatcgtatgacattcatagaatacttgcatcatggaactatttataagatttttctgctaatagtcaacacctcaacaactgtcaactcactttttgctcattcacaaaaaaatatcttagaaaacttaaggagaacaactctttagtctaaatggcaagtcttgttttataaaataatatctcaacatagctgcatgtgaaaaatggtcatttttaagcagtctttgtaaaagtaacaatgaattttgaagtagaagctgatgctttgtgtcttctgctatttgtgtggtcaatgacacggctactgctcccagagtaaacgatacgtgccagtgaatattttgtgcaagttaaatgttcatcatcctctttctgagaaataaaaatgcattactttaaaaacaaccaaaaaaggacatttaaacaaaggattcccctccagtagactctcgtttatgggcttcagaccacattttgtgtaagagctttcagtcatccattttttctttcattccacaaaaatttattgagcacctgctgtgttccaggaaatacagtaatagggatgcgccatcataggcatggataaaggaaattcacatacaatccccccaatttttttttcttttgagatggagtgtcactctgttgcccaggctggagtgcggtggtatgatctcagctcactgcaacctctgcctcccgggttcaagcgattctcctgcctcaacctcccaactagctgggattacaggcatgtgtcaccatgcccggctaatttttgtatttttagtagaaacagggttagaccatgttggccaggctggtcttgaactcatgacttcaagtgatccagctgccttggcttcccaaagtgctgggattacaggtatgagccactgtgcccagcctacaatcccccaaattctttgtaagcataatttcaaccctttactatctctaaactttgagcttgagtaagctgatgggcaagaacagggcaagttatggtgacgatagtggtgtgtccacaaactggaatatgtgatccaataagtatggttaatggacaacagagaagaatacttgcaaatagggctattgaaggaaatggccctttgacaagggaggtggaacagttgggggaaagcctggtcaatgtcttcttccttctgtcctgtccccttccccatgcctggaccacctggaaactatggattaaagcagtattctcttgcacccctatggctacacacacccctgggtgcagcggctgctttcccctatctccagcatagctcatgagggactccatgtgagcgctgggttgcctgaaattgagggaaagcaatctggtcagaactaagtagggcctgcttcttgttgcctatgctacagttaatccattgccatctgtctttattttgctgactcactgctttcatttgggttggcagttcttttgctgttggctgcagtctttaactgtttacggaggactgagatggatggagaattaggggctttgcattcattcgctgaatgaaatcctacccaggtactgtgggcctcttgtcgaggggctgaggccaaggcccctggattttgatggatggtggagattaagtgtagggtaacacatcatttagtctgattgcaaggccaggtttctcccaagcattgccaaatgagctgggaggtcatgcgaattgtctgcccaagcacaagggagcgtgatatcttttaattagagtaaggatgaaggatattagggaccttggtctgtcagagaacttggaacacccaaatgctatacttcattcaagtttctctttaagtttcaccttatccatggaagcttttctgcataaacttccatccccacactgcatcccatccctcctccgaaatgcacttccctgcgctttgaatctcatcagcatttggcttcaactgtatacaatcttggctcccacagccattttgaagctgcccttcagcagatttgagacccattctttatcctgtgagatagaaccttatcaagatgtgaaactctgtagcctttatagctcattttgttatatggcaattggatcctgggaaaaggtgacttggaggaagccatcattggcctttgagacctataggaattcagtagaaacactttcaggatgctttgtcaaatgacttgtgttaagatgccaagggtttgtcgtgggctcatgtaagttttaacccttttcaaggctactttctgtaagcattgtatcatttctggggtagagggagttgagggttttttggtatatctgcctactcagccttggtgtcaaccagtacttcctgggatttggggtaggaacaatagaagttaaaaaggaactttgtgttttaggtagggggaacgtaggtactggtttgctcaggatagtcctgtgttacacctgctgtcctagtgtcattatcgaaggcacatttgtgcccttcacccacaaaagtgttccagtttgtacaataaacttagctttaggcagcaccttagctttaggcagcaaatatgtaatgtacaggatcacacccagagctagaaagactacagagttttgcagttgatgagcttctatctcactgggataaagaacgggctttcaaatctgctgaaggacagcttcagaatggctgtgggagccaggattgcacacagtggaaacaaaatcctgatgagattcaaagtgcagggaagtgcatttcagaggaggggtgaggtgcagtgaggggatggaagtttttgcagaaaagcttccacggataaggtgaagtttggagagaaacttggctgggtgaggtggctcatgcctgtaatccctacactttgggaggccgaggcaggggaattgcttgggtccaggagttcaagaccagcctgggcaacatagtgagaccctgtctgtatgatttttttaaattagctagccaggtgtagtggatcacaactgtggtcccaactactcgggcggctgaggtgggaggtttgcttgaccccaggagactgaggctgcagtgagtcatgatcataccactacactccagtctgggcaacagagtgagaccctgtctccagagagagaaagagagagaaatgtgaatgaaatatagcatttgggtgttccaagttctctgacagaccaaggttctgaatatccttcatccttattctaattaaaaaacaccacactcccttttgcttgggcagataattcacatgacctcccagcttgtttggcagcaatatgttttataattatatattttataagcaagtgtaaaaaatacttgcttataaaagttgttcccttaacaacttaagattgcatggtcagactatcccagggaaagggcttctccaagccaccaaccctagaaagtatcctctaccaatcggacaggatcaaaacgtcacctccaggaattggagctctcagacactgctggcaggactgtaaaatggtgcagacactttgcaaaactgtttggaaattctcaaacaattcaacatagagttaccatatgactcagcagttccactcctacacatatacccgagagaagtgaaaacatatgtctacacaatagcttgtacatgaatgttcatggcggtattattcataatagccaagaagaggaaacaactcaaacgtctatcaactgatgaatggataaacaaaatgtagtatatccatataagggaatattatttaaccatgaaaaggagtagagaactgatatatgccacaacacggatgaactttgcaaacataatgctaagtgaaagatgccatcacaaaagactgcatcatattattccatttctaggaaatgtcaaaacaggcaaatccatacaaatagaaattagattactggttccctaggactgagcagggtggggattcagggatggaagagtgacagcttaatggtacagagtttcttttgggggtgattaaaatgttctaaaattgattgtggtgatggttgcagaactccacgaacatactaaaaaccactgaattgtgccatttaaatgggtgaattgtatggaatgtaatttagatctcaataaagccattaaacgtgtggcctccaggcataactcagactcagtaccagctacccagttaggcttgcactcctttagcaaggacatgggcactctcttccagagagctcttctcaggcttcaaaatgggcaagcatgaacttgggcaaatgcctcataagtgcaaaccagtgggaagaagccttgttaatacccataagcctttggggtttttttccccctttatagaaacatccaacccagagccacagagtccaataataattgacagacaagaaccttagagcttgcctactccaatccctctgtgtagatgctcagaaagaggaagtgacttgctcaagtcacacagctagtcagtggcaggacatggaccagaacctgatgctcctaactcccactccagtgctctttctcctgtcctggcttctccactacttccctttcccctgccttgcccaaatcagcccctttggcccttcttgctaaaatctaggagtcaagtctgagaatccaagcacaaaatcagggtgaatttacaattttggaaatatggtacaattttcctaagtagtagatcagaagatctgtattataggtcttccaacatcaggatgtggatggagtacaggatttgacccctggtacaactaaatttgtggaataatcacatgcttctttttatactgtatttggcagtattagaagagaaaaataatattcatcttaggaaaaccttggtaactgcaaatttgctggcaaccttatttcctcttgctttcttggaagaaatcaaacgaaaaagcagctgtacaaattagccctgaccaacaggctcaggaccaaaacaaaacaaaacaaaaaataataaagccaaaaacaaattaagcttaatatttaaatcagaatggaaaatatatccaactatacgcctactggaacccttgaaactgctaatctctacttgattattcacaacctgacctttgcaggaggtcaggacaaagctggggacagtctgaccgaaatgtatcagcaattttccaaactccttcatctgcattcacagattttcctgataaccctaagagcagcaaaaccattgatcatgcttgttggagtcctattagtaccacagtgaaaagaaaatgtgcttagtaggccatcagtcaacagaccctgtgtgccaggtacaatgccagtgctagggggagacaagacggggaagaaatgatgcctaccaacaggagccatacacccccaaaatagggtgaaccaggcatggtgtagggcaagagcatggggcaagagcaaagctgaagggctaggagagtagatgtatgttgaataacattgaggggactagtctttctggaatagagatttcttttgagggagttaatgggatgtttgattgaaaaagaaggttggagacagattgtggaggcaaaatggagcattttgaagaggtgagtggccagatgaaaaccacatcaggggagccttctcttcagcctcccctcaacactggttttggtattctctgggctcccacaaccccctgggccttatcctagcactttacacattttcctgtaattcactgcttccttgtacttcttccctcaaactgatttccttgtgggaacagcttacatctggttgatgcatatatccctaatgcctaacaaagggtttaacacgtggtcagcactcaggaaatgtgtgttgatgggatgggacaggacgggatgggacttgatagaaggttagatctgtggaggagccatctggaagagaaggcaggaagaggagatcagttagaaggatgttgccctgggagatgaggaaatatggccctgacccaaagcagtagcgatggtgacagagaagaagggaggatgtctgatgtattttgaaagaagaatagacaggacttgggaaccttagttaacactgacctgaggaaacaatgcaaaaggactgtggaaccaaagtaggttccccatgaggcagtgtggtaggtcctacagaccccaataggattaaccagcctccatttgcactttgtggacaattggttatgagcacagctgtacttttcatgtctagaggtgaaagggactagaccattgctgaggggactttgcccagctgtctctgtgccggctgtgctaagtccccagggagctcatgctgaccaataaggcaaagctcaggagtgatgaaccaccgtttggctgtcttaatcctaaggcctcaactcagctctgaccacctggaggtgtcacacaaagaagtccaaaataaagaagagtgtcagcccaagaaacaagagtctccttttcctagccatgcctatttcgttccaccttcagtctttctgcagctcaggaagggaggggtgagagaaaaccacggaacttttcaaaatcccattttccaaaagctaaatcagattcattctgtgtctcctgcgcagactgcattagtctgggtaatgtaaacactgtgaggccacagctgtctgccagctgcaacgttaaagcccgttttggggggcatgaaaaaacctgtctgtaactatcacagatgagaagtgttagttaatgaatggtccctgctgagtccagagcccagctgagttatttcagtcttgagccttagcagagatttttattgggtaacaaatttcaaatgctccagttacccctagaccccagattggagctcgttgctcaatccaacccccacgccccagccaaaactaattcactccagggacattcctgattgcagctcaagaatcttggtgtttggagtgttgggtgattgctcaaggaggatttggtaagggcttaataataacatcagcctccttgtgctccctgcagaagtgtggagagtgacctttttcaagagtagggccatccgtggcttccaccagggctggtcagcttggagcagcctaaggaatggtggctttgagttggacaccactgtttctgctgggccttggcttaaagctctgggttttgctggcacctttccactcctactattctttctcctcctacatgggctcaggtcaggggcaaggccaagagggccaacaaaccaccagctgcattgagacaggggctagggcccaggcctttacgtgcataattcagtggcatttcgtacgttcacaatattataccatcatgacctttgtttagttctggaacatttttatcatcgccaaagaagatccccatacctgttaagcactcatttcccatcccctcccctccctgtaccggctcccggaaaccactaatttgctacctgtctctgtggatttgcctattctggacgtttcatacaaacggaatcatacagtatgtggtctttgttgtcaagccagtattctttgagtacccactgtaatagacatgaggattcctcctcaggtgcagcagctactgctttttagaatacttagcttaatcaaggcacatgctgggtgattgatttgcaccattctgtttaatcttcacaacaactctctaaagtagataataataatgttcccatttcaaagatgagtagtccaagactaagagaaattgagtagcttggccaagatcgcactagtagttaagattccaactcaagtccttccattatttatcatgtattcagccctacttagagccagtctacttacttagaagcaacatactctcttcgtggtatgtgctgcctgccccatcttgcccgcccttaaatccccactgtgacagaccccataggcaagggaataatctcatgagccccttgtgaaaatacccatgtgttggcagggctagtagcctggtatgagtgcccctagtattcatatgcccttgggcacacccagagttttctttagttcccagagagctgaatataaccccacctccttctctcccactcatgaaagcatatgggtatgttagtgagagttatttatagagaaatctttgaatctgctcaaatttatttttaagtaaatcatatgcaagctttggtatttgattattagaaataaataataagtgaggccaggcgtggtggctcacgcctgtaatcccagcactttgggaggccgaggggggcagatcacccgaggtcgggagtttgagaccagcctgaccaacatggagaaaccgcgtctctactaaaaatacaaaattagccaggtatggtggcgcatgcccgtaatcccagctactcaggagtctgaggcaggagaatggcttgaacctgggaggcggaggttgcagtgagcttagatcgcaccattgcactccagcctgggcaacaagagcgaaactctgtctcaaaaaaaaaaaaaaaaaaaagggaagaagaggaagaaagaaagaaataataactgattatcaaacaccaacgtgtcctgacatcaaaggtgagaatttttggtccaaacacatctagaggctgcaaagagctacacctcagctcagttacctccagtttgcaggtgaattcccagatcagtgaagttctccctgaagactgaagatcggattgtgtcaaaggtctggggtggccttcatgaagcagcctcaaaggctgtgcacctcatgtctggacttttgagcagtgactctggctgcatctgacagggactctcatgtcccaaccacatgtacaagaaatcacaagggcttgacccaagttctgcaataaaactcaagaaaaaggaaaaggaaaatgtgagttgttccactgttttaaagacttcaggatatatgttttaaaaattcacaaatgggagcggcactcaggaaagttcaatggaactgaaagagacaaatattgatactcaacagtcagcttcaataataataataataataatgggaccgcctgaattcaaataaatggaacagatgttcctcatgtgttctgagttgaaaatcattccttcatgtgggatcagttaaaaatcaagcttgggacttactgtatgtttaatataaaaactctcaataaaaatactttggaggcaaaatccaagtgagggcatgctgcaatcatcagtgcaaataatcaaccagtcagcatttgcctgtaagagaccaagggatgtacatgtgtgaggatgagaattactgagatagaggtggtgatagaaagttatttgccatcacatctaaccggagctcagcatgcaggggttttctcaatgtaagtgggacttggaaattgaagctgtggtgagccatggaaaaatggaaaaatcaattattttgatatttagtggacattagaggaattttcaaaagatgggctcttagaaataaatgaaactgtcccacagaatagctaatttcaacttgaaccagcccagccccagtatgggggtggatataacgagaggactttagtactttagtctgccatcagtactccatccacacctaacatcagagctggaagacatactagaaactatgatccaacattctcacttcactgataaggaaacaggcacaggagtctcttacacatgcccagggtcatagaggaaattcatctccaggcagaattcagggaacccactaaaagaaagaggcagaatcaaaatggaatatagaaaacattgttgccctttcacaatacaggcataacattaggattctacaagaaacaccaaactggcatgccctttcattccacagtaccagctaacagccctgttcattttaaagaattagtggagtaaaacagtcacccaatccaaaaaagagaaacaccaaacaggcagccacaaagaaggtcttgacgaaaccaggaaagggtcaagggcattgggaagctgccttacaaggccaggcaggaaagattaaagcaaaatagttggggaagatgaaggcatagaagggatgtcatataatcaaagtatatagagaaactcctgaaggtcgtggatccaggggagttagacacattcatcagattctggagtacaagagagatgcacagcctttgcagtgattatcaggaaaaacagactgaaaaaagcagctttactatacacagtggatatgggatgcccagtaaatgtgaaggaagtgtgcaaaccttattctgaaggtgttgtgaagttaaaaagcattttaatgcttccagtaaaccaattcttggtttaataataacattaataatagctaccatttattgagcacttacgatgtgccaggcaccatgctgagctctttacatggttttcttatttcctccttttacctttatttcatccttttttatttcatcctacagttgtgatgtaggcactacctccatttttcagatgaggaaaccaaggctcagagaggttaactcatcttccctaagtcagacagctagtcagtggtggaacctcccctcaaatccaggtctcccttaattccagagcacagaaacactcccccatcctgcctctgtaattgggacagcttggttgcttgagactctccctctgacaaaagtggtattttagaatgttcattctggctggtggaaaaagtgaactggaaagataggccccaggaccaaggaaccagttaggaggcagaaccaatgaaagggaatgaaaataaagaattctgtgaaatagaactggaaggagaaactgacagactccaaagacgaataggatcttactgtgccaggatctgcttttgccatttaggatatcgtggagatcttcctatgataagacatataaatctgccttgtaccttttgtgactgcttaggcattcaatctgtgggagtactactacgacaaacactgttctagtgagcatgctggatatacgtatatctttgtatactggtatgtatataagatcaattccaatcagtggaatttctggcctgaaagaaacatattttaaattttgatagactttttcgggaagattttcatagttgagtgattattattttaaattaggggtgtgggagggaaccttccttggtagatatactatagcagaaataaattagttggtcatcattcaaaagtgtaatcaaaaagcacaaggcctttcataccattcctaccaaacaacatcaatgttgtcgaagctaattacaggaagaaagggaacagaagacacagtaacccttttgggaaccattttcaaatggagaactgggaactcatctctcttcattacttaattttgagggaaggggaactatgctgaagtgttgagcagctggatagctgtggctgtcatttttttttttaagggaaagggtctcactctgtcacccaagctggagtgcagtggtgtgatcatatctcactgtagcctccaattcctgtgctcaagtgatcctcctgtgtggctgtcatttaatagacagcctattgagaggcttctaggaggaagattggcaaactgaatacagggcaattttcagatataataataacaacttgattttgtttgtagttgagaaggttggctattgtttttagttaggggatttaaataacttctttaaaacagctcccaaagggaagggaaggtaaactcaagtgttattatgaagtataatggtctgtccctccaagtgataagtttgattcactgctagcagagccagttctgcttggcacctccccagtactaactgcctctggccaaaaagctaccaggccctggtgccagatcctgggtgtcatgagccaagtaagaagaagggagtagatggggagagaagatagctgaggcaagctgtctctcccagagagatgggttacaacagaatccaatgcaagcttttattggagagacctatgtgtggagacaataggcctactttttaaatttccacaaaatgaactaggtacagaataccactattttattcattcacttgacaaatatttactgagcatctactatgtgccaggtactttgataaacactgggagtaaactgttgaacaaaacagaagtgtcccctgccctcagggagcttactgtttcataggcaaggtgagtgaaaagcaagtaaacacacaaatatagaattacagatggcaaaagaaaaaatacaggtggggcatggactaagggtcaggatggtgtcgccatggtggcctggcatttagagtgagttctgaataaagagaagggagccacctttcaggctgaagggaacgtgtgtgaaagcacttttgggattcaggctcttgaagtcgctggtcaggcaggaggctccctgaaatctgctccactttttgctcctcactgtgcaaaccaaagtgctctaggctttgtggttgctcagggcacagaggaccagatgggttccagagaccagcctgaaagttccccagtgaggatgcatggtgatagcctgcgagtttcagccagttggatgaggtgagcttccaaaatattcttaaaccctacagcctccgagacccatttcccagtgatttccattcctggtcatcactttctttctgcaggggacacttgcctgtggaaaagcagtgcctcgccttggttagggttaaagattgaggcagtgctggccttcaggaaaagtgcaagcagcaatggagagagagcaaaaactgaagccaaggaagcagcccctgccaacaacttccgttctttccctttccttcggcatggctgcccaaggagcccccagtgactgttcatggtgatctgtttgtttcacaattgacaaagaaggagggagccctttctgacatttttgcccagaggacccagatttctcagtttgaaactgccaaatacgcaactttgggtggatatttggctgaatcactttgaagggcttgtcagtgcctaaaatggaaattgttagaaagcagaggagggtggttgccagcaaccatgaaatggtaatgaccaaatcatttatttttgcaatgaaatgtcatcccctaacactacaaaggcaggttttttctagcttagaagtactgactacctataaaaatcttcaaaagtgattctgtgtgccatgcacatgtacacatataccccatttctctcaccctctgccttccctcctaaaccaagcttcttccatgttcctggagcccagctgcaacctgggatgaattaagatattggctgattatgaaaggtaatcaggcttcagctatcatataaaatgaaggggagttcatttggttatttgtaagatggtatgtggctgactttctatgtgggaaagtcagtaggctgtaatagatcatgccccaaaatacgatgtggatcttttaaagatctgtttgagtctagctgtagttgcacctaggagacatgatacttaataaggtttctcctatctatctatctatctatctatctatctatctatctatctatcatttatctgtcatctatctatctgcttcattagcaggcaaattaggcaagatctcccattgtgtactttgtatttttaaatgctgacaccttttttctgagtttaggaggaagatactggaaaatacattgtgggttgacactggggaatgcaagaggatctttctttgaaaacagccattaagatactattcccctgggccaattcctgggcagttttaaccacatacaaagccccaggttcttcttctagcttttctatattgactcctgtgttaagatcagtgaaaatttatactatcatataatttattttaaagtaatactttacaagcctttggcttgaaaatatttcagtaacatctgcacattcaatactgaaaagtaagatggctccattctgctctcattatagtaggctttgagaggtatcttttctttgtatcacagtcattagtccagtggttgatcagcttctttttcaacagaagtggctttttccaaagtcctttgtgattgttgatgtgggatctattctgaaagcaggtttgctgttaaggaaggttataggaacattaccgtttagccatggaccttgatcatctgaatgtggtagctgggtgttatctcagtgcatttgaagctcatgcttatggaatccctgttatgcaaggggttggggaagcccactggaaaaagtggctccagtgtggatgaatccgtccttcagattcctttgtagggttggcttaaagggcaattataaattagtctgtgtcatttctgtccatttcccaaccttttaagagctctcctggccctcgatctgcatgtatctaataccactttctcagcctcagtttcctaatatgtaacacgaaggacttggactagacaagctacaagttctccccaaactctgacacttgataaatctaatgcacttatcagcagagaggaatgtggctattttccaactctttctttagtttggggaaactaattttatataatgttctttccctgtgtttcccttttaaaaggaaaacatgacccatttccggtgttgtaaagtcaacactttgcagctctgcacgaggaagcttctttctatgtagaaggggcacagaatgccacgggaaccagggcaggaaccaacacctgacaagagatgcaggcacatgcggcatgtggggcgggctgtccctcacaggagccagaatcatcagtactagcctcagtcctcccatgcagctggccccactcagaagcataatggtgtggagcagagatccctgagctagcattcctggattagagtgcttactagctgtttacctccagtgagttaattaacctttctgtgcctcaggttcctaatctgtaaaatacgaataataatcacactactgcagagtacagttgcaaggattagataagatcacgtgggcatgtaaagtgcttagaacaacgtgtagcacacacatattaagtgctcggcaaatgttaactatttgtccattgggctcaaatgtccaagtatggatccaggagttgaaaggttggattccacagggccatcctccctcttgtgtccaagactctttgtggtctaggacaacttttgtgagaacaacttgtatctgctctggaatagatgactttcccttttctatagagctactgtccaactagcccagccttagtgtccctgggttcacaagtcagtgataatgaccaaaaatatgaaaaactatctgacgagagggaaagtgtgctcattgagaccccagcaataagcaattgtctgccattgcagaggatttaacagagctcagacgtgaaggctcttgtagttgacaaaggatctttagaaaagaatgttccctgagggtgctccatgtctacagaggcccaaacaagagaaaacagattgtggttagacccagggaagacatttttaccacacacagataaaatgctgggccacattcccaaaacaggttatgtagtgtcttcccctggtaaattgggaaaagagtggctggccatctgtcctagattgtttcatagaccaccagagcaggaagaacccttagaggtcatcatatccaaacctctattttaaggattgagaatgctaatacacagagggaggagataattgccctatagtcatatagcaaattattagcaggaccaggatttaaatcttaggccaacacagcttgccactgcaccttagttatctcttaaggcactcaaagtgctgtcccttctagttctggaatgctccatggtatcaatgtactaaaaaagtaactgaggcccacccagaaggactcgaaggtgttgagcagtatccaaattgcaattcctctagtttacccatccgattttggagctccagctgtcaaagtgtttcagccaagcctcctcattcaactaactggtcttaacttaccatttgaaagcagctgtggttaaagcagagcttgctgactcagcccatgtagtaaggatgactaaacacaagaatttcctgtggaggggggaggagggggatggaaaatatctttcaaatgcatttgtttcagggaacccttctgatcagtcaggaggtagcccaccgtgggcccatgaggaaaagcagcaggctgtccccgctcagcaccaaggcaggatttgcagatgtttcctttcttttttctaaacaacattgtggctgtctcggcaccattttggtctggccagcatttgcacagagcttcatctgccaactgatacagcccaaagccaagcggagcagatgccttccctgactggaggggcctttcacattcctctgctcagagcccaggggtgaattggggctgatctgctttatctcaagacagtttcaattctgagcccaccttgaactcaaaagagaggatcacttatgctgaccgatcagaaaatattgtgggctggcttccatctccaggatgcaccttggggagtttgcaatctggagtaacgttatcattttcaggtctgagtaccacacggccattggacaacttcaggaaacaaacattgaccttcagttgggttgctcaccagcttaaagcagtaatccagtgaacccaaaatttgggtaaatattttaagactgttggctggaaaagagtctgccttgctcaattagaaagtggaagacacctggtgcatttgggggtgacagattttatttacaacttgcaaaatagaaaagggcagcagggaaaaagagagagtgaacatactcagccatattctgaaagccatatacaactcaaacagttcagtcattgaggattcaagtccaagaggcctgcctcaccctcatgctcacaaggagaaaacaggactaactgcctccgaggtctcaaacaagaccgaggattttcttttctttttttttttttttttttttttttttttgagacagagcctgctctgttgcccgggctggagtgcagtggcacgatctcggctcgcggcaacctccacctcccgggttcaagcgattctcctgcctcagcctctcaagtagctgggatcacagttgcgcaccaccacacctggctaatttttgtagttttagtagagatgggatttcaccatgttggccaggctggtcttgaactccagaccttaagtgatccgccagactcagcctcccaaagtgctgggattacaggcatgagccactgcgcctggccaaggatctatttttcataagcaagtaaaaatttcttcatctaatgggggaaatgttctggaacaggcaatgtggagtaatggaaaacaaactggtctggcaagaggagaggggagaaggaaggagggagtgtcccagttcccttgggtgtgaagggtgacccaagaagtgtaagctttgaagtgttatcttacttttctaagcctgtttctgattcagtaaatactttagctacacatagtgcctagtaataatgttttctgaataagtgagagtgagagagaaaaagaaagcaatgaatatatgaatgaatatgtcaagaaagtgaattaatatatgacagaatggtaaggatttgcgtagttcatggagttggtttgaagcttaaatgaaataatggttatgagttctcattttctaacactacgcttaatacattatctgtatactcactatcttatttgaatctttcgaggctcctgtgagataggcagggtaaggactgtcacctgtctgatagagggaattgagtatcggagaggtggagaggcaatagatgatggaactaggggctccgcatgcagtgctccttctaacgtaccacacaacctcttactttcagatgaaaaaggtttttaaagaagaaagttctataggaccaccacataggatctatgacttacaactaagcaccttttatatgagggcttaaacactggaagtgggcttagaagaagaaatatcaggctaggactaacaatgctattgaagattatggtaagaacttgtcaactcaaaatacaagaggccagggggaaatggtgttggaatgacttgggtttggattatctaatatttttgtaaaagaacaatgggacctctagttggcaaggaactaacagttgctatttgaaataacatgggccactataagaaggttgactgtagactcaagtaagtcagccagtatctacttagtttgtcccatcaggtgtctggcctttcatgaagccataagctgtttagcaggaacagacttgtggtctgagtcttctccaggtttacatgggtcttagaacctttgactcatgatactgaatggtgctgtttaataaagtcatatagtctagtccccatccagtaaagctattcctatctgatgagtcactgtccaccctccagtgacaaaacaaatgaacaaacaaacaaacaaaaaacttactgcctactgtacctatagtttccagctttctgttctggacagttatgatggtcgtctgtgccatcatcatttctaattgcatggggcactagggaaatagagatatgttcattgtaagtgtacctcatgcaggcaattagacattgaaaacaaaattttcataaagcaaatccttatttttgtgccctagatcggcttgttatttaaagaaatcattgatctctagtttatcattttctaaaacacagaattaggttttctttttcttttcttttttcttttttttttttttgagatggagtcttgctttgtcacccaggctcaagtgcagtggcgcaatctcagctcactgcaacctccgcctcccaggttcaaacgcttctcctgcctcagcctcccaagtagctgggattacaggcgcatgccaccatgcctggctaatttttgtattttcagtggagatggggtttcaccatgttggccaggctggtcttgaactcctgacctcgtgatctgctcacctcgccctcccaaagtgctgggattacaggcatgagccaccgcgtccagccagaattaggttttcttaatgcaggagttttaaacatggggtctgttgctcttggactagctatgggaagctgggtgaatttttctgaaactatgtgcagaattgtgtttttgcttttacatacttttctgagaggatctacagctttcctcaaattctcaaaagggttaacacccaaaaaggtgaagaaaaactgggtgaaaaaaatggtggaactataattgtgtttgtgagtcctaaagtatgcagcttcaactgcaattttttaagaaggtggctttgtctctgtcaattgcatggtctggttctcttccttctgctgcctctgaaggataggtacccatgggacatagtgccaagctttgactttttctctgtcgtatttgcagggtattaaccatgctaataggagttgaatggcaattgttgtagactaaaataaggtattatttgataacatttctaattccttgtcctcagttgtcaaccccagagtacagcctataaggcagacatctttgttgcatgacttcagctttagaatcagagagctctgtgaccttgggaaagtcacttaatctctctgagcctcagttttcatctggcagatgggaataataacagggttgttgtgaggattataagtgagatgatgaggctgggcatggtggctcacgcctgtaatcacagccctttgggaggctgaggtgggcagatcgctggagcccaggaattcaagaccagcctaggcaacataacgaaaacacgtctctactaaaataaaaataaaaataaaagattagccaggcatggtggtgcacacctgtagtcccagcaactgaggaagctaaggtgggaggattgcttgagcctgggaggttgaggctacagtgagccatgatcgcaccactgcactccatcctgggcaacagagtgagaacctgtctcaaaaaaaaaagtgagatgatgtatataatgtgctggaaacatagtaagtgcttaataaatagcaatgccaatggtacctgtgctgataagcaagttcttaagaagatccaaagctctttcctgaggatatggatagctctgtctgggagctaccttgctgcccggggccatgctcagtggtccatccatgggcatgggaacaaaaacagtcggacctttgtcactttattcaaaacatagggtttggcctgttcaacacttgtactctgctagaaactgttgaggagccctgaaaccatgtttgactattaaacccagaagttctatgtagggaaaagggaggaacaattggtgcagtcacatcagctcaaaagttccagtcggtgctttgacccagcagcaataatagtgtccaaagggccttcccatccctgttctcattttatcctcaaaacagccatatgaggtaagcagagcaggtgctggagaagccacttattgcagcaatgatacaagcaggtccagaagttttaaggactttgtgaaaatgcagtggtttgtaaataagtaaaattcgtgtgttagcaggaaatgtttattgggtattcgtttttgaatattgagtttattgagtataactgaatatagcacagagctgggcacatggaaaggcttatatagtcagattggtgtggcaagaattccatgacaatgcatcaaaaagattatatatcatgaccaagtgggatttatccctgggatgcaaggtgagtttaacatacacacatcagtcaatgtgatacacctcattaacaaaatgaggctaaaaaccacctgatcatcttaatagatgcagacaaagtatttgacaaggttcaacatcctttgttgatacaaactctcaacaaattaagtatagaaggaacttacctcaacacagtaaagaccatttgtgaaaagcctgcagctaacatcataatcaatggggaaaaactggaagcttttcctcctctaagatccagtactaggcaaggatcccaatctcgccacttctattcaacatagtattggaagtactagccagagcaaccacacaccttttttgaaaggcatccaaataagaaaggaagaagtaggccaggcatggtggctcatgcctgtaatcccagcactttgggaggccgaggcaggcagatcacttgagttcaggagttcgagaccagcctggccaacatgacgaaaccctgcctgtactaaaaatacaaaaataagctgggcatggtggcttgtacctgtagtcccagctgcttgggaggctgaggcacgagaatcgcttgaacccgggaggtggaggttgcagtgagccaagaacgtgccagtgcactcctgactgggcaaaagagccagacccagtctccccacccccccaccaaaaaaaaaaagaaagaaagaaaagaaaggaagaagtaaaattatgcctttgtagatgacgtgatggcggctgcctataatcccagctacttgggaggctgaggcaggagaatagcttgaactaaggaggcgaaggctgcagtgagtcgagatcgcaccactgcactccagcctgggtgacagagcgagactctgtctaaaaaaaaaaagtgatattcagatttgatgtaatccctatcaaaattccagcagcatttttcacagaaagagaaaaacaattctaaaatttgtgtggaaccacaaaagaccccagatagctgaagcaatttttttttgttgttttgttttttttgttttgagacggagtcttgctctgtcgcccaggctggagtgcagtggcgcaatctcggctcactgcaagctctgcctcccgggttcacaccattctcctgcctcagcctcctgagtagctgggactacaggcgcccgccaccatgcccagctaattttttgtatttttagtagagatggggtttcgccatgttagccaggatggtctccatctcctgacctcgtgatctgcctgcctcggcctcccaaagtgctgggattacaggcgtgagccactgcgcccagctaaggtgaagcaatcttgagagggaaaaagagagaaagttgggggcactttctgatttcaaattatattacaggcaggtggtccagtggctcatgcctgtaactccagcgctttgggaagccaaggtgggaggatagcttgagtccagaagtttgaaaccagcctcagaaacacagcaagatcctgtctctacaaaataatttttttaattagctgggcatggtggtgcatgcctgtagttctagctaccagggaagctgaggtaggaggattacttgagcccaggagttcaaggttacactgtgctatgattttgccactgctctctagcctgagtgatgagcaagaccctgtctcttaaaaaaaattatattaaaaatctatagtaatcaaaacagtataactctggcattaaaaaaacacatagaccaatagaatagaatagagagcccataaataaacccaagcatacacagtcaactaatttttaacaagggtgccaagaagacaccatggggaaagggcatctcttcaacaaatggtgttgggaaaactggatatccacattcaaaagaatgagattagacttttataccatacatacaaatcaactcaaaattggttaaaggcctacatataagacctgaaaccataaagctagaagaaaacctagcagaaaagcgccttgacattagctttggcaatgatatttcagatatcacaccaaaagctcagattacaaaagcaaaaataaagaagtgagactacatcgagctaaaagcttctgtacagcaaggaaaataatcaacaaaatgaaaaggcagcctacagattgggggaaaatatttgcaaataatatatctaataaggggctaatatccaaaatatgtaaggaacacacacaactcaatggcaaaataaatcaataaataacctgatttaaaaatgggcaaaggatctgaatagacatttatctaaagaaaacatacaaatagccaacaagtatatgaaaaggtgcacaatatcactaatcattaaggagatgcaaatcaaaatcacaatgagatatcccctacatctgttaggttggctattgtcaacaagtcaaaagataacaagtgttggcaaagatgtggagaaaaagggacccacctgtacactgctggtgggaatgtaaatgagtaaagccattgtggaaaacaggatagaggttcctgaaaaaattaaaagtggaattaccatatggcctatcaattccccttctggatatatacccaaaggaaatgaaatcaacaccttgtagagatatctgtcctcccatgttcattgcagcattaatcacaatagccaagattcagaaacaatttgtgtccatggatggatgcatggataaagaaattgtggtggccgggcacagtggtacacgcctgtaatcccaatgctttgggaggccgaggcaggaggatagtttgaagccaggagttcgagaccagcctgtgcaatatagtgacaccctatctttacaaaagtaaaaaaaaagaaaaagaaaaaaaattagctgggcatgataatgcacatctgtagtgccagctactcaggaggtggaggtaggaggatagcttgagcccaagagtttgaagctacaatgagctatgatggcaccactgcactccagcctgggcaacaaagtgagactctatctctatataaaaaatgaaattgtggtatgtatgtatattgtgtgtgtgtgtgtgtgtgtatcatatatacagaatactattcagcctagaagagagggtgatcctgccatttgtgacaacatggctgaacctggaagacattaggctaagtgaaataaaccaggcacagaaagaaaatactgaatgatctcacttatatgtagaatttttaaaaagagctgatgatgtacagcataaggactatagttaatgacattatatgtaatttcctaagagagtggagtttagatgctcttaccacacaaaaaagtacttatgtgaagtgatggatatattaatttgcttgattgtattattttactgtatatatatatacacatcatgttatacacctcaaatatatatgcaataaacattttaaaagaatatgtgaaagtaaaatcataagaaagtataactagacactgggtggtctggtacagctaagagctgtgagactgtagcaaagggaagatgtaggtcggttgcaggatccagggaaggcttcctggaggaggtgggccctgggctgctagggaggtggagggaagcagtgtggcaggcagataagcaggagcatagaggctgggatgagcaggctgggggaatggaggggctcacacagtggtcagccggggggtcgctttgggaaatagtggtaattttgattaaagaggttatggaaggcattgattgctcaaacaagggaaggggactggacttgatttcgtaggcggtgaggggctgtgaggtatggcaacagagcggcaagaaaaggcagtggagttgggagagtccagctgggagccaggagtaagaatctagccatcaatgatcagagtctgggctaggacgaagccatagaaacagagaaaggggaaggatgaaagcgctcactggtctctagagcctttgcttggagtaacacaaagacctttctctctgtaaggagcaagtccatttttggtctttatatttctacagcatgagaaatgcctctttcatccaggagcacgtgccctgcttgaagaaaaccaggcaagacagcttgcaaaggagagagcctgggagatgacttttcatgttgcacaatggttcttcaccaaaggagtcacagagggtcttttgacatagacactgccctaacttatgtgcaagttactgccctgcatcctagggaggctttggggtgtgggatgacaaagtacctccacagtccccttcctccgcctctgcccatagttctacttgatgtaacaggtcttgtgagtcttttcaggtgggaaaatgctctctcagccttcacaggtcagtcatgaacctgatcccacatggacacaattctgttgacattttagcatgaaaggtacaaaagggaaatctgcaaaggggtctcaggattcagttccctggatcgtcctgtgcatttctttctcagatttgaggtttttccttttattttggagatggggcctcactatgttgttcaggctgatctggaactcccaggctcaagtgatcctcccaactcagcctcccgagttgctggggttaccagtgttagccacccaacccatctcagatttgagcatttctttcagaaatatgagtgaggtggtttcatgtggagacccctctgaggctctgaagcatcatttctacctgctatgtgtgcctgagaaacccatgcctggcccaatccccatataccctcaagtacaaatgggataataggaccccctgggggtccatgcacttgaccaaggttgctcttagaggctggattcagcacagattcagctactccggctcaggggcagggcaaagcaaaggtaccaatacattcatctggctggaaaaggaggattttgtttttacgaactttaaaggaatataaaaatgactttgttgtgattgaattgccttgctggatgaagtgccctgtggctccagggcttagagaggcttgtatggagactgtgtatttccttatgtatgtttctatatagatatatttccttatatacaaacatctgcacaattgtgtttgggagccccaggctaaaactaagaccctgacatgtttgaaactttgctggatagaaactaggggtggagaaatcctgtttaattgctgcaagtagtttttagcttataagagatgaaacatttgatattcatttaggacaaactcttcctgttttaatgatagcatctcctatgtattgagagcttcctatgtgtccggcactgtgctaaacgctttacatacataatctcatttaatcttcacagtgtccttaaaagtgaggtactattgttgtcctccattttacagagaaggaaagtgatgggaagagaggttgagggacttgattaaggcaaggtggctaataggtggaaagctggggtttgaactgtagtcttaatgactgtgcaaaacatccttgtgagaactacttaagtttcttctccctgcaaatttaaagcaaatactttctaatgaaatcaggtgtggtacaagaagcaaaaatggctttgcaaggaggaagatatacaaagtcatctaccagggaggcagagtagcatttctgcaaactagtttgctattggagcaattacatctcggctgaagagagaacaagtacggtgaggtgatggagtggagtttgactttgagtcccttgagtgcaagaaggccaagagccagaggctgacaggcctgagaaaccatagcacccatggagctgcttctaagcccaggggttcaagtgtgacctagagttgggcagagcagacaaccagctcgttgcactaaacctacacctgccttgtgtctcgtgcctttttatcatggtagtttttaactcgttatttctggcacactggaaagttttcatttttgggttgtccactgtgcatctaactaccgcattgaactcttattcattcttttgcgaaattttaattcagttacacctcttgggtttctagatatgcaagcatatcattgcaaatatatatgcatatatatatacatatgtatatatgcatatatatacatatgtgtatatgcatatatacatatgtatatgtatgtgtgtgtgtgtatatatatatctatatatataatctatatatctatatccactttacagataaagaaactaaggcactcagagaggtttagaaattactctaggtcagacagctaataagtgatagtgcacagatttaaaaataggcctaccttcagatcctgagctgtaaagtactatacaatatctctcatacataaattacatttttataaaaatgagatgacactgtatacattctttgtaatgtcctttcacttaataactttcttatatgcctagatgtattcaataacataattttaaggatgtataaaatacctttatcataaaagtataggccaagcgtggtggctgatgcctgtaatcccagcactttgggaggtcaaggtgggcaaatcacttgagcccaggagttcgagaccaccctgggcaacatggcaaaaccccatctctacaaaaaaacacaaaaattagccagccatggtggtgcatacctataatcctataagctactcagaaggctgaggtaggaggatgcacacctataagcctataagctactcagaaggctggggtaggaggaacacttgagccttggaggtggaggtttgcatgagccttgatcataccactgcactctagccggggcaacagagtgagaccctgcctcaacaaaagtaaaataattaacatttattgagtgcttaagatggatgagacatcttaacatggattatttcaaataaatttgtttacatgaggcaggattactggttgttgtagtcatatcagttcagaaactccagcttgtcactctcctacttgctggcaccccagcctgtcaccctcgaccagctttggagctgtgggatctgcatggattgttatgctatccaatgcaaaatgcccttgttttattcatatgggtaaggagcaagcagcaagtatctggactgagcacagggcatggcaaaggcagccagagtgaccctccacgttgacaaggattcctgggaggatttaacattactagtctaaattagggaccaaggaaaactgttctcatctagtttcctggaagctttgcaatgatactggaaccctaggaaaaccatggccgagaagagattttaggaggtacaggagccaaaggtgaagagacaccattggtgggttgagggggaccaggtatagtgaaagcatcaacactaacatcttgcccacaaataagatcccttccagccaggtgcggtggctcacgcctgtaatcccagcactttgggaggccaaggcaggtagatcatgaggtcaggagttcaagaccagcctggccaacatggtgaaaccccgtctctactaaaaatataaaaattatccgggtgtggtggcgcacgcctgtaatcccagctactcaggaggctgaggcatgaggatcgcttgaacctgggaggcagaggttgcagtgagctgagattgcgccattgcactccagcctgggtgacagagcgagactgtctcaaaaaaaaaaaaaatttcttccactgatgcacaatgtctatttaatgctgctatgcttatactatgaactgaactttgtctcctcaaaattcacatactgaaactctaacccgaaatgtgatggcatttggaggtggggcttcagggaggtacttagatttagatgaggtcatgaaggtgggttccccgtgttgggatttgtgccctttatagaagaggaaaagaccagagcttggaactccctcactttctcttcacccagatgcaccaaggaaaggccacgtgaggcaggaagagggccttcaccaggaactgaattggacaacaccttgatcttggactttccagcttccaaaactgggagaaatcaatgtctgttgtatatatttttgctatggtggcctgagcagactaagacactggccatttacttcaactgattgcctacattttgaaagtgttagagaagaatggtttatgcttctcagatggctctcagaattacgttagaaaatatattttattcattctttaagaaaaatccgcaaacaattaccgagtacctgctatgtgccaggcactcttctaagcagtgaccaaggcagacatgatccctgccttcgtgtagcttacaatctaatggaaaaggcagatattgaacaaataatcttataaatagtgatgttatttccagttgttatgtggtgctaatgaagaagtgaaggagctatgaacagatataagaggggcccatgacctgaagagggaggatgagatggcttccctgtatgtgtgcatgcgctttccagggcatggtgggagatgacaatgacattactagcagaaagaatggcaccacaggccaggtgtggtggctcatgcctataatcctaacactttgagaggctgaggaaggaggatcatttgagcccaggaggtcaaggctacagtgagccatgattgcaccactgcactccagcctgggtgggagagtgagaccactgtctctaaaaaaagaaaaagaggccgggcacggtggctcactcctgtaatcccagcattttaagaggccgaggtgggtgaatcatgaggtcaggaggtacagaccatcctgaccaacatggtgaaaccccgtctctactaaaatataaaaaattagccggacatggtggcgggtgcctgtagtcccagctactcgggaggctgaggcaggggaatcacttgaacctgggaggcggagattgcagtgagcggagatggcgccactgcactccagcctggcgacagagcaagactccatctcaaaaaaaaaaaaaaagaaaaaagaaaaaaagaaaaagaagagtgatacaatttgatggaataaagcacatttacagtgttctccaaccaccaccactatttccagaacattttcatcatcccaaaggaaatcctatgcccctttaagtactcactccctgttgttccctcctccttgccctacataaccactgatctattttctgtatctgtggatgtgaacattctggatatttcatgtaactgggatcatatagcagtctttttgtgtctggctgctttcacttagcataatgttctcaaggtttatccaaattgtagcatgtatcagcacttcattcctttttatggctgaataatattccattgtactgatagactacattttgcttgtccgttcatcagctgatgaacatttggattgtttcaacctcttggctattatcaatagtgctgctaaacatttgggatacaagtttttgtttgaacacctatttccaattctattggatatgtatctaggaatagacttgctgggtcatatggtaattctgtgtttaacttactgaggaacaagaaaatagcactacttttattgttgtaaagaaaaactcaacaaccaaaacataatcatatggagatatatatttgtatttttcttttgcagcttgaaggaatacacatttgttgtctccatttttatggttcagtccaggcacagcttagctgggtcctctgctcagtgtgtcatgagcctgcagtccaggtgttgtctaggatgcattctcatctggagatctggagcttggggtccgcatccaaggttgttcaggttgttgacagaattgagttccttgctgctctagtgccgaggctctcacctcccggaggctgcccctctctccacaaccttgtttgcttcttcatgtccagcaggaaatgctgtctctcttcagggagggctaatagctttcacttgattacatcagccccacccaagataatgttttttatgttttgttacagtccagaggccttttttttttttttacatatatacctattatgccatgaattcatgcggagtaggttccagcagctccggctccttcccactggttcttgcacagtgtgcttctctgggtggagcgggctggtgcttcagttgaacccaggtacctttctctttggcttcctttttctctgaacagtttccttcatgcaattcaggatgctattttttggctcttaataaagtgcttaatatgctcaatatgcacattaattctcttggcaagaatcttaaccttgtgtttttaaaataatgccaacagcacactgggtaacaatgtaggctcttccagttttgccatgaaaacatttgtggggtattcctttctgaacagtgcccattcccttgatgtctacaatatcacctttcttgtagattcacaggtatgtggccaaaggaatgaacccacgttctctaaaaggcctagagaacacgtattgggtgcctcttctctttccctttgtgttcattattttggcaaaatactagaagatggtggttctggccaaaagtgatcatctgtcttttttattaactcaaaatcagctgatatgtgactttaattacatcttgaagctatattttaaaatattttgtacagatgtagagggtacaagtgcagacttcctacatgcatatattgtaccatggtggagtttgggcttttgatgtactcatcactcgaatagtgaacattgtacacaataggcaattttctgcaaaacacatgatttcattcttttttatggctgggtagtgttccatgatgtatagctaccatattttctttatccaatccaccactgatggacgcttaggttggttccattatctttgctattgtgaatagtgcagtgataaacatgagtgcaagtatctttgtcatataatgatttatttccctgtaggtagatacccagtagtgggactcctggatcgaatgatatttctaattttagttctttgagaatggatcaaatgacatttctattttttgttctttcagaactatccctactgttttccttaagttgtgctaatttacattctaaccaacagtacataagcattcccttttctccacatcctcaccaacatctatttttctttttaattatagccattctgactggtgtaagatggtatctcattgtggttttaatttgtgtttctctgattagtgatgttgagtgtttttttcacatgtttattggccacttgtatgtttaaagctatatttttaagcattatgataagcaatctagccagattagtgacaaaatgaaccctactctcaaggaggagaatccaagtgagtaattcagcacacgcacatcactacagttagaaaaactacacaaatacaacttttttttttttttgagatggagtctcactctgtcacccgggctggagtgcagtggtgcgattttggctcactgcagcctccgcctcccaggatcaagcgattctcctgcctcagcctcctgagtagctgggactacaggtgcatgccaccacacccagctaatttttttgtatctctagtagagacagggtttcaccatattggccaggatggtcttgatctcttgacctcgtgatccacccgcctcggcttcccaaagtgctgggattacaagcgtgagccaccatgcccggccacaaataccactttctattggccaacccaggaagaaacatgaacttccttcctcaagtttgaggctggagtctttgtcttagccttcagtcactagagtaagactggtgttctcctcatccaaccatgaacacattgaggacaagggcacatctgagtcatctctgtcatcccagtgcatggcacagtcaacatttgttggtggaaggaaggcaggaatgccacccatcccccccggggagatggtcttgggcacagtctctctttgcattgctcctgcagggtactgagccacctctaccctcacagcaacctcctctccatcatccatcacttcaggtcactcaatgatgagcaagccagctgatagcactttttagctacacaaatggataaatcacagaaaccaacatttgtcagactcagctatcctgattcttcttgtgaacaaaatgatcattaattcctttagacgagtcccccagtctccagccatttgtctcctttccccatgggcaaataaaaatgggaatcttattagtggtctctagtcatctcatagcattgcggggagagctgaagctggatgaatggacatccctgagcttgtggagttctcaccaagtgggcagtgactgggtatgatcccctttggagcctgtcactgctgttgacattgaaaataccggtgtggaaacaaatgctgtctttgtcacaggctcaactacaggggcctctccttccctaagctggcagctgagactaagtacttgagatccctgggccagctgttgtgaagtaaacgccaggcagtaggtaaggcaagattcagaactgggcagaaagccaggctggagagggagcactgataggaggggagcacaaaagttggcaaacaaatgctttccaagtaggttttaaaaaacacaatctggcctctaaagtagacaaagcaccaatggggggtgcaggggtgggggtgctgcctgaaaatgcctgctctgactatcagctcaagaagattctagaactggaaaggcactgtgagcaatgtttcccgaggaggcttcccttggagcacagaaagatagccacaccctttgaagttagctgggagcttacaaagggcagtgttgtttccactaaggaagaatgatagccctgcataatggtgtccttattctgtaaaccccagaccttgtgcgatgaggggcaagtgagcctgcaggccccagcaaagggggaggaaatggttggcaaaacacatacttttagcttgcttactggtcaacatggaaggtcttccctaggaagatggtgtggtcaaagtcaggggtctgtttcaactctcttccaaggatgattgctaaatcatatcaagatacctttttaatttgatgatggctgatgtaagtttccaaatgcttgcatcttctgtcatgtttgatgtatttcagtgaatcatgccacaagctgagaggccctagagatgaaaggctgatgagaaaaaacggatgagcccattgttttacatcagaatgtgaatggtgatatttctgagtagtgggattcctgtcacacaaaaggggaagtcagtaggctggcagtagctgccaagggcagcttattggacaattattagggaatggaatcctaaaattggaattttaacatagccttgatcaactttggaatgcctatggtattgcatcatacatgcttatgtcagggaccacttccaaaattctgactcatctcccaggccaatgaaaccatttcagcatgtgaattacacccctggtgttgtccaagggaatttttgtcagccctggtgcccaggactgattccattaggcctaggagaagctgtgtggtgcaacagaaagagccatgaggagccctgagctctagtcctagctctgttgccaattaactgtcattccaagtgaatcttttagtgaatctgtgtcttggtttcttcagcagttgaaaagagacagttgaatttgatgagttagtctcttacggctttaaaaataaaaatgcatgtttcatagcttggcatttaacaaagaattgtggatatgtaagtaatctaattttataattttctttaggtatgaaagggaccttaaacatcgtatagtccaacccctttatcatacagatgtagaaaccaaggtccagaaaggggaagggatttgatcaattagtgcagaattagggttagagatcaggtttctggattcccagtccagtgcattttccactacatttatttttaaatcaagtaatacatgagcatggtttaaaaatatcaaataggcagctgggtgcggttgctcacacctgtaatcccagcactttgggaggctgaggcgggtggatcacgaggtcaggggatcgagaccatcctggctaacacggtgaaaccccatctctactaaaaatacaaaatacccaggcgtggtggcgggcacctgtagtcccagctactcgggaggctgaggcaggagaatggcgtgaacctgggaggtggagcttgcagtgagtggagatcatgccactgcactccagcctgggtgacagagcaagactctgtctcaaaaaagaaaaaaaaaaaaaaaaaaaaaaaaaaaaaaaaaaatatatatatatatatatatatatatatatatatatatatatataaaatacagagagctgataataaaaaacaacagttctctgccccactcctccccatccccagtcccactcctcagaggcaaccattttttaacagattctgttggcaattcatctgatagttacttctgaatctctaaatattactctgttcccattcttgatttatccattttggacattatctattaactcctgttataaaaatggaagatttagctcacttaacattactcccaactgcctctctttcttctgcctccccatggttgatagcaatattttatgagatttttaaaaattcactttttaaaatagcatgctattttaaaaatttacttttttggtgtacagctctatgagtttaggcaaatacataaagtcatgtaactgccaccacaatcatgatatagaacagttccattaccccccaaatcccctcatgctgccctttgtaattggcttctccctttaccccctacactgatctgttttgttgctacaattttgtcttttccagaatgcccagaaattgaatcatatactatataaccctttgatactgacttctttcactcagtataactattttgagattcatgtatgtgttgttcattcttttgtattgctgaatagtactccactgcatggatgtaccacagcttatccattcaccagttgcagaccatttcagttgtttccagtttgatagcattatttttagttattctattggttactttttaactgaaaatcatatactgaaacctctacttcttgcaccatcatccactatatagtaagtaggtcttctttttcagaatagtaaatgctttggactgattgaaaaacataatactttcatttctttagtcacagttttagacggatttaatttgagggtgtgatttttcatggggttgggaaggtttgctcaaatgctgtccagcagccctattcaaggctacagccattctaaatgcctcctgtcacatagggggccttctctagtaccagatatgcttgttgctgggaagatacgcatgtactttctgttctgaccgttgctaactcaggcagtagtttttgggaaaaagacctttcttcatgtggatttcagcttttgtctgtcatgctttttctgttccagctgccttcaccagtgagcacaaagccacatttcaaaggaaactgacaaattatccccagctgccagaagaaggttagttttctgtgtgttcagtgtcccccttctctgataaccaacaggttaactttctaaagggaactgacaaaagcagaaattgtccttttacccaaatgagttgtgattgttgatttttttaaagatgtggatttgtaatattcctctccattcctactctaatttataccaggaaatagagtgtaagtgatcacaatggaacctctattgtttgcaagattcatattaatgcattctggttttttaagtgcttacaagatctaaattaatttttaaattagctagcatagtgtctttactcaatgagtagccatttaaaggctgaatgatgtcagccctggccatagagatttatgtgttgttatatttcatttgcatttttaaccatctttgtacatgtgttatgcctctagcacttatgctgtataacaggagagagtctaatgcctagcacagtacactacatatagtaggtgctcactaaatgcca

SEQ ID NO: 3736 - DNA, 197753 bp, human
gaggagtctgtcaaggagtgccaccctttggtaatctttattaatatatacctaatatgtaccttatgtttgtggcatgtgatactgatgttccatttatcatagtgataggaagctttttattacagtaaacttggcaggtcgtatagtaaaggaaaagtgacttaatttaaatacgtcttgagtaaatgatagtatgaacgatccatagccagatatggcccaaatcttaaaatatacataattacttcgatccaggaaagtattgggtcacagtggtgtgtggaacagtctgtatgaagaagttagaagctgtggaatctgtgtggaatgctcttgccgggttctttttagatttcctcttttttgggattctgcgcttttcctttcccttttcttttctctttctttctttctttctttctttctttctttcttttttttttcggagtttctttcttgttgcccaggctggagtgcagtggcgccgtctcggctcaatgcaacctccgcctcccgggttcaagcaattctcctgcctcagcctcctgagtaggtgggattacaatcacccgccaccacgcccgactaatttttgtatttttagtagagatggggtttcaccgtgttagccaggctggtctcgaacttctgacctcaggtgatccgcctgcctcggcctcccaaagtgctgggattataggcgtgagctatcgtgcccagcctattctgcacttttcttctcctgtgaggtgtggtaagacaggtcaggaacctctctcctttagcttctggggggaacatgaggggctgaggtaaagtggggctaaagagcacttaaggcctggtttgcttacctatctcttctgactaaaaaagtgattagaactccagagctaatgtcagcatgcagccctcagagaaaggagcttctagtctggatcactgaggcctgccttctttgggcaagaggaatttttagtctagttcccctcatgactactgaagtagtctggggtgaaagccctagctggtgaagtgtttctttgaatcttccctgtaagcatccatctccctcggagacctgtgggatgcggggaggaagaggggaagagaggctgtggctgttgtaggtgaggggttaataattctaggatttgtaatcctgaccatgtatatttctacctcagagacaaaattaacatctcatagcagtggtttaatttctgttattgtttttcatctttattcatttttatttatttttgaattatggaggagaaaagcttgttacaaaaagtggaaacctcatagaagtatgcaaagtaaaaaaatactcccccttcagcgttttcatctataatgtaatagtttgatttgtgtaccaaattatctttttcttttcttttcttttctttttttttttttttttttttttttttgagatagagcctcattctgtcacccaggctggagtgcagtggcatgatctcggctcaccgcaacctctgctgcccgggttcaagtgattctcctgcttcccgagtagctgggattataggcgcccgccactgcgcctggctaatttttgtatttttagtagagacggggtttcaccatgttggccaggctgctcttgaactcctgacctcgtgatccacccgcctcggcctcccaaagtccaaagtgctgggattacaggtgtgagccaccgtgcccggccctagttatctttttctatacataggcgaacatatttgtaatagatgcacatgcatattttaaaatttttatggaaatgtaatgtatatacaaaaagtatacaggttgatgaattatcacaaactggatcttctgggggaatgttctctgtgacctgggtgatggttacatgggtttattcatttgtgataattcctggagagtaaatggcagaaagtgagccagtagggaacaactcaagagttctggaatgttctctatggacctgggcgatggttacttgggttgattcagtctgtgatcattcatagagtgaatgactggaagtggtcattggggggggggtgcctcaacagttctggaatgttctatgtgacctgactgatgtttgcttaggttccctttgtcagcattcaaagagtgaatgactggaagtaggtattgtggggcacctcaagagttctggaatgttctctgtggacctgggtgatggttacttgggttgattgcgtttgtgatcattcatagagtgaatgactggaagtgggcattagagggcgcttcaaaagttctcgaatgctctgcactgagataggtgactgtttatgggttcatttttagcaattgtgtgaacattccataatttaaccctcaaatgatgatcattgaggttctttataattttttagtatacacaagtaaatgttgttatttatttaaatttgtccgcttctgtatgtatttcttcaggagagattcttagaagtgataaattgctgggtcagaggacatgtgcattttattattttctttttggaaaggtaagacaagttcagtgtaaaaaaatcaaatagcaaataaaaaggacatatagggaaaagtcagttttcctcttacccttgacctccagtcccatcagatcctttctcagaagcaaccagtgttaccagcttctggcaggttctaacagagatactgtgtacattgcatatatatttacatatccttataaggcattgcttaaagccataccaccaccccatcaagattgtaccaatttataatctcgtcaatagcgtttaagagttcccttccccccgatcccgaaccctggccagggatgatttgggggttctgaaaatatttgagtaaaaaggaacaggttttattcattcatccattggcaatacattaatgtgcttcagaattcaaaaggtgcaaaacgtctgcctcccactttcatcccctagctgtcatagctcctttcccccagagcaattgtgttttcagtttctaatgcattcttacggagaaagtttgcatatgtaaacaaatccatctatatattttttttttcctgaaattttacacaaatggcagcatatttgtatgagcgattactacatgacctccctctccttttcccctcaaaaacctaagtgacttaaaacaattattcattttttctcatgagcctatgggtaagctgggagtatctgctattcagggccaggctcagatcatcttggctggtcagttgatgggtcagttggggattggttggtctagaatggcttcagctgggattgttcagctctactccatgaggtctcttacccacaagcagtctagtctgggcttgttcccatcgtagtgtgaggactccacaagaacagaagcacagaaggcctctggaggcctagacttggctctggcacaacgtaactgtcttattctgtcgaccaaagcaagccacaggctagctagcccggattcaaggaatgtgaggagctgcaaagtcacgttgcagggtgtatgggcttagggaggggaagagctggggccatttattctatcaaatacaatactataggtattgttatgtaccttaaccttttttttttaacctaacactgtatcttggaaatgacttcatattagtccacaaagagcttctttgttttttattctatttcattttgccagccccctattgaaggaaacatattgcttccagtcttttgctattatctaacaatgctgcaatgaataacattgaacatatgtcagataaattcctaggggtggaattactgggtcaaaaggtatatatatttattatgtttgatagtgacttccaaattaaactgaaaattttgtaattttttttccactctaaagaaatagaagttcagttttgtgcagtggcagcatcatagccagtgaggtttatctgaggagtgattattgctaattgaaaacttttcccagtaccccgccatgatggcttgaaatatagttggcgttggcattttttgacagtctgtatggagactaaactaaaaatagaaatgaagaaaaaagaaatggaagttcataatttaaaatttttatttttttgtacaaattgatggggtataagtgaaattttgttacatgtatataatgcattgtaatgaagtcagagtatttagggtgtccataacccaagtacaatatatttttgttaagtatagtcaacctaatgtgctgtcaaacactgaatttattccttctgtcttactgtatatttgtaagtaccccttaacccactttttttcatcctcctccctacccccgattcacccttcccagtctctgttatctgtctgtccactctctatctacatatgatcaagttttttagctcccacatataagtaagaacattcaatatttgtctttttgtgcctagcttatttcacttaagatatgacttctagttccattgatgttgctgaaaatgacatgatttcattcttttttataactatatagtattccattgtgtatatgtaccacattttctttatccattcatctgttgatggacatttaggttgattctgtatctttgctattttgaagagtgctgcagtaaacataggagtgcaggtatccctttgatatattgatttcttttcctttgggtagatacatgggattgttagatcaaatggcaattctatgtttagttttttgagaaatctccatactgttttccatagtggctatactagtctacattcccaccaccaatgtataagagttcctggccgggcttggtggctcatgcctgtactcctagcactttgggaggccgaggcgggtggatcaagaggtcaggagtttgagaccagcccggacaatatgctgaaaccctctctctactaaaaatacaaaaattagccaggcatggtggcgcacacctgtagtcccagctactcaggaggctgaggtaggagaatcacttgaacccaggaggtggaggttgcagcgagctgagattgcaccactgcactccagcctaggcgacagagtgagactctgtctcaaaaaaaaaaaagagttccttttctctgcatcctcaccaacatctcttattttttgtcttttcagtagtagccattctgactggggtaagatgatatctcattgtggttttgatctgcatttatctgatgattagcgatgtagagtattttttcatatacctgttggctgtttgtatgttttcttttaagaaatgtctattcatgtccttttcccattttttagtgggaatatttgttgttttcctattatttgagttcttggtatattctggatattaagtccccattagatgaatagtttacaaatattttctcatattcaacaggttgtttcttaactctattgattgtttcctttactgtgcagaagatttttagcttgatttgcctatttttgtttttgttgcctgtgcttttgaggtcttagtcataaattctttgtctagatcaatgtccaggagagttttccataggttttcttgtagtgtttttatagtttcaagtcttatgtttaatccattttgagtcgatttttgtatatggtaagagataggggtccaatttcattctgcatgtggctattcatttttcccagcactatttgttgaagaaagtgtcctttccccagggaaagttcttgctggctttgtcaaaaatcagttggctgtgtatgtggctttatttctgagttctctatgctgttccattggtatatgtgtctgtttttataccattaccatgctgttttggttactatagccttgcaatatattttgaagtcaggtaatgtgatgcttccagctttctttttgctcaggattgttttggttacttggactctttttttgttctgtatgaattttaggattgttttttctaattttgtgaagaattatgttggtattttgataaggattgcatcgaatctatagatagctttgggcaatgtggtcattttaactagattaatttttccaacccatgagcatgggttttttttttccatttgtctatgtcatcttcaatttcttttatcagtgtttgtagttttccttatagagatctttcacctccttgtttgaagttattcctacatattttatttttgtaactattgtaaatgggattgccttcttttctttcatgtctagatcattattggccatcatatagaaatgctaatgatttttgtacattgattttgtatgctgcaactttttattttaaaagaagtcaagcctacagaaaagttgaaagaatagtacaataaaaacccatatacccttcatgaagattaaacacttgtttacattttgccacatttgttctctctctgtgtgtatacatatatataacactacatagaacatacatatatatatatacatattttatgaaccatttgacattaagttggagatatcaagacactttttcagcctgtattgcctaaaaacaagggtgtttacctacataatcacaattttgttagcacacccaagaaatttaagattgacagaatattattttattcatagcccatattcaaatttcccgattgccccaataatgtcatttagagcttttttttgtttgtttcaatcaaggatcccaaattcaggatcaaaggtcatacaaattcatgtacttgtcatatctctagtagtctttcatataaaagtttcccacttttttcatctttcatgaaatattcattttgaagactctaggccagttatcttgtatcatggcctaaaatttggatttgtcacattgttccctcatgaatatattcaggttaaacacttttggcaaagataccacataggtggtttccattgcctcacgtcaggaggtgtatacaatgtcaatttgtcctattgccaagttggatcacttgaccaaagtagtgtaatccagatttctccatgtaaaggcacattctcctcctttgtaattaatattcaattaatatctttaaagtatgaccatgtaaatattctgttccccaataattttcatctgatagttttagcattcattataatccctatctgaatcagtttttaacacagtggctgcaaaggtacgttttcccaattctgttgttccttccacatttattagctatccattcgtctgtaaaggaagctgaccccttttgtttttcatgtcacttcaaattcttttttaaaattaatctgtataacctgttaccattattggactcgtgcctgaatagacagatcaacaaaacaaagcagaaagtccagaaatagacccaagtatatatgaaaatgtaatcttttttttttttttgagacggagtcttgctctttcccccaggctggagtgcagtggcgtaatctcggctcaatgcaacctccgcctcccgggttcacgccattctcctgcctcagcctcctgagtagctgggactacaggcacccgccaccacgcctggccaattttttgtatttttagtagagacggggtttcactgtgttagccaggatggtctcgataccctgacctcgtgatccgcctgtctcggcctcccaaagtgctgggattacaggcgtgagccaccgcgcccggccgaaaatgtaatatttaataaacagtttattactggggcaaagatggactttttaaataaattctattggcacaactggatagccatttggacaaaaaggtaatttggtcccatacttcacattgtaccctagaataagctccaaatggagcttattatataaaatatttaaaaaataaaaaataaaaccatataggtaccaggtggtccaaatattaaaaaaaaaaacatataggcactagaagaaaacgtcgattaatttctttataatctgggtgtggggaaagccttttaaaatatgactccaaatccaaatgccataaaatgatgagtattttcaagtacataaaaatcaaagtaaaaacctttttttgcatggcaaaaatcagataggcaaagtcaaaagaaagatgatgaaggccgggcgtggtggctcatgcctgtaatcccaacactttgggaggccaaggcgggcggatctcgaggacaggagatagagaccatcctggctaacacggtgaaaccccgtctctactaaaaatacaaaaaattagccgggcgtggtggtgggcacctgtagtcccagctacttgggaggctgagatagaagaatcacttgaacccgggagccagaggttgcagtgagccaagagcactccagcctggtgacagagcaagaatccatctcaaaaaaaaaaaaaaaaaaaaaaaagaaagaaaaggaaaaagaaaagaaagatgatgaaactgagaaaatacttataatgtatacataaataaaggtccaatatcccaaacatataaagaactttttaaatctaaagaaaaaaggctaaaaagtctcaggaggaaaatgggcaaaaacatgaatacacagttcacagaagaaagtatacaaatgatccttaaatatatgaaaagatactcaacttcacacatagtaagagatgcaaatatatttaaaatacacagtcaacttgaccatctggatcatttggagaggaggagcaatgccaggttaggttaagttctcccatttaggcactccttgatatccctgggcttcaccttttatggcacttatctgacttgtaattacagtgattgtttaatgtctgtcttccatactagttaccaaatgtataagaatagtgaccaagactatcttattcacactggtatccccagctccacgcacaaagtaaatgctcaattaacatttgtcaaatcaatgaacaaacaaactacagagtacttatactcaccaataagagctaccacttaatagttggatgaatgaatgagtaacgtggaggcaaggaattgaatctaaatctatgttttctgtagttctctctccccgcttctctttcagttcttgcccactttccatggcaaactctctctcctattttttctccctaatttccatctaatttccacatgctagctaaagtaaaaccttcagcatggcctatgctcataaaatgtgtgcctagatcaaaaataagaaaagttgcaaatttacatgataaattggatgttagcatctgaagtgctttaaaatggcctgctttcttatgtttctataattattttcttatgcaccaaaataagaaaactgaaaaataatttattgttaaagtcattccaacatttatcttattgctaaaactgcttcctaccgtttcattgcaaacctacagtattttagctttacttttgtgaatcaaattggaactctaaccagcgtaatcttgtctcttcaagaaaatgcattgtaggcaccaaaaaaaaaaaaaaaaaaaaagaacaataaatgttcgaaatgtagcacatttgtaaattggaagacagcttgtttatgagtgcctgttgattaaatttgttaatgagcccttaagaaattgcccctttttctcctaccactagaaatccttgatggatttttctattacatctaattttcaacacatagaataaagccttccatctatgttgacttttacctcagaagttgagcgagttacttgatttttacaagcccagaaaaataggcttccccctagacagtcattgtaaaaggagtctcttggtagcagattccatttttttctaatactataattatagatcgatccaataaatgttactttaaaattttgctcagtggaaaggcactatagaaaaatctcatgtattagcctaaagcagcttgaatctactccctatcttgtgaatgtttaggagttttgatagcctatataaataagtgtgctgcatagcagcagttattacaataaaacaatattctgctggattttgttgaagctttgattaatgtgaatataaattgatagggacaacagaaagtttgaggttaaaatttaggtagcaaccttgccataacgtattgtaaaagtaccatatgctcattggataatatatgaaaagtaatgaaaaatagaaaaaagtttaaagtgaaaataaaaatcaccataattacgccaggcagagacagctgtgtgtttgtggggttttctatgtgatggaactcagatgctatatgcaatattttagtctatggaagcacttaaacattgatagtattttttaaagaaatattttgtgtcatccggggtatttaagttttatggtttagcacactactctggagaatggtttgagactcccgagtcgagaaatcaattcacagaagtcctgtttcaattacctgcagatgtcagtgtggatctgagtgtgattcaacactttgttccaggatgtggtgggacagttgaagtccagttgtgaaccagttgcttattaaacaaataacagtttagtttggatgagaaatgtgagctgtaaggacctcaagtctccgaaatttctttttataaaatctaaataagcatggatatattctccagttacatccagttcacagaagattataccatctcgttcccgcccctgattgtttaaacagcctaagattagttatagtgctggagaagtagagttgatgtcgttgggcttattaaatttgactccagcccagatggcaggtctgagcgatacattaggagctgtgttggtttactttttgctgttatcgtatatttaaactcaaagtttaaaactgatgattccagctctaaaagggcatcatctttgccattgcttctgatgcttatctgcttttctacatgatcccgctctttcatgcaacttcgtgacatgaaaagtcaatgtcgattaggctaggaaaatgtcagggagacttgcagtggctcattttaccaaaacacaattgtttctcgggccacgacacaaatctgccatctgtttcataagcttgcaggcttcctctgaagtataatttgctatatatattggtacagaaattgttggtagcttatgtttacctagcaacataatctgtttggtagaaggctgtgggaaaggaggctttgtggaggaggattttctttttctttctttttttaaagagagcagtttcttcatctacaaattatctttaagtgcaagaaaggcggatgtgctggcccaaacaatctgccttttataccattttaacctaaattgcctagtaaatgctcactttgggagttatttttgctatgtcaattatctcatatatacatgaatgccctcttttcaatttatttttcttttcatacaaatcactgtgaaataactgccttgaccttctagctgtaaaagatcaccgagctttgggactgcctgcatctgtccagtgtgtatttctcctgtttcccagtgctcttagtgtgacttgtgggttttgaatgttgaatttacatttcaaggatgtttgtcagggcctggtagtctttaagttaaatgtaacaaaatcaagcagcctgcactgtgttgtctgcattacattaattttcatttaattgaatgagctgtatatttctacctacccactttcttagctttcttatcagcagagcaatgtgtctgttgaaagaaaaaaaaagccaaggggagaaaaaaaagttttgactttccttcatgttagttatagacatcatatgctggtaaaggttagagtgtactttctacattcattttgagaaggggaagaaagtgttgtcctgtcaacttccttcatgtaacaccaaggtataatttgctgcaggcttattgcatgatattgcccttctgaaagtgacgggtttttcattttaatctatagctattatgtagttctcaatgaagaggcaatgtggaggttactaacccacttccctctctaaaaaaaaacaaacaaagaagaaatgaaaagaaaaacgaacttctatatcatcctgagactttgaaactagtcctgagaaaagactgtagcagaattgttatatggacaaagttcctttagccagagccatcccatgtctttcatcttgcagcctttgtttctgcccccttgagtccctaactcttcacaagcccagaaatctcctcacaatgtagcctcacaggaaagcactgataacttctacagagttggccctgacagttttgcaagggacataggaattaactgggttggaaagcaggtttccttgcatcactgggagcagccattaataatacaaacatttattcttggtgttctccagtaatgctagtcatggaagtgagaaattgacagcttgagttgtgaaactgagacccatttttatacagagcagatagttaaaggcaagtgagagaagatgagctaatgagagaagggttgacaaaagaagagcagaggaccgggcttttgcaacagaagggagatgtaggatgaaagatcctggaggagtgaatgatcaaggagggaagcttattgtcttatttaaccaacacttcttcagcattggtagtgtgccagagacaagagatgggaggaacaggatagagaggagacatttttaggagggtgatgaatgaaaacaaaatggtagaagatgccccaaaagtctttagtggctttatttctgtcgagaaggtcggaagtcagattgcagaggagcaagaaaggaatgcagcattcattctaaaagtttggcagcattctagagactggtagctggaagggtaggagggtcacttgtagagcagttgttgatgttgttgttgttgttgatggtgatgcagttgtctgcatgagattgaagagccaatgggataggaaataaatcagaggtccctggtgagcagtgctgtccactagaactttccacgatgatgggaattacatacatttgcaccgtcccattcaggagccgccagcaccacgtggctgttgagtacttgaaatgtggctagcacaatcaagaaacttcatttttagctttatttcattataattcatttacatttttcttttcctttttttttttttttgacagagccttgctgtgttgcccaggctgcagtgcggtggcatgatcttggctcactgtaacctctgcctcctgggttcaagcgattctcctgcctcaacctcctgagtagctgggactacaggtggcgcccccacaccaggctatatatatatataaatatatatatatatatttataaatatatatatataaaaatatatatatataaatatatatataaatatatatatatatatttataaatatatatatataaaaatatatatatataaatatatatataaatatatatatatatatatatatttttttttttgtatttttattagagacagggtttcaccatgttaaccaggctggtcttgaactgctgacctcaggtgatccacctgcctcggcctcccaaagtgctgggattacaggcttgagccactgcgtccggtcataattcatttacatttaaatagctacacgtggcaagaggttactatctaggacagcagaggtctataaggagaaaataaatgtgggagtaagaaaatgggaagagatgaattctagagcagagtaggaggcagtaacttagtatttaggaaaaatcttcatctgatgagagatgctctcacatctccaatagctaggggagttcagacccatagcgtaaatgttttcagcaaccgaattgtcaagctcatctactaaaaatgggagagttgagaggaagaagatttggggacccgaggagaaagattgggatattcacagcatacggtatatcaggaacaactgggcagtgatgggaaccaaactgtggttgacagcatgagtttgtggtgggccaagtctaagaggctcaacatgggccaaatttgtactgagccaaatgcgtgcaattccatataaggttctttctggaataagaaacaaactaaaaggatctggaaaaaggatattatgcaatttaggcttagaaagttatgtttgagtatatcccagcagctctgttactctctcttaaacatcttctgataaattccattggtttttttttctgatgaatttaagccttgatagtataaaatgtatttagaggaatctcactaggcaggttagggcccttctgcctgggtggtgtttggttagggttatctgcaagattccattgcttgttctccaagcaaaagagctttcgggtagctcacccacgcctctctggtgataggagtggagatggtgggggcttccttatagctagaaaaattatagcactgtgtaagcccattgctatttaactaacactctttccagatgttcttggaatggaggccaggggcaagatatgcttattgcaatacagcttctatttgtgggaaaggagaaaaattaaaggaatgagcagatagaaatggaaactgatcagctagtatttttctatatgttaataacacgaaaagaattaattatgaactgaacagagttttctttaaaatccaggtattaggcagcaatttaaaatcttgattttttgatagaaatatctcaacaagctcaaatttttgacttcagaaacaagtgcactctttggctacctcgtcagtcctgtggatatttctgtgtaggcatttggttcttgttttcttctgtcacccaggttggagtacggtggcctgaacatgtctcactgcagcctcaacctcccaggttcaagggatcctcccactttagcctcccgagtagctgggactacaggcaaacgtcaccgtgcctgtttgttgttgttgtttgtttgttttgttttgttttgagtcagagtctcacactgttgcccaggctggagtgcagtggcacgatcttggctcactgcaacctctatcttccatgctcaacaatcctcatgcttcagcctcccaagtagctaggactacaggcaggcaccaccaagcccgcctaattgttgtattttttgtagagacagggtttcatcatgttgcctaggctggtctcgaactcctgggctcaagtgagcctcctgccttggcctcccaaagcactgggattacaggtgtgagccaccatgcccagcctgattcttgttttcattgcagcctaacactcttagaaaaggctgattcgtgtcaaaaacccatgacagtgagtaaccctgattagaactcttcttctaacattaaaatttaaagtaagcaaaatgtgtcttgttcaatatgttccagtggccagtaagggacaatacgacttctccagtctctatagttccagctagggatttaaagagaaataaaacagatgttagagcctcaacctgccaatatcagacctaggtaattgtcttgccagtcatttcatccatctgctgtaaaatatcaagacgttccccccatttaaaccctgataccagagtaattcaagctgcctgagtaacaccagtagctacgaccaaattaagttttcaaagatgagaataaaactgctgaaagtagaatttggcatgcctctaagagataaggagtcactcagaaattttagaatttcaatttgttcatccaggcatttgttaaatatcttccaagatcccttaccattggtgatgtggggagaagacaggcgattcagtagcggtatcagatatgaatctggccctcaaagatttgtactctagttgggtttacagatctgaagcttctaaagcaattcgagaacaattagatgtaaacttacatggtaaggcccagaaggtgactagaaccagtacttttttttttttttttttgagatggagtctctctcttgtcgcccaggctggagtacagtggcgtgatcttggcccactgcaacctccgcctcccgggttcaagtgattctcctgtctcagcctcctgagtagccgagattacaggcgcctgccaccatgcccggctaatttttgtgtttttagtagagacagggtttcaccatgttggccgggctggtctccaactcctgacctcaagtgatccgcccacctcggcctcccaaaatgctgggattacaggcgtgagccactgcatgcagctgaacctgtatctttaaaaacaaaagagacatgtgatagcacagagagaacctggcattagcgtatctaaggccaattttgtcactaactgaccggatcaccttggccttaaactctaaatcctgtttgtttttctataaaatggagattgtgctacttgctaaactggctttctcacagggcttcttgtctagggtgggaagccatactggataattttgaagtcctttcctggctcttaatattctatgattttatggtagtgaatgcaaaagtgctttgaaaagtgttaagtggtgtacattgtaatatttgtggcattatcatcattatgaatgcctctttggggttcccagaggctgatgttctccgtgcatctgctcacaggaccaccacacagcaagtttcctgactctcaggccaggattctctttctgatcccataatgtctcttttaaaaattaataagctgagtgactagcagataatttcccaaggaggtccctacaatttccccactcccacacacatttattttctcttccttggcagagtgcaaacttcactacaggccaccgaacaaaataatgtcttcttttaaaatcattaagctgagtgaccaggcaactcgaaatatagcagggtgtttcccagggaggtcaggtcaccactttccccaccccctcctcatttatcttctcttctccatcagaatgcaagctgccacacaaacttttgggcatatgctcttttggcctcctggataggcaggtgttagccacaggaaacaagcaactaaacaggctgctcttggtgccgattggccatgggttaatgagaggtttcatttaactctaggtggtcggtggtgttccaccccacctctcccagagtatgtcattgtcctgaatgagaaggcctgagggcaatgcttagaaatgagtttaagctgttacacatcaactaaggttaaagtcctctgtgcttctgtcccccttattgcctactctataccattcctcttagcatatactgccttgggctgtttttattttttctgaagcatgtggcctgtatcccttagtgaaaccctgtagccccttgaacattgagcacaatgttctgtaaacaatattcacatgatttgaaaaacaaaatccaagcaatgtagaaaatacgatcttctgaagtatttacagtccaaaagaaattatactgatactaatccaagagacttggaagtctattcacttccaccctttcacctcaaattgtgcagattggtttaacagcccaccatgtctcactaatgttaatgtatggttacctctggcagtctcgacgctgagatctgtgactggagcctgggcatcagttaactttgccaatgactgtgatatatcatctataatatatgatacgtgatatggccagtggagccaaacaagtcattggagagtgagttatgggctttctggacagaagaggtattgggtcaagtccaaaaacagcattcaattttcctactctgtaagcagcaagaaaaatgagggccaaggtgaccacaatcctatctagcctctacatctgcctttaccaagatgtttctaaagtccttgatgttaactccagaaaggcagtaaaaatggaccaacagcagagagatgtaaagggtgccttcctgtctcttgggacaatgaggcagccagccagcctggccagctgaaggagaacaaggcaacctgcccagcgagacaaagcagaggtcagacaaggaagtggaactattctgcaagaggggtgggagttttgaaaaattaaaaacaggtcaaggaggaagctgatgatgggaactgaacctcaggccacaggcctttgattgtataccctccagaacagagtgtcacactgagcactgcaagtaatctggctttgcctatgtcaatgtgtgttatcctcaaccttggcttgggtgagtcttcaattctcaagctgattcattttaaattcaacaaaaacaagggagaggtggggaggggaacagattttaggggttacttacctccctctgaaactaacgctggtgttttctaacccagcaccttgcaacaaagggagagcatgttagcttccttctgggaaaggaaggaactggactcactgtggtttgggtagtgcttgctactgaggcattaatcagggtcctgacatagctggaaagggctggtttccttttcatgtatagaatcataaagggggcacaatattcaaacaaaaggccaaggaaacctctcccaaagatcctatcaactgcagttctggaccaaggagtctggccagaagggaaagcccattttagaaaaggaccctgtttttccaggcagtgacattcctgttactgcggatatgactatagttccaaagaggtcactgagatagaccttaacttcaactggctttcagggactggccaattatttatggtagggttatttttcattatctgtaacattaagaagtacagatctcctacgcttaagatggtagccattgtggtttgacatcccaccatccattttacctcttacattgtttaacgtaagtatagttttggggattgcttccagctccagtgggtggagcctgattagtctgagccaatcttggtgatgccatgtctctggatttttcagctatacctcgctacaaggattggcttgggaatgggcatatgactaaattcatatcaatgacagatgaaggaaagtttgcagtgggtttctgaggaaagcttcctcattgttaagaaagagatctctctcactccatatgttgtcatacatgggtgtgaggtcttcaactgctgcagacatctcactcaagcttgagggtaaagtcaactgggggaggaggccaggacaaaaagaagagtggggaaaaggaaccagggctacagaattatgttggccctgaagccatgtgcctctggatttctagttttatgagccaaaagctttctcattttggaaggtagatggtgacaagagagtctggcttgtccttgagacagggactcccagatcacccagtggagactctgggagactgatacacacacactggactcagaagagactgtaatctggaacaccaatttattcaatgacaaggagtatgtgtctttccaggacctgaaatgcttgtgtcctctaacttccaatcccagtatcaaggtacctaggaacccaggctggtagtacaaaaatagcaaactgcaaaaataataataaccaatagcctggtttgcccaaagtcacgtagcttgtaaatagcagagcacagagagtcaacaggtagactctgatctgagtccaaagccaaaactcataagtagtttatctagcctttagtgacaatcaggacgttattccgatggacaaaaacaatatactgagcccttgctatgtggctggccctgtgctaaacactcaacatttattacttaattgactcctcactataacccagcggggacaggtattatgataattcccattttacagcagtggcaacagaggcttggagaaatgaagtcagtccccaaggctatgtgggtaataagtggcggggtcacctgatataattctagggtatccactattctttaaggaatcataacgaagggagcggggagaagagtagcatctaggttgtttcctctggtcccatccaaaatatacctttctttttcttttttttttttttttgagatggagtctctctatgttgctcaggctggagtgcagtggcatgatctcagttcactgaaacctctgcccccttggttcaagcaattcttctgcctcagcctccttagtagctgggattacaggcatgtgccacacccagctaatttttgtatttttagtagagatggggctttcgccatgttggccaggatggtctcgaactcctatccttaggtgatccacccgcctcggcctcccaaagtgctgggattacaggcgtgagccaccgcgcccggcccaaaatgtatctttctgatggcctaaagaacttacgtcctcttccttaaacaatgccacacacttgctgagaacgtcttacaatccagatgtccttattcagtattcacgttcggttaccaaaaactttcgtcacaaccagatcaagataacttattttgtattggttagccctttaaattgatcccttgtggttgagattttagaaaccactctcagtctcttgctgattttgagatagtaccctagtcttaatagcatcgatggctagagtttttcttgtttcggagagtgacattggctggccttgtccctacatcccaggaggctaccttatttgtatcctgcagacctcttcttactgttttcagaatttttatggtgtttaattattcattcttgcctgaaccatacatctttgctgtaacttatgtttcttttggttttttactacgtctttattttctaattaaattattttaattgttttatgtttggaagtcttctctcccccaccccccaataaaatgacaagcttctttcaggcattgactgtattttctgctttctacacattccccacagcaccaaacagaaagtggagcacatagtaagcattcagtgaatgctgatggaattgaattatgaactattgtctcatgttcagtctttccccaagggcttttggttagaacatttggccggaatgtcatacagacaaaactgaattaggaaaaaacatgcaatatatgttagagtcaaggtttcaggcttagaattttgcattacctaatgttttgacttcttttcaagtcagttagttattatctggcctcacaaacattgcctttcttgttacatcttctaggtgggacttttctttctctttgtcctgtaatttcacatttatccctctcaaacaaatccttgagcatggtttttcttcttgctgaagaagtcactgttgtggccatcctagagtggcctgctgtgaaacatgtgctatttcacttctgtcttcatttttattttcttgtctttctgtttctgttttctttcctttctctctctctttctttccttcttctttctttttacattaacaactgcctgtagatgacaacagctagaaggtgacaacagaaacaggaggaccagcccttgctgtagcttacaccctaaaaggggaaagacaggacatccaaatggaacaaaacacacacatttgaggattccaatgcaggaggggacagaggagtcatcaatttgaacctaatttagccccttaaggaagtcagcaccgagaccattgccaaaactttattgattcctactttggacttaaaaaaaccctctcagagttgaaagaagaccactgttgtctttttttcttttctttctttctttttttttttgaaacagagtctcgctctgtcgcccaggctggagtgcagtggcgtgatctctgctcactgcaacctccgcctcctgggttcaagtgattcgcctgcctcagtttcccaagtagctgggactacaggcatgcgccaccatgcccagctcatttttgtatttctagtagagatggggtttcaccatattggccaggctggtctcgaacacctgacctcaggtgatccgcccacctcagcctcccaaagtgctgggattacaggcttgagccactgcgcccggcccactgttgtcttccttacttcgtactccatgctccaggctgtgcagccacagtcctgtgctctcagtgcctgggcagggataatcaggaagtgtcaactctgttatggagggaacagtaagcctgtctgcccatcttcagtgatgaggtctctttgaacttacatattcaatacctggatttagacagcagtggcctgctttagacagccatacatgagaactgactgcatgagggtggaaaaaggctcttccccactgcccatcccccacccagcccctgcacctgtgactgtttgaaatccccactctgccagctttgttcctcagtaattcctgctgagggaatttaggcctgctctccacagccacttccatctgcacttggctttcttcttgagtccacagttctggcaagggctgacttcttccaagtcagtgagaggagagtgcacgttcaaaatcatctgcctgggattggagagagtggaaaatgggaaacatgctcggtttggaggcatctcattcttttggaaaaatctgaaacctccactggtttactgtttataggctgccaagtgtgttctttttttttttttttttttccaagacagaggacaccatctctgcatctcattctaaataacagacaaactatatacagtgcttctcccacccattacaaaattgccaaataaggtggggttaggatttggcttattatcgtggttgtttaccacaaaggggtcacagttgaactgcttttagcaaaaatagggtgttgttactctctccctcctcggtgattgggtatgtctattccttatccaaaatttccagacagttcctgtctcagagacttgttacccctaaactaccttgctacttaatttaacaaaaaggaaagtatgaaaattagatgtttgctcattgcttctgacattttttcttccaaagttctcctcaccgtactacagtggagggaaagactatgaacatacattcgttacgggtatacttttttgatttggtaaaaaggctctgctattgtgaagcatgtcttaaacataaacaataaaacctcataaagctagcttctgtttacccaaagtggtgggtaattggaaaccggattatagaatcatagattttttaaaataaaattgttatcgaagcataatatccatgtcaaaaagtacacaaatcattagtgtacaacttgatggatttttacaaaatgaacatacccgtgtaaccaatacccagatcaagaaacagaacactttccttatattagtttctgtggttgccataacacattactacaaatttcatggcttaaaacaacagaaatgtattccttcgcagttctagaggccagaagtctgaaagcaagatgtcagcagggctgtgcttcctccaggggctgtaggggagaatccttccttacctcttccttcctggagctagtggctccaggcattccttggcttgtggctgcatcacttcagaattctctgcctctgtcttcacatggccttctgcttctccctcttctgtgccttctcctttgccatctcttataatgatacttgtcattggctttagggcccactcagataatccaggatgaactcatcttgagagccttaacttagttatatctgcaaaggcccctttcccaaagaaggccacattcacaacttctaggacatggtcatatcttttctggggccgccattcaagctaatacccctctcagcgacttccatgtcaaaggtaaccactgtcctgacctctaaaagcatagattagctttgcatgcaattcagttttctataaatagaatcatagaggccatactcttttgtgtgtggcttcttttcgtaacatcatgctcatgagatctccatggttgcttacagctgttgatcattcactctcattgcagtatagtattctattgaattagtttttttttttttttttggagacggaatttcactgttgttgcccaggctggagtgcaatggcgcgatcttggctcactgcaacctccgcctcccgggttcaagcgatacacctgcctcagcctcccgagtagctgggattacagacatgcaccaccacgcccggctaattttgtatttttagtagagacggggtttctccatgttggtcaggttggtcttgaatttcccacctcaggtgatctgcccgcctcagcctcacaaagtgctgggattacaggcatgagccaccatgcacagcctgaatgactttatcacaatgatccattcgacttttgaagggcctttgaattacttttagtgttaccattacgataatgtggttatgaatattcctgtatttgtgtcttggggcaaatgtgcatatatttccattgggtatacccaggggtggaatttttaggtcctaggatatgtgtatgttcagcttcagtagacagtgccaaagaattatagattttttaagttataattaatctttgaaatcgagaccagatttaagtaatgcctcacttaaataaaatgcatgtaataatcccaaatccactaatccaaaaaacagtatttctcctggtgcccagacctttcgaaaggggcagatcttattctacattgccattctggcacggacaccccaaaaacatgctgcattgtctttgtcagatcacacaagtaaaagagaacttggtagcattggccatggagagaggcaagaggcaagccatgtggccaagagcattagctggaattaaccagcttcctccctgcactgaggcttcctgtttgctctagcagtcagctggcttgggatagcattgaaggcaggctctcttatcctcactagtgtaggcataggagcgatgttgcctaggaaagggcattatacatgaagcttgcatttcaagaagtgtctgtttcaaaaaaaagttcccacttttggaccctgagctatgaaaagccaaagtcacctcgaagtcgaataaaaaaatcaatttaacaaaacagtccctttcacacacactcccaccctgctgtgttatttttttaaaaccatttagtgtcattaagccattgcctcataaagttgtttcaccaggaacttcagtttccccaggaagagatgaaaataaactgaacatttcatgtcactgttcccacgagtcttaaaaaatcatgtttgtctttaacagcacgatatgaaacatctcttgtcgataaggagttatacttcaggataacaaggcaacagaatctacaatgataaattttacccacattttaagccagaattcctcatatagattaccaggcatatttgactccaaccatattttcccacataattatttcttttaaatctcctaattattccattctgttgaataccatatgtcctgctgagggacaattgtgtctaaacaaatcaacaggttttgcatcattgtctaaatatgagggagaaacaacagccccacaactctactctggcattttggtggaaatgaagagttctaaatcccacattgggaatgcctcatctctggctcccctggaagataacttgtggagcccaaaaacaaagccaaatgaattttggaaaggtcagtgggaaagacattggggtgggacttttccagaaaatgtttgagcctttgctccatgagctgtctggtcacccggacagtttgtacttcccagagagggtggggaagagagcagaagcaattcttctctctgggtacctgggtccaggggggctggaaacctgggatttgctcagttggcttgggtgcagttgtctcaccctgggaacgagcccgtttgaaccctatgaacagtgtagttatgtcaggaaccttggagatagaacagaacatctgtgggaataaaatagctgaggattgtctgccttgtgtcttgttttcgagagaactgctgatgtgtttcaaataattgaatactgtgcgctgggaaagtgcttctccctgaagccagttccaggcaccccagagctccagtgcttctgctaagggcttgcagacatcgctgttaacacgccaccttccaacaataattgacctttctcctttttattttcttttttctcaccctctctgtcttgctctcactactctccccctttctctagtcttagttttctctttatatgtttatgtcttccctcaaagatgtggccaagaagccccgatggctctcagagtcacaaagaaggttaagtgcactggtgtgaggataactggcagttctgagaaatccgcaagtccctgaagattcttttcctccctctgtgattgcatcagcctcgccctcccctacttgtctgtgttgtccattctccttttatccatgctcacttctaaatcagttcattcaaacaccataagcatttgccttcagcgaattaactctgatttagttcaaagttcaatcaaaaggaaccagaataaaggaatagagtggactttcctttcggcgcccccacctgacttcccataagccaaactagctttttcgtcgacctcagcatggttagagcttccagatctcctttccaactgcccatgcaatgtcagaaggaagggtaatggagcacacctctagaatgttggggatcagtggtgctcccaattaggggcaggtgcattagcacacacacacttcctggcctcttccctggcccctgtccagaactccagcaagctaatcacaaggaaaatgtgtgtgcctgaatgttaggagtgaacaggcaggtgacttgcttcagaattagcttgcagcgtctctttttctagctgccatccagtattagatgtggtaaccacaccagttaacaccccggattggcttgggattatgaatggaaggaagggagatccccatgcaagcaagcagctgtccctttgcttaattattgggatccacaagtccatccctattgccagggcttcagtgtcgagatgatgaaataggtgattaagggacttggaggccagtccacattgcagctttgtctgagtgttccaacgacaagtgttattagtccactaatcataacattgcctgcagtggaatttccttgggaaggaatggggcagcgcctccatgccagagggctgcgcagcatgaaaatactaacacatcacaattggctgttctgtgggaagacgattccaacatccaattcaggaaataggtcaccgggctgctagatacactgctattttgatttacttccttagactcttgcagtcttcatagacttctctctgggtagaatcaaactcctccaacttactggcttctggagtgccacatagggaaagatgcaagcaagttctgaaaacagaggcatggatttctcgtgatcaatcttgtggtgtcctggtgtccacttgcttctagaatcaaacacaatgcccttcgggatactcctcaccttgacctctttcaggggagcttcccagaggtctggggccatggcttttaggagcctgcagctgtgccggccagacaacaaatgtttagtgagaggttgaagagatacaaatgggttgaagggcgccagagccttctcagtaatgagcatagcaaagcttcgatttccaaggatcttgggaggacaagatgtactcatttggagtattgcactgccagggctgtttgtaccagctgtcgggttcagagaccaccctgttggtggggtcaggggcccagccaaccctttcttttattctatacctctggtcacttgggccttaagaagcaggagtcggggcggtgggggcggtttggggctctgtcactaagcagctgcctctttcctggatcagtctagacttccctctgatttttcctaaacccaagcagttgtctactgccttggagtgtcagcaaagggtatttgtgggtctttggtatttgcagatttcatatcaggcaaaagcttacattccccttttcttcttcttcttttttttttgaaatggagtctcgctttgtcaccaggctggagtgcagtggcacaatcatctcagctcactgcaacctctgcctcccaggttcaagcgattctcctgcctcagcctgccgagtagctgggactacaggcgcatgccaccacacccagctaatttttgtatttttagtagagacagggtttcaccatgttggccaggatggtctcgatctctcaatcttatgatccgcctgcctcggcctcccaaagtgctggaattacaggcgtgagccaccgcgcccagcccctttacttcttcttcttctttttttttttttttttttaaggtagacagattatatgacattgggggctctgaacttacccactgcccactttttgtttttagcctttcaactactgggtaattctggatttataacctctttcttggtgcccagagacatactatattatgttggggcataaattttgggcttcagctcacctgtccagagatgccatcccaaggcagtcttttaggagatgaggagttgtaccagttgagataccatgggagggtttgaagaggtgtcttgctgagtaagaccaaagggtgttttctctctctctctctctctcttcctctctctttcttgctttctctctctcttccctgctagccatgacctatatcagcaaatagaaaaggggaatatttgtgataaactcctcctggcaaatccattttttgggctctggacttgagaagagctttactgccttttaaaattctaagtagtctgttaaacactatttcgaccctctaattctttctccagttcttttttcttttctttctttttttttttaacaaatctttagagcagaggttgtcacacaagtaagtggagtagaatttatagtcactgcagaacaaccacatggttattgcatatactgcagagacaagcaaaagatatgagacaaaaattgcaagagcaagcacctccaagttatccagcagccagtaaggttacagagattgctactggttacagaggctgtgatgtgagctgggcctgaatttgatccccagctgtgctccttatagccgtggcactaggcaggttcctgagcccctgcttcctaccctccagatgaaaacaaaagttcttagtgcgaaagggttgggaaggttaaacaagaaaatataggtgatatgctttctcagcccagtcctggaaattagtaaaatggtcacagaatggtgacttttctcattatgaaaatcacctccttggctttgtagtcccatttcctgtttaatagcaactgaaatagccacaggagccaccaccccccatctgagtctggctattttcgaggctccatttggaaggggatggccccagcagtccagggggtgggaggtggtggggagggaggcattattctctgggttgcagctgtggcagtaagtacagtatcccccacatgccagatgaatcaagctgagggccagatctgggctgtgggccagaggttccccaccctgatttatagcatggacagagatgtgggtgttttgtgaatatattttgatgatgataaaaaaaagagagaggggagggaacgccattccttaaaaatgtgctgagggagggaggttcagacctatcttcaagattagagcagcctggctgttcgcggtagcaagtcattagaaagaggcccatggaagagcagcctgtgagaggccttgaaacacagtgaattgtgaataaggcccctgtatgccagccattgggggcagattaggcttgctgtcctctctgcaggtgtggagtgggggactaagcctgcattttaactcctgcaggtcccaagagcagagaaagggagcactgggtctgctgagctgtggggagccccccggccccatgcgttcccagtgctaatagttctcccgaaaccagccaggctttgcctctgagatcaggcctaggtcattgccaatggactgaggacaacaggctaagtgtggaagtttgccctggatggagtttggagaaaactcacgtggaggatttattctaaaccttcaacctaacaacacatttgagagggctggctgagcagcagatgggagttgtggctccctccagaatgttcccctcccaaacaaggcacagctaggcacagacctccttgttttacttgtgggatatcaggcacagttgtcctggtttactgtgtttcatccaggaaagaacttcaatcaggtttcctaggacccctacagatctttgaagacaagagatttattccccagaggtgaggccactaaacagacagggtcctaaagcttgcagttcataaaatcacatcggtctgcaaacatctttttttttctaagggaagggcagtgaacgctctcatgccaacagcctgcagtatctgacaagtacaatctggtttttttccctctcacctctcactgctcccagccttgagccttctgttcaaaccaggcctcatcctcatccccagcacccctgccaacccaccctgctcagatttgcctttaagcttttgctccatctggaatcctcttgccctttgaggatccaaagcctttgtcctttcacatgaccagttctctgaggaaacagccctagctattcctgaggcccccattactgcctggtcaagggctttggggcacatactgcctgtgcgtccatcctcatgaactccaaatctccccgctactccacaggacaaagaaaacgagactgacaacgaagtctgaaggagaaaggcaagtatctttctgctggactggccctcaagacttagcacaagtgagtttttggagttttttcctgtgatttctgtgtgtacatatatactcacctcttttctgtgttcacttcactgaaacacaaatccaccacacccataaggccaaccctgggttactttttgagcctgcagagatttcccccaacagacaaaacttctaagccccggaagttctctgttttatatctaggatgtgaactaagactctgtgagaggggttctggtctatatcacttggggctgcctccttcaagggatggtgagaagccccctgaaatgaaataaaatggtttctcaggctcttccttttgaatttcccatttcctgcctcagggctcaacaaaggacttgtgtatgagggggtgtgtgagtgtgtgtaccatggcaggagaaggcacacaggatccttgttgttcattcacttttcctgggaggaaacagcagtgggtgtctattcccagcagtattaggaagcagtggtgtgggcccctcgccgtctctcttcccagcttgctgggaacgtcttttactccaagctggttaagtaaccacagagttgcatctctggcttctctgactacctcccactctccacttgatgcccacaaaaacaatgtgttcagctgatgtttgggtaacgttgtacatattcctagcaaggacattggacatattccttgcagataaggaaggtaggatccgttcctgactcaggaggctgatgtttcattctaataaagctcaaggtttctcctcgcccacagtcgtgctttttgataacctggcaacagccaaacctcagtcattgctttgaatggccctatctcagcatttaagagcatttttcaggggctgggcttcataaagattggggtttttttgagatcctgttaaaaaatggggtaagcatcgtgggcacatgctcatcacaacccagggaacaaactgttggcgaggagtgtagtagagcccacatacagaccaaatgcattaattatgaatggttcttatcttgtgattaaaacagatctggcaggcctggaacttggcagcccttggttagctattagttctatgctactgtaccggctgggcagtcataaaactgtatctctttgaaaaatggtccatcatgtagaacagcctcctctgcacccattagctcaaattgatatgacttgatggcctaatcttgggcttctcagatgctggatttaatttctgtctggagctttaggaaatctggaggaagggacacaagggctgcatgcagtgaggtagggtcagaggatgtacacaccagcccccacctccatctgcacaactccccttactgatggaaggcatccctctagttcatgttgccattgtgtgcccccactctgtcaagccctgttaaggaattaactacaagttgggagttcattggtaagatcctggggcatgacttgcaggtgcaatcacagcttactgcagcctcgacctcctgggctgaaatgatcctcccacctcagccctccgtgtagctggaactacaggtgtttgccatcaatcccgggtaattttttatacttgtatattgacaggtgtctcaaggaggcaaaagctcccaaggatggaggccatagtgctgggataagaactcatagtgtagatatttttggactgagtcttatcagaagacactttaggaatttcaggaatcagaagggtgtgattgggaaaacaggggcagagcttcccaatgccccagaaatcccaccaaatagaccacactgagtctccagtcagatggtgccaatctctctgctctaccccggcagtagtaggcctacgatattgctagatagcattcatgaagttccagctaggccaagtacttttgcaagttcatgagcaggcccctagggtagtctagcttgtagtctagatgagaaggctgttgctaatgcttgaatggacttttatttgattatttgatttaaatgtctcaaaaatggagcaagaacctaatctattgacaaaaacatgaatttgggaatcaaatccaaccattgctcatttattcaccttcaaaagttgagcattttatattgagcattaaatatgtgccaggcacagtgaaaagcattcatgtgacaggtaggtacaattatatccccattttatagagatacaaactgatgctcgggcatattcatctcggttgcacagctctaaagtagtggtgctggaattaaaaacaatgtagcacagagcataggttgtgaagtcaggctgcaggaatattcatattcttatagataaatgtgtaaaactaagggatgtttcttttcataagtgttctctggaggagctctcagcctcacgtgggaaaatagctctgtcactcagaggagagctttaggaggatgatacaggtatgggcaccatcaacatatagaaggcaagtgaagctgagggagatgagaggaagggccagaaagacttgctgtaggtcacacagccatcaaggacagagccaggcccaggcaacagcacttcccccattgccgtttccttcagctgcaacttccataccaagaggcggctccatcctttcctcgccccctttctcttactttacagtcagacaggagttatttcccaggaagcaataacagtattgacaatcagaggagtttgggacaggcaccgtggcttatgcttataatcccagcactttgggaggccgaggcaggaggattgcctgagcccaggaatttgagaccagcctgggcaacataatgagaccccatctttacaaaaaaatttttaaaaaattagctgggcatagtggcgcacaactatagtcctagctacttgggaggctgaggcgggaggatcgcttgagcccaggattttgaggctgctgtaagctatgatggcatcactgtgctccagcctgggtgacagagcaagacccctatctcttaaaaaaaagaattcatcttgagtaattattcatagctattgagtatgaatgaattctgtggtaaatagacaactctagggatttcagcacccactcccattgggaaaccttgctctaaactctcacataaaacactttccttctcagaaactcaatgctggctgtgaagaagagcttccagagcaatgactttctcttgacaaaggctggccctctcaaaaatggtaacatttgtctgttgcagtgtgcaagctcacacctttctctcatatggagccttcaggtcctcatgtgcttgtgctttcacccctggatcagagtgcatcttcatgtgctgtccacatgtgtacaacaaaactgtctctctggggccaggtgtgatggctcacatctgtaatcccagcactttgggagactgaggcaagtggatcacttgaggtcaggagttcgagaccagcctggccaacatggtgaaaccccgtctctactaaaaatacaaagttagccgggtgtggtggtgcacacctgtaatcccagctacttgggaggctaaggcaggagaatcacttgaacctgggaggtggaggttgcagtgagccaagatcaagccattgcacaccagcctggggaacaagagcgaaactccgtctcgaaaaacaaaacaaaaaaaaagatagaaagaaagaaaaagaaacagaaaacacctttctctatggaaagaatatcataatggctcatatgctcttttctgggcctttgtttcaggggacaagaaccccaacagtggaatttcaggcatcagccagcaggtgggtggattaataaagagagattgagagaaggcacctttctgccactcctgaaatcatactcctggctctgagtgtcagtcccgtttggaaactatagctggaaaagtctcagctgcccctgacacggtcaaatggaaagtgcatgggctctggagtcagactgtctggggtcgtgttctagctctgctacttactagctgtggcacttttcataagttactcaatgcgtggtgcctcagttttctcgttctataaaacaagataagtatagtacataattcacagggttcttaggtgggtagatctagataacttgaatacatataaacacttagcagagtgcctgtgtgccgggtacaatgggaagcacttaatgaatggtatctagtcttatcatttccttgctaaagctacctcttcttttaagtcccttaactaagtaggtcactttagagaaactcaattcaactggaattattgagtgtctgttgtgtgcctagcattgtgctggggacactgtgaggaatacaggagaaatctatgaaggaagaactgttctcaaggagctttttaggcaggatgttttgagtttcctccaacagcccaactagcagccacgtggagaggcccacggctcttccttacatagtagcatagcaaggggtttaaacttatgggctctgcaatcagacaggcatatcatctctgcctcctgactgaggtgtgatgttgggaaaggtacactacctccccatttctcggtttcctcatctataaaaatgtgcatcataattacatctttatacattgtgtgcccatcaacatagatttatgattattgatttatgcaattgtcttttcaatcagataggaaaaaagggagttacaaaataccttaaaatctttaacatttacctttaaatattaaatttactggtgttcttttctttcttcctgtggattcaaactactatctggtgtcccgtcatttcagcctgagagattccctttatcatttcttgtagtgaagatatcctagcaacaaactctcactttttatctagctgggaatgccttcatttctcctttattttaaacaacagtttggttggggatagaatttttggttgacagttgtttgcctttcagcactttgaatatgtcatcacactggcttctggtcttcatggtttctgatgagaaatcaactgttaattttattgggggtcttttgtatgtgatgagtcacttccctcttgctgcttatgagattctctttgcctttggcttgtcacagtttgattacgatgtatctagatatggacatttttgagtttatcctacttggagttggtggtgctttttggatgtgtaggttaatgtttttcatcaaatttggggagattctgcctattatttcttcaaacattctttatactcctttcttcctctcctctccttctgaaactcccattaagtgtacgttgttatgctggatggtgtcccacaggtgtctgaggctctgacatttttcttcattcgtttttctttctgtttctcacgctggataatataagtatcttcaaatttgctgattctttcttctccccattcaaatccgccattgaacatctttagtgaatttttcattttagttattatatttttaattcaaaaatttctatttggttgttttaaaataatttctatttatattttctgtttattgagatatcactctcatattttagttctttagacatggtttcctttcactctttgaacctatttgaaatagctgatttaaatctttgtgtaaaaagtccaacatcaggccttcctcagggacagtttctattgattgttttcttttcctttgtatgggctatttctttgcagatcccatacattttttgttgaaaactgggcattttgaatattataaggtggcatcctggaaatcagattctctgtcctcctgagcgtttgttgttgttgctgcttgttgtagtagttatttgtttagtgacatattctgtttgaacttctaccagagttggccagtcctatctcatagctacaatttgcaaagtataactccccctactgtttgctttggctgccccacaactcttttgatgaaacttaaagccaggcattaagagaagcaagatataaatatgaagcttgtcttgatgcctcttagatcttcatggagcaacctttattcaaataactcataaattacaaggcaaatcagcattcattatctgcctttatgtcagaatgagaaaaaaatgagagatttacatggcatgagagaagaacgcattccactcttctaagaggcgttaaaggctccctttttagtgaaataagccacaatccagaaggagaatggaaatccatgtcacttgagagagatgccactagccctttccttctatttgcaagcctccctacttttgagggagggggagcacacccctgctaaccggagttgtctaggtcctgtggtgttaccagagacaggggtgcctatgtgaggctctctctccgagcaaaggaggaagccttaggaaattgggaggtaatcagagactgggccagaaggactggtaaggtagcctgaggagcatgggcagagtgtctccagcactggatgggggtaaagaggagggagagaaagggggaaagggaggtaggtaatgggataaaatatggtcaataaattctgtgacactggggcaggcttagagcaacgggtagtttgcccttcctgactccatattttcaccaggaagttttttttttttttttttttttgagacagagtcttgctctgtcgcaaggctggaatgcagtggtgtgatctcggctcactgtaacctccaccttctgggttcaagtgattcccctgcctcagcctcctgagtagctgggactacaggcgcatgccaccacgcccagataattttctgtattttagtagagacagggtttcaccatgttggccaggatggtctcgatctcctgacctcatgatccggccgcctcggcctcccaaagtgctgggattacaggcgtgagccacagcgcccggccaggaagtttttaatattgttattttgttcttgaaatattccttaagcatcaaccttatacattcattcaacaattatgtaccaagtgtcaggcattagaaatactgagatgaataaaacaggtcccgattataagggaaagtaatgtatagaaaattacagtagtgtgagagcagaagtgtgactgagggaaggccagggagctggatctgcaaggagacccctcactccagcttcgagtaggggtaggaaatagaatttataaggcttctagcaggaggtaatgcttgagatgaatctctaaccttaaagcacaataaatttgtcaagcatcattggccaaaggagtgtgtgagggtgcaaacatcctagtgagaaggaacagaagccagaaggagcttctggtatattctgatacattctaagacggaaaaatagctttggaggatggacatagggtgtatggagggttccaaaggagattagattagaaatttaaataaagccagatcatgaaatgccctgcaagtttttgtttgcttgttttttgagacagtctcactctgtcacccaggctggagtgcagtggtatgatttcagctcactgcaacctctgcctcctgggttcaagctattctcctgcctcaacctcccaagtagtggggattataggcacccgccaccacacctggttaatttttgtatttttagtagagatagggtttcaccatgttggccaggatggtctcgaactcctgacctcaggtgatcgatccgcccacctgagcctcccaaagtgttgggattacaggcgtaagccactgtgcctggcatgccctgcatgttttaaggaggcatctgtgctttatcttgaaggttatgagggagtcaacaaaggatttcacaggggaatgacctagatagtatagtaaggcagttaagagtgcagaatctatatatcagtgatgttcaaagtgtagttcaggtaccagcagtctcagtgtcacggggaacttgttaaaaatgcaaattcttgggccccattctagacctactgaatcagaaactagagataggccccagtcagctgtgttttaacaagctctccaggtgactgcaatgcgtgctcaagctggagaactacttccctacacagaccacctaggttggaagcctagctctcccactatataacctggggcaagttctaaactccagtgaagagagggggtaaggggaggggacgggaagtgagggaacagccatgacactaaactaagacccacaggccatataaaaatggttggtcatccagaaggaatctgggtgacagtgacattcatgataatagcttacatttattaagagcttactgcggaccaggtattattctaagaacttcacaaatattaatctacttaatcctcacaacaactttataatcctatttttcagctgaggaaactggggctcagaaaggtaaaaatatggtgtgatgtggagagatgtttacaattaaagtgggaatttttttttttttttgagacagggtctcgctctgtcgcccaggctggaatgcagtggcacgatcacagctcactgcagcctcggccttccaggctccagcgatcctcccacctgtctcccaagtagctgggactacaggtgcactccaccatgcccagctaatttttgtatttttttgtagagatggggtttcgtcatcttgcccaggctggtctcgaattcctgggctcaaatgatccccccaccttggcctcccaaagtgctgggattacaggcatgagccactgcacccagccgagttttgtttttattaaaagaaaaaacccataaatcatgtatatatgcatggaaaaagactgggaggaaatagcccaacatactcattgtggtggtgcaattgcaggcatttttaatttcttttttgtagttatctttgttttccagaatttctctaagaagtttatattgcttttgtaatcagggaaaacacccttttgaaaaagaaaagaaattgaacatgtgcacttgaggaagatgtgagcatcctctcagtgcacaatgcagacccacagaaagaaaaatgcacctggcttgtcgctatttcatgcaagaggattctgagggccttatcatgttggcacgcagtgagggaactggtggaggagtttggaaaaaaaatcagtgcagatagatagttcctaaacacccttcatccagctttctctaatgttaactgagttaaccatagcacagtttccagatcaaaactaggaaattaacaatggcacaataatattgactaaaccatagtttattcacattttcccggtctttccactaatgtattttttctgttccagaagccaatctaggatcccacctggcattgcgttgtcatgtctcattagcctccttcaatttgacagttcttcagtctttgtcttttgtggctttgacactttctaagatcctggtcagctactttgtaaaatgtccctcaatttagatttgttttatgtttttttttttcatgattagattgaggttacacgttttttgagaggaatatcagagaagtgatattatgccattcttagcactccctggtcttttaataactgtgtccccttaaacgctttcatcatgcaattttaaaattataagcataaatggttgcaaagatgtttatttccaatctgttgtaaatatcagcatttgaaatgcaattacttcactcttttaaaggtattcaatggaatctaaatagcaaagtcatttttacccaccattattttattttaaaatacatgaagatcttttttaaacatttaacattttactccttgaatctgtatttctagtccactttcctcagataattttatcttaaggtaatacattcttggctgggagctggggctcatgtctgtaatctcagcactttgaaaggctaaggcaggaggagtgcttgaggccaggagtcaagaccactctgggcaacatagagagagccccgtatctacaaaacaaaaattttacaaaatcggccaggtgtggtggtgcgtgcctactgtcccagatactcagaggctgagttgggaggatcgcttgagcttgagaggttgaggctgcgctgagccatgatcctgccactgcactccagcctgggtggcagagtgagaccttgtctcaaaaaaaaaaaaaaaaagtaatacaattttatacctaaaaggtaaggcttaaaattctcaccctatgtgacttctctgtaacaaaaatatgctttataaattgaaattgatttatacttgatttttaccataaagcactattagaattattatgattattatacacagtgatcaaaacaagtatatttaaagttttttaaaaataattattacttgtgaaaaggaaatttttatttaaatatatctcttaatgaaatgaatgggactttcttttcaggtatctaggataaataatacttattgctagaaagagacagtattcagaatcacgtctttttttttttttgagacaaagtctcattatgttgcccaggctggactcaaactcctggactcaaacagtcctcctgccttagcctcctgagtagcttggactgtatgctctcacctttcagcatcaattctatttctaattttttaatatatttaagggctgaataaacttgtttacataagtaagaagaagaaaatttaaaagttttataatagcactgtcatgtaattccataaacatctgggctataaaccaaaaatcagttatctccctgcaaaaataactttttcgttttttattgagatataattcatataccatagaatgcacacctttaaactatatgattaagtggttttagtatatttagaaagttgtaaaaccatcactactattcaattccagaatattttcatcatccccaaagagaaactcattacatgttagcagtcactccccatttcctcctcgccccaactcctggcaaacattaatctttcggcctctggatttgcccattctggtcatttcatgtaagtggaatcgtgtaatatgtggccttttgtgtctggcttatttcactttgctgaatgttttcaaggtttatccacattgtagcatgaatcagtgcttcattcctttttatacctgaataatattccattgtatggatataccaaattttctttatccatttgtcagctgatggacatctgagttgtttccatcttttggctatctgtgaatagcaatgctatagacattcatttatgccgagtgcaatgacatgtgcctgtagtcccagctactcaggagactgaggcaggagggtcacttgagcccaggagttcaagcccagcctgggtaacacagagagatctcatctctaaaataataaaaagaacacattgatttacaaggttttcggtgggcacatgttttcgtttctcttactgggtcatatgggaatttatgtttataaatttttgaggaaatgccagacattctcaaagtagctgcaccactttacattctcaccagcaatgtatgagcgttccaattcttccacacccttgccaacacttcctgttattatctgcctttttttatttttatttttattttttttgagacggagtcttgctgtgtcacccaggctggagtgcagtggcatgatctcggctcactgcaacctctgcctcccaggttcaagcaattctcctgcctcagcctcccgagtagctgggattacaggcgcatgccaccatgcctggctaatttttgtatttttagtagagacggggtttcatcatcttggccaagctcatcttgaacttctgaccttgtgatccacccgccttggcctcccaaagtgctgggattacaggtgtgatccaccatgcccggcctgtcttttttttaagagacaagttctcactctatttccaaggctggagtgcagtggcagcgatcatagctcactgtagcctcaaaatcctaggctcaagcaatcctcagcctcccgagtagctgggactacaaggtgtgtgccaccatactggctaattttttaatttttttttcagaggtggggtcattctatgttgcccaagctggcctcaaactcctggcctcaagtgatcctcctgctgtagcctcccaaagtgctgggattataggcgtgagccaccatgcccagcctgtctttttgattatagccatcctaatagatgtcttcactaggtatctctttgtggttttgatatgcctttccttaatggctaatgatgttgagcatcttttcgtgtacttattggccatttgtatatcttctttggagaaatgactcttcagattctttgcccatttttaattaggttatttgtctttttatcgtttagttgtgagaattctagatactctagatacaagtccattatcagatatatgacttgcaaatattttctcccattctgcatgttgccttttcactttctgggtggtttaatttgcagtacaaaagtgcttcatgctaggaaggcacagtggcctatgcctgtaatcctaacacttcgagatgctgaggcaggaggatcacttgagcccaggagtttgagaacagcttgggcaacatagtgagagcccatctctacaaaaaataaaaaaaattcagctgggtgtggtggcacactcctgtggtcccagctactaaagtggctgaagtggaaggatggcttgagcccgggaggtcaaggctgcattaagctatgattatgacactgtgctctagaaataaaagtgtttcattttcatatagtccaatttatctctcttttttttcctttgtcacttgcgtgtttgttgtcctatcatcctaagaatttcttacctaatccaaggtcaggaagatttacacttatgttttcttctgagttttagttttagttgttacacttttagctctgggtctgttgcattactgtgtacattttaagatcaacatgtcaatttctgccaaaaaaaaaaaaagccagctgagattttattagagattacactgaatccgtagaacaattgggggagtactgccatcttagcaatattaagtcttctaatccatgaacaagaaatgtcattccatttactaaggccttctttattctctgtcaatggtgttttatagttttcagtgtacaagttttgcacttcatttgttaaatttatttctaattagtttattattttattgcaaatagaattgttttcttaatttgattttcaagttgtccattgttagtgcttagtcatagaattgattgttgtgttttctggcatcctgcaaccttgctgaacttgattattagctctaatagttttttgtggattctttaggattttctaactaaggttgtgccacctgcaaatagagatattttttacttcttcctttccaatctggatgtctttaatttttttctcttgcctatttagcccagctagaacttccagtataatattgaatagaagtggtaagagtggacattcttgtattgtttttgatcttagggggaaatcttacagttttataccattaaatttgatgttagttgtgggtttttcatagatgttctttaccagattaaaagttactttctagttcttgtttattgagtgttttttgtttgtttgtttgtttttcattgaaacggagtcttgctctgtcatgcaggctggagggcagtggcatgatctcagctcactgcaacctccacctcccaggttcaagcaattctcccacctcagcctcccgagtagctgggattacaggctcccatcaccacgcccagctaatttttttatttttagtagagatggggtttcgccatgttggccaggctggtctcaaactcctgacctcaagtgatccacccgcctcggcctcccaaagtgctgggattacaggcctcccaaagtgctgggattacacctcgcctggcctactgagtgcttttatcatgaaggaatattgaattttgtcaaacacttgttctgcatctatggagattaacaggtagtttttgttccattaatgcagcatactacattgactgattttcttatgttgaaccaaccttgcatccctaggaaaaattttatttggtcattgtgcgtaattcattttatttgttgttggattcagtttagtagtattttgttgaggatttttgtgtttgtgtgataaaatacagataacataaaattcgccatttcaacaatttcagagtgtacaactcagtgacatttgttatgttcacagtgttgtgcaatacttaccactatgtagtttcaagacattttcagcatgacaaaaggaaaccccacacacactaagccgtcattctcccctccccctggcaaccactaatctgcttcctgtctctatgtatttgcctattctgaatattttttgcccaggtgtgaggtgaaaagggtttgggtgaaatttcctctatttagaaaattactatcacaaattctttatcagtcagcagccagtcagcagcctgtcccacacaattattcacaggccccttttgaacctcctgcatttggcaagaaagggaggtgagcatggaaaaggaagagggcaatctttcaactgtctcccctccttctgctagagaagggggactatgagaagaggactgcccaggatggctccaggcaaaatataaacatttgtctcctttgccctcaaatctcccctttctgctgctatatccaggccctggtggcctcaagtagccaggccctaggatatctctaagatctcttccctccaggcggggctgcaggccctgagactactttcataattggtttcctgttgggtgtcccttgcctgcaagccttactaactggccagatggcatccacttgcttgagccacgtgttcttgtttgctaaggcctccctaagttatcctgtccaaattccctgaacgtgaggaatgtcaagccccaaagctgtaaaaacggtgactcactgaagtccaagaaggaggtacttctggagagcagggtgatctttacgtacttttcaagtaatgcccatgggcaaatttgttatttagtgaagcaggatcaggcagtgggaaaaaaaaggtgacaccccaccctcacagtatgccttacagcccactccacagctttattaggagctaagtctctggagagattctggggaattttttttctccagggaggctttctggcttacacttctccagaccccaaggacactcccagatgcaaggtgatgtcattggagtgttttcagatagagaatttaagacttgctctgacctcatgtgctttgtgtttccagtttaactcaaactttccaagacttgagttcatttacctttaatcaaaattccctttctgggctccacttctgattacacatgggcctctaagtcttcttggccatcaggtaccagttgatcaaaagtgtcacacatttaggtagggccagtgtggctgacatgccctttgaagttcaaatagggttggaaatgagtgcaatattgctcacatgatgtcaaatctcacatgtttgaaatagagtgtgtgacatttgacaaattcaagcacatggtgaggcagctattctgcttacagagcaaagactccactaaggactaggtgagtgactgctcattggggcctgcctctttgttgacaacagactcagactggggcctttttgacgaaaaatcagaatgctatttccaacccttaggcaagtaatgggctaatgaatggctctagaattttaggagacaggcctcactctgggggacagtccccactgaaggcaaagttctttcctcacccccacatgtgtggctgataaaagctacttgtctggctgggtgcggtgtctcaagcctgtaatcccagcactttgggaggctgaggcaggcggatcgcttgaggtcaggaggttgtaaaccaccctggccaacatggtgaaaacctgtctctactgaaaagacaaaaattagcaggggtaatttttggcacgcacctataattccagctactctggaagcagaggcaggagaatcccttgaacccaggcagacattgcagtgagccgagattgcaccactgccctccagcctgggtgacagagcaagactctgtctcaagaaaaaagctacttgtcatatgtgcgcaatgtacttctccctgaagactatttcaaatggtttcagtttggccatctacccagaacgcacacgtacccagcacgcacatgtacccagcaaatgccttcctatttctaccatctttacccatagaaggccttagagtaagtactctttttcactgagtcaggtttagaccacagaatcctcagatcagcactcccagcagcctgggccagttgcttggagttggtatacaagataatgaaaattgctatcattttactgaggatttattatgggtgaggcactgggtaagtgcattacatgcattatctcttttaattcccacaatagtcttgttatgtactattattctcattttacagacaaggaaccaaggccaagggaaggtaagtaaactttctcaaggtcagattggcagaactgggctggaattcccgtctgtttgactccagagactaacctcttaaccgttacgctatgccagttcattcattcactcaacaagtatttaatcggcacaaattctgtgttagcatggttctaggccctggggatacagcagtcagaagatcttcgcccagtggaacatgacactgtgtgggcctctggaagaaggccctctgggaatcagtgacttgacactggataatacatccatttgctagcaggatgagggatctcaaaaatgtgggagctccacgcctaaacacagggagtatatggaaaactcaagccacaaggcaaaagggcaatggcaaagtttcagctcaaccctgacagggctctgtatgcttagcataggctatagcccatgctccagtgcttgagaaggataacatgccctactgatctctgtaacccttgaaggtcaaccaccccaggccctcctaccataagccaacattaagtttttcaagcatcccaggtctgcctgtcttttttgccattagcagctgaatgtgtgaagctcgtggctccccgcaaggaaccctaggggtgggtcacaggtggggctgagctcactcttcctatagatacatttcccccttgtaaagagcaaaggagacagatcaaaggccacctgggcccacttgcttgctagagagacccgggggagctggaaaggaaaggggaggaggggactggggtaggctggagctgtgctgtgattgattggcttgttttgctcctgcacttctgtttacccagctgggcctgctgctgcccagaggaccagcatgtgcatggccactctggccggcctttggggcagtgtcagagtgagctgtgcactcagccatctcctggcaaaactgaggcagggaagtttgtgttttatgtctgcaactttcctgccccactgggccttctcccacctccagggacacccctccgtaacacacacaccccagtctcagccacaaagttcttcaggtcttcttcctcttagtggaacctagtgtcactcaggtatctaagacactaacaggtaaacatctgccaacagcctctagcttaattcttctagcatttcaaaatgccgggcttctctgtaattaattagtccattcaaggcagacaagagcagagggccccaggagagggaaacaaatagcttatgaaagagctacagatccaaggacacaaatgaagtccctggtcttctaggtcagtctttctgttaattgacaaacaaggttaaaacaaatcccagcatctcagtaatgctctctgctcggtttgaatagcagtagcccaaggtagaacggtttcagaactcagtgtgttaggggggtggggggccgtgggcaggatttgaagatttgaaggacccttccaagtgcacgtggccactggtttgtcagtgtttaacgccagctctacttttcttaaaaaccaacccaaccccaaatcagaagcaagtagagactggtggcaaagggcccctgggctttgggtaggcactagagtggtggtttagagtgggctttggagtcagacaagcctgagtgggagtttcaaatctcagctctgctacttataactgtttgactttgggcaagttgcttagcttttctgagtctcagtataaccttctgtcaaatgaggataacacctacctcactgcattgttgtgaggattaaatgccataaagtgtgccaagtgcttagcaactgatctgtgttatcaatatatacagaggggtgtgatgatcaaagacgaggattgtggagagagggggatgggatacctcattctcttcctgaaatgttcagcactttgggtgtgcattcctaatgtttacacagttcaaaggcgagttcaaaatgtggaaacaacccaaatgtctatcaacggatgattggataaacaaaacatggtacacacatgcaatggaatactattcagcctttaaaaggaaggaaattctgatgcatactacaatacagatgaactttgaggacattatgctaagtgaaataagccagtcactcaaagacaaacactgcaagattccacttacatgaagtttctaggatggttaaattcatagaaacagacagtagaatgggggttgccaggggctgggaaagaggggaatggggagctaatgtttgatgggtacagagtttctatccgagaagatgaaaaaattctggagatggagggtggcgctggtggcacaacattgtgaatgtactgaatgccactgaatcgtacgcttaaaatggttaaaatggtaaacgttaaattttatgttgcgtgtgtttactgcaattttggatggattgggggtatatgtgtgagaaaagccatgaaaggttagtgccctggtgaaagccagggattctattttctactccgctatgagaaggcagccagtttccatacaggggaaggggagagagagagggagagggatggggggatagagagagagagaagcaggagaggagggaaaggagaatggcctgggctgtcagtgtaaaacaaaaaatacaaaagttggaggtttttcagctctgaaaatgcaacaagcaaggagagtaggctccatccctaggtgagccccaaagcccacttgggccacagctatagcctggctgggagaccacaaaagggaaggaggaggtaatttggactggcctgaggtaaaaattgcagagatttgcaagtgcaatcagctcttcaactccccaccacttccaaggcagagtgggtgggaccagactcttctcttcctccaatcccactccttccaggctacaaggggcccctcaaggctgcccttctcattcggttccagctgcctgatttccctggagaggaggttgtggaggtggggctgccagtccctacatccctagcagacccacctcttcacgggaccatccggaccctgtacacgtggaccctggccgtgtagacacacctgagtccaggaacgacacaagccgcagggatcccagcctaggcacggaggtaattaggcccgtcttctctgctcctgaagtaatgtttatttgtctttcaaattctgccaaccaaaatggcttaggctgtgatttaccgtcacaccattatgtcatacttccttactgcttttatgaccaagaaagactccaggcacagtagccatattatgtcccagcgaactcctgcccaaattaagtcactgtttctggtccctatcgctggtcaaatatgacttctaagggtaattgctgttttaggggcacattttaaagcaaatgcaaaaaataatgaatgtacctattttgtgactgaaatttgcatctgtctttttaccctctcccggcaaatatgttttatgtttatttaaacagtctttaataaaaatctacagctgcaaagcatcttactactcaatgctttctggttaagaaaattgcccataatcacagtggactttactattcataacagaatattatttttcatcggtgcatggctgcatcccaatgtatgagtgttgcaaatgcaatgtgaggcttatctgaggtcggaagctcttcattcattcatttattcaatccatcaacaaacttttttgcggacttaccatatggggtttgggacctttggggaacagggggcaagcatgggcagaggcatgagagagcaggtcactgataggacaaaggtagccattgtcaaccacagttgatgtattgtgattggttggaaagtgtgacacaagtaatttgttactgataataattaatgtaccagagttgctgaataatttactttagttgtaagttagagtggattcaaggttatctttacaataatagcatcactctcacctgcttgcatttcagtttgttttgatgagagttagagaaaagggtccaattaatagctgcggattccccaaggacactcatgggagtgtgtcatgcatgtgcacatcatctgtcagttatatcatagttgaggattatcagagtggcctacaaggcgtgtgttatgtgggagagtggagagagatgaaccgggagaggcaggatgggtagatacggcttttcagagcttgcataaacacagtttcaggtggattggcccccaaattttgcagatctaattgtcagtaatgtagagctactgcttgtttatcaggttccagtatttccccaagtacagagatgtgatcttaggtaaagtagtgactgtcaactcatacttgtgaatttgacctgtcttggagaacctgtaattatacttctcagaatcaagtacttctagcactggctgtgttgcatgttgagcttcttagaaatgagaatgtgacccaagaggtagcttccaggttaggtttcgtggggtgattgtgccgggaccacatttatctgtcttgaaaaacagatagaaattctcggtcatgagtcaaactagaaaaaggaacttactaataatggatttgatatgctatttctactgggaagtcagatggggtatggggagctgttggggtacagagaaggagtgtctacttttccttacctttccaatataaaatggatttctagaatattggaaatgacacctttcatgaaaatagaataaatgatgagcttggtgttctgatttgaagggtactagaactgtttccctgctcctaaaaatactctcccactgctgcttgattttctaatattagaaattgtggtagaatctctttttatatgtttacaaattatgctttgctctgttcaactagttttcattttctttttcaaatgtatgctggaggaaaagaggatagttcttctaaaaataagaagcacattcaagaatgagctggaagcctgctggaattgttaaggaaaccaattgtgtgtagatgcgacctcagtaattaatcagtgaacatctagcagccaaatatctgatgggagggaggaggccctctccttagagagagggaaaatgactactcccttctgattgaaaaagcaccatcccagaccttcttgctgctgacatgcagatgtacatctggctgtaatctctcactccctgctagcctttgccaaactgtgtggaacagaaatccagtttctcctccatgtaaagcgacagagagaaattgaatagttagatagttaaaattctgagcactggctaggaaaaggaacatgcccaaagcaataaaaagactctcacttaaaaaactgtggctgaagaaagatttgagcagtttaaacaactagtggagttgattggggtgaagggagtagaagtctcaaagccacagacaagccttgatactctgcagacaagctaagaaatatttaaattgtgtgaaatctactcaaggctgatgaataagatagaataagagcttgataacatttgaaagaatttatttgcacttaagtgtctgtgtttctataaatcttgctctaaattttattttatgtggtgttgttttaaaaacagagttatttataaagaatgaaagcataattgagtggggaagtgtgctctgttccctttctccgagctgtccaacctaagggaagactatcattctgtcaaagtggtggtaacttaatcaaattgcaggactagtacataggaggaaaatgatgccctttgaagctttgccttggaaacccacacttcataagtgacaacaaatacaacagtgcctcaacttttggattaaatattgcagccttctttaaaaataaaaaatgcctctggataggttaacatatagagttattagtatcttagtacagtggtttcccaaactgggtatttaacacacgtttcatttatattgagaacttttaaaattcagaaaagtgcagagaagagtatagcaaacacttgtgttctcaccatgcagaggagaaatacactactgtatttactgtgtcttccattctttttaaattaaaaaaaaagtgctacatgaaaagttgaggccccctttatctcctgcctccagtcaactcatttttattaatttggtatgttttcttccaaactatgatatacttttgtatttttttaaacttagcattatgttcttgagatcagtccatgtgggtgcctattggtctagttcattcttactgctgaacagtaacctatagtaccaccacagcacatttaatttattcattcctcctttggtggatatttatttccaaatttttagtattagaaacaaacaacttgcaataaacactgagatatctgtgtctttgcacactggattggaatttctctagagtatgtaccttctagaaagtaagatttctgggttaaagagtacatacacttttagtttttctgggcactggcaggttgctctccaatgtggctctaccgagtaacagtcccataagtcgtttatgagctcccatgacaccataccattgataacttttgagttttaatttttgcctgtctgatgagtaaagacagtatcttgttttgttgttgtttttatttccttgagtactagtgaggttaagtatctttgcatatatttctagaccattccagtgtcttctgccagttgtctgttggtattctttgctcctttttccattgtgttgattgccttttaaaattgacttatagcatttattttatgtcttttttgactctgtttctttttcaattacatgtgtggcaagtgtcttctcccactatatggcttatctttaactttatactgtcattttttcttatagacattataatgtttaatgtggtcacatttaccagtcttttctactaaaatttgtaagttttgtgtgtgtgattaatgaattcttctattctgaggtcataaaggtattctatatttgcatcaaagtgttgtaaaattttgcttttaacagttagatctttaattcattttgaattgatttttatgtagggtttgaataagttatctaattgtatcttttatcatatgaataattttaatgccatttattaaataatctatatcttatcctccacgatttataatcaatctctgtcctttacctagttctcatagacttacctgagttgtttgtaggccctttttatattccactggtctatttgtttatccatctgccaatactatatagttttattttttattttttgagatagagtctcgctctgtctcccaggctggagtgcagtggcgcgatcccgggttcaagcgattctcctgcctcaggctcccaagtagctgggactacaggtgcacgccaccacacccacctaattttaatatttttagtagaaaccaggtttcaccattttggccaggctggtctcaaactcttgacctcaagtgatccgcccgccttggcctcccacagttctcagattataggcgtgagccactgtgcctggcctacgttgttttaatgccatgacattataataagccttaacaatgtgcccttcactactcttcttcacaattgtcttgtatattcttgatgccttactattctgttacaatcttattctctgtgtaaatcttctgtgtaaattaccttgtcaaaaatccagaaaaatcctgttgtgattttggttgaacttgcatagaatttacagaccaatttaaagaaaattgccatatttgtgttgagccttcccatacatgaacatggcatatatctcctttttgaggttactttattctaaactttttatttcaatataattatagattcacgggaagatgcaaatatggtacagagaggccccctgtaccattcactgactttctcccatgattatattttacataactagagtacagtatcaaaactaagaattcgacattgatacaatatgtgtgtatataattctatgccatttttatcacaggtgtagatttgtgtaagatacagaaggccagacgcagtggctcacacctgtaatcccagcactttgggaggccgacgtgggcggatcacctgagtttgggaggtcgagaccagcctgaccaacatggggaaaccctttctttactaaaaatacaaaattagtcaggcgtggtggcacatgcctgtaatcccagctacttgggaggctgaggcaggagaattgcttgaacctgggaggtggggttgtggtgagccgagattgtgccatattgcactccagcctgggcaacaagagcaaaactctgtctcaaaaaaaaaaaaaaaaaaaagatacagaatgattccatcaccacaaagatgtccctcatgctacctttatggttacacccaccccaccctatctctaacccccagaaatcactaatctagtcttcatctttacaattttgtcatttcaagaatgttatataagtgaaataatacagtatgtgactttttgagattacctttcttcattccctggagattcatgcaagttgctgtgtgtgtcaatagttactcctttctattgccgagtctgctagtgacgaattctgttagttttccttcatctgaggatgtcttgatttccccttcattttgaagaatatttttgctgggtgtagaattctgtgctggcagttctcttctttcctggtatggatgtaccatagttggtcgaacccgttcacttgttgagggacgttttggttgtttctggtttgagtgttttctgtttgttacctctgttttttatttctctgttttcattttcttgccttcctgtgtgttacttgaatattttttagaattctattttggttcacctacaggatttttagagttatgtctttgtgtagctttttttgtggttgctctaggtctaacgtgacatacacataacttattacaatctactggtgtcatcattttaccagttaaagtatagcaactttattcctttactttctccagtttataattatcttaagtattttgtttacatacattgagaaaactatcaaacaatgttttactttttgctttaaccatcaaacataattttaaaaaaaaatcaatagaagaggacagcctattgtatttatccatattttttgttctttctttgttctttctcattcctgatgctcaaagattccttctatcacttgtttctgtttggagaacttccttcagccattctttaaatgttagtttgctatcataaggacagaaaaccaaacaccccatgttctcactcataggtgggtattgaacaatgagaacacttcgacacagggcggggaacatcacaccccgtgagccactgtgcctggcctattctcttggcctgtcagaggatggagggctgggggagcaatagcattaggagaaatacctaatgtaaatgacaggttgatgggtgcagcaaaccaacatggcacatgtatacctatgtaacaaatctgcacgttgtgcacgtgtaccctagaacttaaagtataattttaaaaaatgttagtttgcaagtgataaattctgttagtgttcctgcatctaaggatgtcttgattttcccttcattaagaaggatatttttgttggttgtagaattctgtgctggcagttcttttctttcagtacttaaaaaataccatgtcatttccttgtaacctccacagattttgatgagaaatctacagtcactgggttttggcctggatttctttgggtttaatgtatttgggatttactcagctttttgaacctgtaggtttgtcttttgccaaatttgagtaaatttcagccactgtttgtttgaatacatcttcagcctcaccttttattccctctccttctgtgactttgatgacataaatgctttgttatagtgccacggatccctgaggctctgttcatacatatttttcagtctactttctctttgttgtttgtccttggtaatttctatttttgtatcttcgagcttactgcttcttttctctatctcctccattttgctattgggcccatccattgaagttttaaaattttggttgttttctcattctaaaatttccatttggttcttctttatatctcctattttctttgttgagattttttgccctttgtttcaagtgcatttataattacttgttcaaaggttcttatgatggctgctttaaaatcgttgacaggtaattgtaatatctgtgtcatttcagtcttggcatctgttgaatgtcttttctcattcaaattgagattttcctggtttttggtattataagtgattttttattcaactttgacattttgggtactacattatgagactggttcttattgaaatcttctgttttagcaggcctcctctgacgctgctccagtggtggaagaggaggcaccacctcattactgccagctggagatggacgtacagctccctatgtggtcgctactgtcactgtggagaaaggagatttattacagtcacagcttcccacttggccctctccaacaccacactggctaggtgattgggatacttccttacagcctagggaggggaaaagtcagcctccccactcagcctttgctggcatgaataggagtgtttttttctgtagatatttgccgggagtagagagcagttattgttaaaggtgttctgttctacacggttgttctttttctgatacactggctagcgaaagcaggcttatgttggggattttttttgtctgtgcttgttggtattactgggttgctagcttctctagtacccagtctgggatatatgaggcaaaaaggggacagaagaaactcaccaatacgttgcctcagttcccaaggtccctagccagtctgcccttttttctctacctgtcagagtcatcttatatctgccttatacataatgttcagggtttttagccgtacttggcagaaagagtagggaaaattacttttatttcatcttgtcttgaaactgaagtataagatcatcttttatgacgttcaaaaattttaataattttctccataaaggtcttatacaactgttgtgtgtgtatatatactatgttgttaacagtgttaattcagtgaatggaaatggttaccactctgtaatgcatgtaataaagcacttacatatacttgtttaaaagctgtttcttggaatgctactcacacactgctcacgctcctagctctttgctaataatatgtattttggataatatcactcctctttaagaattacatattctaatttattgtttctggtatatttaaatgatactgatttttttcatattaatatatccagcacttttgttgaatgctcttattagttctaacagtttctagatactcttgcttttttttttttttttttttgagacggagtctcactctgtcaccaggctggaatccagtgatgtgatcttggctcactgcaacctccgcctcctgtgttcaagcaattctctgcctcagcctcccgagtagctgggattataggtgcctgccaccacacccgactaactttttgtatttttagtagagacaggtttcaccatcttggccaggctggtcttgaactcctgacctcatgatccacctgcctcggcctcccaaagtgctgggattacaggcgtgagccaccgtgcctggccgattctcttgcattttctgtataggcaatcatatcatctgcaattatgattttttcctttttctaatatatatatattatatatttatatattttatatattagtgtgtgtgtgtgtatatatatatatatatatataatttttttgagttggagtctcgctttgttgcccaggctggagtgcagtggcatgatctcagctcactgcaacctctgcctcctgggttcaagcaattctcctgcctcagcctcctgagtagctgggattacagacacacgccaccacgtctggctaatttttgtatttttttggtagagatggggtttcaccatgttggtcaggctggtctctaactcctgacctcgtgatctgcccaccttggcctcccaaagtgctgggattacaggtgtgagccactgcgcccagccatatatatatattttaatatgtttaatactttatattatatttcatataatatataaatattatataatatataaatatatattaaagtagaatactttaatatgtttgtaattattgtgatttctgttatgcttagatttattttttcattttgttttatatttctattactatgttttatttttttttgttgttgttattttgtttttttttttttgagatggagtctcactgtgttgcccaggctggagtgcaatgttgcaatctcagctcactgtaacctctgcctcccgggttcaagtgattctccttcctcagcctcctgtgtagctgggattacaggcatgcaacaccacgcccagctaatttttgtatttttatagagacagggtttcaccattttggccagtctggtctcgaattcctgacctcaagtgatccgccgacctcagcctcctgaagtgctgggattacaggtgtaagccaccacgcccagcctatatttctattactatgttttacattgcttcttttttatttttttctgccttgattgagttgattaatgtttttatttcccctgccttcttctgaaattttggaagttgtatttctgttaatttagtggtcacctttaaaattttacatacacccacggactgcacacacacaaaaattcaagttaatgtgtatattaacttgaatttttgtgcagtccgtgggtgtatgtaaaaattttaaaggtattaaccagagagagaaaacagattgcatagagatatatctccatttagagatagagatagagatatatttcgatttatcctttgagtaataaaataagctaaatatgttttaactctaatcttctactctctatcttaagtgggactgttgggccacattttggtggcattttcctcttcaataccccccggaattggtcattgtaaccttattattattgggattctttttttaagaaaaaacagctttattgagatatcaattatcaccattttagaacatcatcatctcaaaagaaaccctattttttacagttgaggtttatttaaatttatctatatgtttaccaagttttttgctccattgtttcttgaactccagtcctttattgtaggttcagttttcttcttgatgtacatcatttaatatttttttagtgaaggcttatcactgacaaactctcatagtctttgtttaaaagatctcattttaatgaccctcagttgtgaatgataacttctgtatgtaaaattttaagttaatgggtattttccctcaactttgtaaatattattccattgttttttgagttctattgttgctgatgggaagtgtattatttattatctattgtcagtctattttttaatgttagtttttgaatgccatctgtcttttctctctggttaaaaattttctatttgttttcactatgatttgtctaggtttgtatttatttttattcatcttaagatctgggcttcttcaatctgagttcctattgttttacattagactacattcataatacattgctttcaatttacagtttctgtttttaaatagtggatcaagatctaaagacactaaccatagcagccttcccatcgttgttattccctcagtcttttatggccatcttgcctatacacaatttaacaccttttttggttgtgttcttttctattatgcctctctaaagtattcaactttcttagaaataactcttcattttcatacccatatatcatctgtttacagaatatttatttaaattacatagcaaagctatcataaacaagattaggaacaaataaaattggctcttagtaaatatccaacttaactggtgtgagcaaaagtgcatgggatgtactagagaatggcctactagcttcgagcattcacaatgttttctaaataatttcaactcttgttttagattcagggggtacatatgcaggtctgttgcatgggtatattgcatgatgctgaggtttgggatacaaatgatcccatcacccaggtagtaagcatagtacccaacaatttttcaacccttgcccccctctctcactccccactctagtagtctgcagtgtccattgttgccatctttatgtccatatgtactcaatgttttagctcctacttataagtgagaacatgcggtttttggttttctgtccctgcattcattcacttaggataatggcctcgagctgcatccatgttgctgcaaaggacttgatttctttactttcttatggctgcatagtattccatggtgtatatgcaccacattttctttatccagtccaccactgatgggcacctaggttgattgcatgtatttgctattgtgaatagtgctgcaatgaacatgcaagtgtgtgtgtcattttggtagaacatttagttttcttttggatatgtactcattaatgggattgctggacaaataaatggtagttctgttttaagttctctgagaaatctccaaactgctttccacagtggctgaactaatttgcattcccaccaacagtgtataaatgttcccttttctccacagtctcaccagcatctgttactttttcactttttaattaatagccattctgactggtgtgagatggtatttcattgtgttcgtttgtttttgagatagagtctcactccatcacccaggctggagtgcagtggcacaatcttggctcaatgcaacctctgcctcccgggctcaagcaattctcgtgacttagcccccgcaagtagctggaattacaggtgtgtactaccacgcccagctaatttttgtattttcagtagagactgtgtttcaccatgttggccaggctggtctcgaactcctgacctcaagagatctgcctttcttgggctcccaaagttctgggattacaggcgtgagccactgcgcctggtctcattgtggttttgatttgcatctctccagtgattactgacgtggagtattttttcgaatatttgttggctgcttgtatgtcttcttttgagatgtgcctgctcatgtttttgcccactttttaatggcgttatttgttttttgcttgttgaattgtttaaattccttacagattttgggtattagacctttgttggatgcatagtgtgtgaatattttctcccattctatatgttgtctgtttactttgttgataatttcttttgctgtgtagaagctcttttgtttaattgggtcccacttgtcaatttctgtttttgttgcaattgcttttgaggacttagtcataaattctttcccaaggcagatgtccagaatgatgtttcctagattttcttctagaatttttatagtatgtggtcttgcatttaaatttttgatccatcttgagttaatttttgtatatggtaaaaggtaggggtccagtttcattcttctgcatatggttagacagttatcccagcaccatttattgaatagggattcctttccccattgcttatttttgttaactttgtcaaagattagatggctgtacctgtgcaactttatttctaggttctctattctgttccattgatctatgtgtctgtttttgtaccagtaccacactgttttgattactgtagccttatagtatagtttgaagtcgtgtaatgtgatgcctctggctttatcctttttgtgtaggattgctttggctattcgggctcttttttggttccatgtgaactttagaatttttttctaattatgtgaaatatgacattgttaatttcacaggaatagtgctcaatctgtagattcctttgggcaatatggaaattttaaagatattgattcttccaatcctgagtattatatgtttttctattagtttgagtcatctataatttcttttagcagtgttttgtagttctcattgtagagatctttcatgtctttggttagatgtattcctaggtattttattttttgtggctattgtaaatgaaattgcattattgaattggctcttagcttggacattattggtgtatagaaatgctactgatttttgtacactgattttggatcctgaaactttactgaagtcttttatcagtttcaggagacttttagtagagtctttagggttttctaggtatagactcatattgtcagtgaagagagatagtttgacttcttttcctatttggatgccatttatttctttctcttgcctgattgctctggccaagacttcctcaagcattcatagtgtcatacaatgtattttacaggaggaatggaaagagttgattaatcaggagagtaatgagtaaagaagttagataaaagaacttctactgtattgagcatcttctatgggccaattactgaaatggtatatttaagttataatagtaaataagatagacaaatcttttgctctcatggagttaggggagaagaaacaagtaaatatataaataaaccagatagttaatttcagataatcataagtatgatgaaggcaatcagacagagctataaaatagagggtaactgaggggtggaggctagtctatatgaggtaatcactaaagacctttctgagcagtgatatatgaggtacaatctgaaaaattaggaggcaggaacctggaaattcagaaggagagtgttctgggcagaggaaacatttctggtctgaggcaggaatgagcttactgtgctgaagaaatagaaaggactctgtgactggtgtttcattagcagaagagagtgtacatgagatggggtagattagttacaccagggctagaagaaacagggggtttgtagacttgtaatgattttttatttgatcttgagtgtgatttgaaatcaagggatttcaggatggggataacaagaactgatttatactttttaaaagataacgttggctaatgtgtagggtcaggactctagaagggcaacaggtgaagccaaaagaccagttaagaagctgtcttagtcagtttgcactgctataacaatgtactgcagactgggtaattaaccaacaacagaaattttaaaaaataaattttattgtgtacatctgaggtttacagcatgatgtatgggacacatatagatagtaaaatggttattgtgatgaagcagattaacatatccatcatctcacgtagttactttttaacaataggcatttattctcacagttctggagactgggaagtccaagatcaaggcactggcaggcttggtgtctgtgaaggccttttttccacttccaagatggtgccttattgctgcatcctctggaggggaggaatgctgtgtcctcattaggcagaagggcagaggaggcaataagggacaaactccctctatcgagcccttttttgaaagtatttaatcccattcatgaaggaagactcctcatgactcaatcacctcctaaaggccacacctcttaatactgttggattggggattaagttcctgcacgaattttggaggggacaaaaaccattcaaaccatatcagaggccaatgttgtagcctggatgagagattgaagtggcttggattaagatgacagtaagtgaatatcatagtaaatgtagacaaaaaggtagagatttgaagtatattttggaggtagacttgaaaagacttgatagattcaatatatggaggctgagggtaaggaaaagaggagaaaccgggttggtgccttattttgggcctaagtgggtggatggtgatgccattttctgaattatggaagaccagcatgggaatatattttaggggcagaattaagggttctcttctggtcacattatatttgaaattctgtagcagctatccaagcagatattttaagaagacagttggatatgtgagtccagagctcaaggggagatgtcaagattgtaaatatcaatttagtagtcatcagcatatagataatgactcaagtcatagaattgtatgagatcatctagggtgtaatgacactagaaaagaaggctaaggacttagccttggaatactttaacatggagagatcaagcacagaaggggaagatagcaaaagagactgagaagaaacagcaagcaagataggatagaaccagcaatttatcctaataagatgactggacaagcatgtaaagatataaatgcagaagtgtattcatcacagtatttttttcttttttgagacggagtttttgctcttgttgcccacgctggagtgcagtggcactatctcggctcactgcaacctccccctccaaggttcaagagattctcctgcctcagcctcctgagtagctaggattacaggtgtgcgccaccacacccggctaatttttggtatttttagtagagacaaggtttcatcattttggctaagctggtctcaaactcctgacctcaggtgatccacccacctcagcctcccaaaatgcagggattacaggtgtgagccactgcacctggcccacagtatttttataatagtaaaaattggaaataaatgtctatagagagatagttaaatcatggcatgcatatatatatatttataacagaatatgctaggcaaacattaaaacgatgataccaatcaatatttattgacatataaataagtccataatacattcttacatgcaagagcagattacaaagtagcctatatagtatgaagacatcagtgtaaaattatatgtgtgtatgtgtcagagcatgtatgtaaatagggtcatgatggtagtttttgtttttttgttttttctttttttagatagagtctcactctgtcgcccaggctggagtgcagtggtgcaatctctgctcactgcaacctctgctgccccggttcaagcaattctcctgtctcagcctcccaagtaactgggactacaggcacgcgccactatgcccagctaatttttgtatttttagtagagatggggtttcaccatgttggccaggctggtctcgaactcctgacctcaagtcatcctccctccttggcctcctaaactgctgggattataggtgtgagccactgtgcccagctagtgttttgtttttccactttgtttatagatgtatcccttgagcctaaaacagtgttaagtatccagtagacacagatgaatatttgttgaaggaatgaataaatgaatgaatgaacgaatgaatgaatataaaactttaaccaaaatattaagagtggttatctctaggtcctgtgataaaaggtcttctattttcctttcttttgtattgtgttagattttttttttacaatgaccatacattctttttatcaggaagaacattcttttaatttttgaaaccatcctcacctttatcagttacctatgacttccaagtacccctatttggctgaattcagagcaaagcaattgctttgctactgaaaatccatatttaggcaggtatatcagaatgataacagggagatatgttgtctcttggagagctggaggcagaaaaggtgaactaggagtgaaggtcaacagcaactgtgagaaagaaagacttgtgccttggaagaaagttgagctgagattttctttctttctttctttcctttttttttttttgagatggagtctcgctctgttgcccaggctggagtgcagtggcgcgatctcggctccctgcaagctccgcctcccgggttcacgccattcttcctgtgtcagcctcccgagtggttgggactacaggcgcccgccaccccgcccggctaattttttttttctatttttagtagagatgggttttcacagagttagccaggatggtctcgatctcctgacctcgtgatcctcccgcctcggcctcccaaagtgctgggattacaggcgtgagccaccgcgcccggccaaacagacattttcaaagcagaacaacatagaacaagaagctgagggccgcttgcaagcctgaccttggggagaagagcctgtggaacacttagagcacagtaaattttgcaatctaaattcttgattctcagttgtgtattgatacaggagttaataaaggagccaagctacgactcccagattgtgctgtttggtatagaaatgcctaattccctttggtggttgcagtggaaaatgaaggcagtcttctgtatgaagaagtccctggttttctatttttctctgaggctgtaagaaaaacaagttggattatgttttttgaataattgattggatattctttgggattccacgtatgtgtttgcctaatctctctctatcctcccctccactccccctcattacccacccactccccatcaacagaaaagacttagatttctccagtatgggaggttagtctcctgctagcatttctcctgtactgtaccatgcaaaatgagtgctcatttccttcctggccttgagttacaaaagtccctctgctattgcccaagtcttggaaagtgcaggctccaggaaaagggtggtggtagatagagttgccagataaaatacaggaaagccagttaaatctgaattttggataaccaatggattttttttgtataagtatatcccaaatattgcatgggacatacttataccaaaaaaagtcattgtttatctgaaattaaaatttaactggatgtcttttttttttctaaatctggcaatcctagatggagaaaaaaaatccctcttgtgatacaagggttttctcagtgcttttcatctaaaacttaccagatgtttcttagatggcctttcagtttacaaaaggggaaaataactaactgattaagtcaaggttagactgcgaatcagtgctagggctgaaaatttaagttttcaagttttccagcacatgatctaattcagcaaacttttatcaataatttattggctgtaaggaaacaggattagaatgatcacaaaggtacatattcccatgaaaagtaaatttttaaaagattctaaaggtgacaagcattaaggttttactttcctccatggtcatgactgggcttagcctctaaagaagtgtttttcacagtgtagtctttattctacctgcatcagtatcatctggaaagcagtctgtagatacagacagaaagtgaaggtaatgggtcctttgaaagtttgagttcctggtctttgtcttgtaggcaccacaatcacttcctccatttccacagcctttagttccactaacagcttgtatctggagggtctcaatgctagagagctttctggttattttagtttttgtttctgccattacatattataaaaggtaatttattaaaaggcaaaattgaagagggatttgatatcccccccagcacagccaaataaaggcatccaaaataagcattagatgtaaaagaaaaaatgattgacctggcctctattaaatcaccaaatttaactggatcttggaatctgaagaattctctatcacctatatctcttgcattggggccttgccattccacaaaatttattctctacttttcctgggcctgactccaagagaactaatcatatcttaataatttggtacagagtcacagtgtaattgctccaggtcagtattgtatcctatcagactggagtacagaaatgattatcaaacattaaaaagaatgaggtcaagaggtacaacctgactttcaaaacatccttaggatgtatgtatagccagaatgacttttttagttgaggaattatgatgatctctaataggacaaagcaaatgtattcagtcagtctgtcatttcagatttatagcaaacaatctcacatttggtcaattcctcaatcgtatgctaataaaaatgatataaatagtttggtaactcaccctgtggtactaaaatgcaagtaacccaagatgggttggctatgttgttctcatctccctttatcaccagagacttgattcttcttagctggcattatatgctgccagttgatacttgcctaaatatttccttcgtactcagaacattatagttactttttcaagcttcaaatatttccgactaattctagaaatacgtgaggtatgcctgaaacgctgacagctgtagcttacacccaaaatagtcaggcctgctcaaggagatgcattgagcaaacagaaccaggagtttgaaggtgacagctgaacaggcatcaataggaaattgccaggtgctcagctgatccagctagggatgggaacagacagattccatttctagaaatagcacagaggatgccaacaggtcataggatataagctattgcacaaatcttcccttccatcttctagggagcttggagggtatcttaggaaccttaaacttgctgaaaaaaattaacatgtctaatgaataatttttgatattgacttgttgagcccctattagtttcaagttactttcctaggcactgttaggggcagggatacaaagaagtttagacacaggctctactcacacagagttttcacaccagttgaggaaacaagacccatatggcaaagtcctgtcttataaggggttagattcttgatgagaaaaaaaaatcatttatagacaaaacgcacctcgaaaattcctttgagaggttcaatattagagacagacataccatttttcaataagtcaaacacagttgttttttttcccctacaaccttgtaccagatcactttttctttaattgagaaccaagccaattggcttgcacttagaggctgtgttgaattttttaaagcgcacatatttaagcatgagaatctcaccatgagaaacccacaggaactgacaccatctgaaggaacatcagattcacgtctctcaactcaatttaactccagggcaaaacttgttgagtagaataatagttaggattgcccacataattttcaattgcttacatgatcttgctctctgtctctctctctctctctctcaatttcttctgtatatcagccaactcatataagaatggtgtacttgtgatgtgcctctccatacccacgtaacaagacaggagaagctatgcgaaggcgagcttcaccacttactgactgtatgacgttggcccagtgaaccctctgagccttcatttcctcactaataaaataaggataataattgcatcttccttgcaggattgttctgtggattaaatgcagtgatatttgcaaaatgcttagtctaatgcctggtagcataaaagcctcaatattaactattacagcaagtggtttatatgtgatgtgtcaaatgaaagagacatgccttatgtgttataacgtacataactgagtagtgtattggcagggaggggttcatgggtgagatcacttttgaacttggtgagatatgggtaatactggagagctggaggcaggaagggagtgatggtggaagcagggagaaagccaagacatggatgagtcaggatgtctagagacctgaaatacatgggggtgggcagtaaagcctgtggaagggaataataaaatatgctgttggaggaggaagccagggccatgtgattgaaggccttgaatgccaggatgtggtgctggaagcagtgaagaattgtttgagattttttactcaagggtgatgggatgataaaacagttagtatactttcaaattcagctcatctgtcaaatccagcttacagccacttccccctactgcatctcactcttccttttccaaacattgttgacaccgattgctccccttccccctaataattttgcccttaatctaccaccttatctcaaggctaaatgttttctctgagttgtgcgtgtggggggagagagagagaaatatttttctccaaagatagggtcctgcctttcacttcctctgtctgccacacagagtttagcacattgtggactctgaaggaataatttatgagttaactcaatgattgattatgggcatgcctaattggagcaccaaaagcaacgtgtcccttagacaggatgagtactggctctgtgaggaatgtagtaaaacgaaaggtggacagggttataggtcataggctcattcctgaagccccagaatcaagttttttgaacattttcctaaatgtctttgcctaaagacatttgttaaccaggaatctgccaagccaaacaaaggctggctggctggctggctgggctaactagtgtccttaccaggaaatgcaggaaatggaggactgtccagaaggagatgccccaaatgcagccctgtggggaagaccagcttcctcagagcccagagaaggaagagaaacagcctctatctttaatcacagctattcaagaaacaggctctgctgagagcagcagtctctaggggggaaaaggacagtctttgcaaaggaaactttttttctaacctgaggtcaagaccaagtagttaaactttgaagggactgggaaggatagcctgggtatgtaatgaatggaaagagcctattacaccctggttcagaagaaccacaactccatgcctgtcaccatccgtcttcccaaatgctcatcaaatgaaataacccatctgtgacaaatcttcatttgtccaatgtggaagtgcaaagcttttctaatatacatctgcatgttatcctggtttgcaaaagcctccaagcacatcaacaaaagaagctgcttgaaatggattctggttaggacttgtcccttgctcatgttcaaagtgatgtcgttgctgacaattcagaactctcccacttgccaccttctccaggctcccaggctgttttctgaattcccagaagaaactgtttccatggctcaaaatgaccccttcttaggcctctaccaatcagagtctcatccctcagtgccccccatctcatctagctgctagagagaacgcattcttatttaactaatgcacactaaggtgtaagtgaggtcatacacgaactagccaggtgtgtttacatttccagaagggccgtcctaaggaacagaattctaaacagtcaaatttccagagttatttcggcatgttgtgtgatgagacaagccttattgggccaactcaaatataccacatgggtaaccgcctcagccacgtctgatgccgttcctttctcttggaatattctggcctctcctgcttctctctccaaatcttatttttccttcaaggctcagctcaagtcttacccatgaagcttgcccagagcacacctggcttgaattcctgccctgctcggaagtcattgctcctcatttgttccatctgggttggtttggtttcctcgaacagatcctgagctctgtgagagcaggaatcatgttttaaacttcttgccactcttccacaactcctggcatgatgctggcctcagaggatatgtacaagaaatttttatagtaacagccatagcttctccacatgtatcagatttgagtcacagcagccctgtaaggtaggtggtattacccccattttacagaggaacttgtgaaaaaaaaaaaaagaaaaaagaaacactgctcaaaagaaagaagttaaagtcttgtctcctttctatttctggagattctcaatatatcagtcaatatgatatatacatatatatatatatatatatatatatatatatatatatatatatatttttttttttttttttttttttttttttttttttgagacggaatcttgctctgtcgcccaggctggagtgcagtggcgcgatttcggctcactgcaatctccgcctcccggattcaagcaagtctcctccctcagcctcctgaatagctgggactaaaggtgtgtgccaccattgccaccatgcccagctaattttttgtatttttagtagagacggggtttcaccatgttagccaggatggtttcggatctcctgacctcgtgatccacccgcctcagcctcccaaagtgctgggattacaggtatgagccatcaatatgatatttttgagtgtgacctctgtgccctgcactattggaaatataaaaaaggtgtagacctggagccctgtcttcaagtcagccatggaacagtgacttccaaacctggttgatcaccaaaaatacctcaggagcttgttaacacagagacttccaggtcatccccagagattctgactcagcaggtctgggatattgtcttggtattttctcaaagccacctgagggattctaataatcagccatgtttgaaaaccactgccccagtgatccatatcttctcatatatgtgaacaagtcaggtgtttctggaagagtgggaggcacagtactcttgggactgggaacacacaaacttcatattttaattatatgtttattttagtgtgtattagaaagaccataaccattccacaaaactatgatttcccagatatgatacttttctttcattaaaagtgtatttaattctgacacatgctacaacatggatgaaccttgaggacattatgctaagtgaaatataccagacacaaaatactgaaggatctcactcatatgagatacctagagtagtcaaatttatagagacagtagagtggtggttgtcaggggctgcagggagggagaaatggggagttagtgtttatgaagacagagtttcagttggggaaaataaaaagagttctggagatagatggtggtgatggttgcacaacattgtgatgtaccaaatgccactgaattgtacacttaaaatgtttaaaatggtaaattttatgttatgtatattttaccacaataaaatgtactttaaaaagcaagatagagaagtttaaagttggtaaaagtagagacggactgcagatatggcaatcaggaaagtgctgtgcaagtgactggtgtttgagaaatgattgtagtttgactccctcattttacttaggagggcaccaaggctcagagaagggcagggacttgcccaacatcacacattgagtcagtggcagggccagtactgatatccaggtctcccaactctgtcagtattttcaaatttatatcatctgattcattgctcaaatatcacggtgtcggcaacagacacaggagacacccgtgggtgctagagaagttggggagggcttgatggaggaagtaggacttgatgaaggcccttaaagatggaaggatttgtaagtcagaggagatgaaaacgggcatgaacacaaaactctatcagcaaaaatgaatttggtttctggtttgtatggagatagtgaaaatggaaccctaactggagcagttatgttttgaagtaatagaagcctctcgaacaatacattaatttggacttgatatagtaaacaataggcagcccttgtagaattttgagcacaggcgtgacatggtgaaagcaggcttgtagaaaggttaatctagcagtgaccaacaggatgcatataatgaaaccagaccagtgagtgggctcttctaggaatccagccatggtatgacagggaccagaactgggatggtgggaataagaataaagaggcaaaggtaaatcagtgactcattcaaaggcaagtcaaaggcagaacagccagaacttagtcattcatgaaaggacagattcaagattcttaagcctggacgatagagtcatagtagtgcccttaactgaaatgaaaaacaaaggaagaagaaataatgtggggcaaaggtgaaacatttggttttggacataaagagttggaggtggtaaagaaacatccaagtaaaggtagtttccaagcagcttgaaatatgagattggcccttgggttacaggaaagaggccgttaaactctcattttaaatatggatactttacacaaggatggtgttctagtgacatattcatttttgtttagcattaatttgaaagacatattgttttcataaagaaattgtggtgtaagactttgaacgcaagagaacaagcatttaaatgccttaaaagccagaaaacatcaaggaaagggtggggattggcccaagtgagtaattataaattttctcttctggaaagaaaaaagagaaaaaccatggtgtaatttccagttgtcttttcttggagctttaatgcatagaaggatttagtgtccttgtcacccaatacaacctttcaaagaactgctggatgagtatttagtaatgaacctttgggaacaccttgtatggaatccagctcttctgcaattaatgcaggatggcagctgcctgaatgattcatatcaggacatcatgtaataccacataatttgacaaagtgagaacgggagagtggacaatatttgctctgttgtctgttacatacttgctcagtgaatgaaaggctatacctccttaagcataactgacaaaactcttggacttgctaacccaaaaaattcatctctgatttctatgagtcaaactacaataaactgtctgaattggcgaaaacagcaggtttcacagaggttctggacatttttacagagagaaggactgtgggagccttttcttttaattctttcttggagtctgagccggtcatcaggaaaacttgtgaagtttctcttttagcccttccaccattcttcctgtcttctctcttctcacagcacttttgatagtctacaggctctaagttcccagagctagcacagctccaggtccccactgtgaggcgtcactaagactcataataacgattgtgtattgagaattgacaatgtgtcagacgttgtgctaggtgctatatatatatatatatatatatatatatatatatatatatatatatatatatgttatctcagtcctaaaacaaacttatgaggtaagtactattattcccttcattgtacagattagaaaagtgacgtttaaagaggttaagtagattccactaaggcacaaacccgagtctggcactctttccaccacatcaaccttcatcataaagtgataggaaagacaggggtataacctagctagccaaaagcacccagatcaaccctagcaaccagcagactctcacatcatttttttgagcagtgaagttcctagaggcccttacatctgccccctaaggcagactccactgatggcctaaagcaggggtgtccaatcttttggcttccctgggccacattgaaagaggaaaaattgtcttgagccacatataaaatacactaacgctaatgatagctgatgagcttaaaaaaaatcacacacacaaaaactcgtaaggttttaaaaaagtttacaaattgtgttgggccccattcaaagccatcctgggccacatgtggcccacgaactgtgagttggacaagcttggcctaaaggaaactagaaagatgttttctacccttaacatgggcaaggggagagttttgttttggcaggaagtttacagttactctttagatgcttttgaattaagaaattgtaacacacatttttttcttgggcatttccaatgattttgaatttgcactttgattctatctagccctgccatgactgatctgtgacagagccatgatgctaatatccctttcataatatctttccactaaaacattgatcttaagagtggcacaggatttgaggggcaatgagaagctttatgatttgcatttaccccttgttagattgcaagtctcttgaaagagtagactatcatctcttcttgcattaccacccaattctgtgtcgggattaattcatcccattggtttccaagatgaaggctaagaaccatgattctttgtcatattggaagaagaaacaggacaagagacaagcagaaattggggctctagaagggagcaaccaagagaagcctgggcttcttcccaaatttatcaagcctcggcgctggccctgaacacatggcagtctgtacaggtggccaatgcagagacttaaactaagacccattgccttctgctatgattcacaagaggttgaaggaggatctttaaaaagttacaataacataagtgctgtcctgccttaacaaagctaatcactgctgacctaccctaagcaggactgggtttcaaggggtttttccattggtggacaagactcagactgagcacgtcacactctctcacctagtattgcccgtaccaaacaagatggctagctgagatgaaggagggtttctagccagggaaacatattttctttgtttatttacttttcatgaaactatcccacagaagagtcaaaccagcaattctgccctctttagtataccctgggtttgtcattataccctgcaagagatactcttgatcaccaactttcccatcttcaaaccatagaatgacagaactgaaagagaattccaaacgcatctcttctcacacttagttgcatggatggggaacagagaggcctagagaaggagacggattttcttaaagtcatgcagtgacttagttatgggctagaacccagatttcctgattcctggatgagtactcttccaccccaccacaaggtgactccatcaatagccgacatccgattaaggacttcttggcttacgtgtgtgtcaggttctaaagtattccttcattggcttttcggcctcacttgataatccaaggctgtgtggatagtgcctaagtgtcatcctagattgttctccccagatcagttgcaatccaggccaggatggaacagtgccacaaaatcaatcctccctggcctctgcactgtgagtaaacgaaaatgaatgtctctgtcttctgtctggggctttcggattgctgagcagatgtctgtctcaaaatgactccttagatactggacaagaaaaaatatcagttacacaagccccaataagggaacacaagcttttagggtgtgaaaaagctattgttgcctagttcctgctccccgacaagagcaaatgcacaaaatattgaattttcctttttaaagaagatgtacatagagtccccgacttgaatagccttttaagccttgcgtttcttagaaaattggcttttaaacccaagcttgagcttctctgaggagctcttaacctgttcttccatgaggcattagattctggttaccattttttccattcacatgaagtgagcactatttcctaagtactaaccaaaaaaaaaaaaaaaaaaaaaaaaagggacgccattttgtccagcctgctgtattccatatatttccatgttttacctccccttattcaacagactgtgacccagtgtgggcactatttttggagctaacctaagcagtagaactgtggcattgggatgaggaatttgagaagggattcctatgtatctggtgctaggctcagctcttgtttcactgcaagcctcagcccagtaaaagttatgatcttgtgttgctacctaatgctgcagatgtctagttcctgtttgatccactttcaacaactcaaatatagcaggggacacaagttggagcatgttcctcaggaagggaacatgacacacagccactcactcagcagggctaaagctactcctctgtagagactgacagctgctctgctgaggccctctggagcagctagtcagtctcccaagacagggaaaagccatttattctcctttaccaccttttgccatgaatagagaaaatcgggataagactgtctttcttctgcatagtccaagtcagggataaccttgtgtacactttatgggatttgagggatatgcctagggccagctttaggcgtagctgaaatagatgaccatgtccacattttaatgcaagggctgtccaataaggctctaattatctcccccctccagccattatgctggcagaaatcctagaccagtcatgtcaatcatggagactaccatttctaccatttccttctaagggaaactgcacagtcccttgctgaagaaaatagccctaaattattacttgagaatgaagtggtaacttcttagattatggatgagtacctgacccaagctgatggatgacttttgtatgaagtggcctagcaagaaaaaaaactgtacttagtaggacaatgggaagtagctaggacagatgacctgtctttcgaggatgtaagtatgaaaatactgagattttcagtttgtgggcagcagaaatgtaaatgaaaagacactaaataaaaacctagagtgttttttttttttttttttttttagtggcagagcactcagtaacattcaggatattgaggagatggtaagattcaatccctagaactctcttccttcctgaatgatgccaattcctgagtttctactaggagttttagaaggacattcatttgccttcatatagttgggggagaggctgaactatgcaaaaggtagtttttctattgagggttatatggagaaatttttagcaccaggtgggctcccttcctttggaatttgattgagactttggtaagcctaccaatctctttcacatcctgtagaagagtcccattctcagtctccttctcccatttcacccctcctcccaaaatgtagtcccagattgatcatcacttgatgtggccagcttcccattaggaccacaaaagatcaccccctctctttctgactgggcgttccaagccagaccagtctagctagagaatgtgcaagggacttctgataccttgcctgtagtggacatgccaatttaactttttctttcagacctagtctaacatgattgcagatgcccagctcaattttcaggccttatgcatggtacccacacagactgatgttggcacaaagtgaggttgggcacagagccagtattgactttgtggcagctccggaagcagacagcctttcatggaagtgtacatcattccaagtctcttgtcacaatgctagtgtggatggtttcacagtatttttcaagccacatagacactccatgtttgggctcagtgtcagggacaacactctggaagaaccacatccctgactttaccaaaagccatccccatcatctgttttcaatctgggccgaattagcctgtgatgggaagcagagaaagataaatggttcaaggccactgtttgcaaacccctggcaatctatgatggaaaagatttgtgacactcagatctttgtgccatcacacagtgagagcagaccagagtctcttctagtcttcactgagtagggccatctgaaccagtttgtggaattcacctctctatttttgttgtttatgttggagataagtaggcccacaataacagagaaaagataccctaactgacatctctaggatctctgtagatggaggcagaaatggccgtggaaagcctgagatgattccaaggcccactagattaagccaaatctcattttattgctcaacccacacaccccaaatcaatcaattgcagcttcaatcacaggagaaaatgaaaactttaaagctatctacttcttgatttttctttgtgtactgagacttcacagaaaattctggagatggagggaaggatgaagaaagtattgaaattgaacaaataaatcacacacaaaataatattgcacatatttcctgggcttgtctctaccacttataaagtgaacagggatgaaatgacatcttggtttcacagttgaagagtccatatgctcttttactttatctccacttactgagtttggcttttaaggggcacttctcctaggccatctgattagctgacatcctctagtcaagagcagatagaggccgggcatggtggctcatgcctgtaatctcagcactttgggaggccgaggggggcagatcacctgaattcaggagtttgagaccaccctggccaaaatggtgaaacctcatctccactaaaaatacaaaaattagctgggcgtggtggtgggcacctgtaattacatctactaaggaggctgagacaggagaatcacttgaactcaggaggcggagggaggttgcagtgagccgagatcgtgccactgcactccagccagggtgacagagcgagactccatgtcaaaaaagaaaaaaaaaaagcagatagagaggtacttgagacacccatggcaagaccaggatccaataactgtgaagaaaagagaaggagtcatttggccaaaggacccttcctttccccttgagcccctcagaacacacctaagcttgcttgtctccctggctggagcagaagccagggctccttgccccatccagctgccctgtgaagagcataatttgtcaaagttcctattcttcaaagttcctgctaccagacaaactaaatccggtttaattatagaagcacagaacatctgagtcagaaagggccttaaaaattactttgcccagaagaatgccaaggcataaatacagaaggaatcatagaattaaaatatcaccatttcgcaaccatcatcttaataatggatttagacaatgatcatcaacgtatgctgaaactatagggtgcaagtctacgttagtttgatttcttggttatggtggtatcggctcaatttttccactataaaactatctttttcccctttgaaattacaaccctaacaacaataataaataagcctacaatggagcaaaattacataatgtgtcttctgatgtgactcaatatgaggacacaacatcattttaaaacaaaaagctggagaaaaagcatcttgtcacacaaattgggaaactgatacacaacaaggagaaggaactgagtctgaaactgggattagaatatttttccatggtgtcttggtgcaccatctagttccaaccataatgatgttggtgatgatgataccttcatgttttttcaatcaatttttttttcagtttctactatgtgccagatagtgtgcttggcactcaagagtcatcagtgaattaagcaaaagatctctgccttcatggggcttatatttattttcatgctttttcatctttaccttcttcatcctcatcctcatcattaccatttcaccttttttaaaaatttgtgctcctttgcacaaagactcctaaatagctatatctctaggacctggcacagcatagctttttaataaatagttgttatcttcaattaaggaatgtgtatgtgcacatgtatgtatctgtgtgtgtgtgcatgtcgtgactgtgtatataatgccatttcacttctacactgtagctcagtctatcccccactgcttgaaatagcatctccacttctctcacattatccttcaaggcagcctcatttccttagtgatgacttcccaggaggaccccctcctcttaacgaccaaagtgtttaccactcatttaaatctcatcatacacagtatgtgacagcttggggactgtagtttattcatttaactctgttaagggccactaattaatatgggtaggtaaaatgatttccagtttcccaggggccctgtgaaaaccacgatgccctaacaaaagagcagctattacaattttaggccctgagaagacagatgaggccccttctctgatgagcaccttggtcatgcagaatcttcctggcctggtcacatgagcctgattgcaattctgcccccaatctgccggtatgattctggtcaagtcttagccccttgaaattcactggactcacctgtacaatgaagcagttgttctctgggcacttgggtcctttgcaattttctatctattaggcttcattcttcctgacttcaggaagagaggatatggccaggatgcttgagaaagtacagtgccttctcaaatggccccagcactaccatgtctgccctgctctaattaaaagtgcagtgcacagacacttgaatattggccttaattaaggcacccaaatgaaaagcctagaattgcagcgaatgcaccacatatagaactgattttccaaacccttagctgggtaatgttctcaagaggctacacacaagtgacgaagggatcagggaaggaaggtgtttagtttagtttagtttagtttagtttagtttagtttagtttagtttagtttagtttagttcagtttagtttagttcagtttagtttaggaatacttgctcatacagaagccctttcaaaggcaaagaaatggccagtatttcaggcaggaccctcttcttttccctctattcactgcttaacagctccagggcacgctggcatgtgatgtgacagccagtgtgatagagtagctatgatggtgtgctctggcatcagggatacctgggtcttagtcttagctctgtcatgcgctggctgcatgactttagccaggtcacttaacctctgatccttagtttcctcatctgtaaaagggaataataatgatactacttcttagggtcgttgtgacaattaaacaaagggatgcttagaacagtgcctggctcttagttggtgctctgtgagtgttaggagaaaaatgtccaaattgcaatattgggacacaagagtacccatgtccttctgaagattcagggtggtagcatgtttgaaactggagctgtcctacaaaattcagtctctgcctaggaagcagtttgcactctgctctttgcctgaaaactctgctcagtggcttgatcaagtgggaatataccactccatggcggaaagaacagagacataaactctaagctcagagagcagctaattcaatcaccctcttgctcaccttcacccgccaacaccaaacggacccagaaactccaaaaaaggaagtgaatctctgaaggtcacacaataaactagtggtggacagttctacctcttgatctttttactgcttcttttatgaataagagttgagaaacaaaatgtgtgcagtatagaacagattcaaaaacaaactccatgaatctaggagacttaagctagtctctgtacaccagggtttctcaactttagcactattgacattttgagccagatcattacaaattattaccacacattgcactgtagaatgtgtagcagcatccctggcctgcttgctcagttgtgtgacaacgaaaaatgtcttcagacattgccaaatgtctgctctaggggtaaggtggggtggcagaacttcatgttgagagcacagctgaataggagcagcactgtaaatgtagcttgctcctcagagttcttttcagcactcttctccactatattgtctccaatggtgatatcatccaaccccgtggctgatggcttccagatgtggagctctagacttgacctctccagcccactcctgtcttatatatccacggcctactcgacatccctcttgcacatgttataggcatctcagacaataccgaactcctgattcttgagcctaccctttctccaactcattcttgccttcattcattcattcttgcattagacaatattgcacacctagtgtattcatttcctgtggctgctgttacaaactaccacaaacttggtgtggtctaaactacagaaaatgttttctttcatagttctggaagccagaagtcccaaatcaaggtgtcagcaaggccttgcctcctccaaagattctaggggagaatctttccttgcctcttccaacttctgctggctccaggtactccttggcttgtggctgcatcactctgatctctgcattggtcatcacatggtcttttcctcttctctccctgtggttctcctctgtcttttataaggacactcatcatttgacttagaggccacctatataatccacaatgacttcatcttgagatccttaattacatctgcaaaaatccttcttccaaaaaagtcatgttcacaggttcctgcggttaggacacagatgtatctttttaggggccatcattcaacccaccactcctactatgcaccaggaatgttatagatgctggggatacagtggggaacaaagcaaagtccttgatctcgtggaaattacattatactgttagaagatagatagacaataaatggataactatataatatagaatgtcaggtagtgataagtgctagagagaaaaagaaaacagggtaagaagatagaaaatgatggggtatgctacttttgatagggcgctcagggaaatcctcttggaagaggtgatgttcaggtagagaaccgaagcactggaaccagacatgggaaggtcagggaaaggtgttagaggcagagggaacagaaagtgcaaaggtctttagaaaggattattcttgacatgtttgagaaaaagcaaggaggccagagtgggtgttgcacagacagtgaccagaagagtggcaggaaatgagtttggagaggttggtaggaaccagagcacgcagggtgttgtgggccatggaaagaactttggttttattccaagtgtgataagaaaccattagaccgagtctacagatgaggggagtgacatgacctgatttgcattttcaaaatatcagcctggctgtgatgtggagaaggaggcatagcagcagggcaagtgtataggcagtgagacgagcttgtggaaagggagaggcactgtctccatccatccccttgctcaaggagtcattcccgatttctctcttacccttatcccccacatctaatccactggaaaaatcctctcagcttcatattcaaaatatatccagaatttgaccatttctcatcacctccatcactacccctcagtcttagccactgttatctcttgcctggtccactatgatagcctcccaactggtctccctgcttcaacccttgcctcctcagtctatttgtgacacaagagccaaatcgaactttttaaagcataagtcagaacatgtcaccccccgggcttaaaacctgcgatggttttccagtgcacttaaaataaaatccaaacactctgccatggccgccattatgtgactctcacctatcctgcagccccattccctaccactctccttactcactacgttccagccactctggccttctttccttaaacccttccagtttgttcctacctcaaggactttgcaccagctgttcctctaggtggtaatatggttttttccagcggctgtcacctcctccaggaggcctccctgattaccctcatgaaagtaggatcctgattgtcaccctgttttcttttattttcttcagagcatgtattactctctgaaattatatcaggtatttgtttgatttattatgtgtttatatggtggcttatttactacttgtcttttcttactagaaggtaagcttcctgaatcagggctcatgtctgacttgtttgctgctatgacctcagcagctagtacagtgcctggcacacagtagcccctcagttaatatctgttgagtgaatgaacctctctcccagtgcacaactggacaggagcttaaggactatccagcgagtggacgtcggaatcacccagagggcttttaaaacaatccatatttccagggccccttccaagcctactgcatcaaaatctcctggggcgggcccacaaatctacattttgaacaagttcagtttgtaacaaacacttatgtagcacttactgctactattctaagtattttacatatattaactcattttatccttttaatagtaattttagtattacagttttactgccaaggaaacgaaggcacagggacatttagtaactttgcccaaggccacccaggcaggaagtagtagagtcagaattcaaacccagtcagtatgtcctcttaaccactactctgtgctgactctgcacaagaagttctgtgatcagtgctgtttgggacccatacataaaattggctccaataaggacactgagacccagactagacaatggacctgattaaagccacaatcagaaatgagataggttttgcgtctttccatctgatgagcattccattctgtccagtcattctgtgctctgtaaagggcagggccggggagtatgctgcctacataaaagttaagtcacaagaagttgtctagaaatgtttttgctgtcagcactggttgtcagggaatgcaggaacacatcctggtattgggatctcttatcatctctgggacaatacaagcttaaagtgggagaccctcttccctcaggagacagttagcaaagccacgggcgacgaagcctgctgctgctggcctagttgaggatggaggtgtaagagaagcccccataatgtcagcggagggagcagtatgtgcggcggagcttatctgctccggtcacaaaaagtgcaccaggcctcggcaggcagcctccactcccctattcccgccagcccccactgagagaaccaggggatggcccagccagatgacatgcctcagttactctccaatgaggccccgggccaaacaggcttttcaatttccagatgctttttaattaaaataaaggccactctgtaacctaacattgaatagacaaagtttccttagtagaatgactgtacgagttcaccctttttccattacttttcattgagcaactgaacgtttctaaccaataaattatgacttgagtcacatgacagcaaggggcatggaagggttaagtgacttatggaaggtcactctgctaaagaaagactcctttgttctagcctcccctcttgctcctgcctctgcgagcccgtattctaccttttggggagacggaaagagggctactctagcctcgctcagaacagcagagggttgagcaatggtgttgtgacctggtccatctgggaattcagactcttcatctctgcttcaaaatggatctcaagagctcagattttctgtattggttgcccacaccatgagttctaactctgcctccatcctttggggacataaatggcaggagggaaaaaaggccactttctttttttttttttttgagatggagtttcgctcttgttgcccgggctggagtgcaatggcacaaacttggctcaccacaaactctgcctcctggattcaagcgattctcctgccttagcctcccgagtagctgggattacaggcatgcaccaccaggcccggctaattttgtatttttagcagagacgggatttctccatgttggtcaggctggtcttgaactcccgacctcaggtgatccacccgcctcggcctcccgaaatgctgggattacaggcgtgagccaccacgcccggccaggccactttatttctatccaggtcacgtggttagagatgtttggggaggcctgtggggggacaaagcaatctcaccaacttctgtcttggacttacctggtctagaatactagcacagaaaaggagcaagaggcctgacgacaggtttaggctctgcccaggtgtaatagcttactttttcttcttaattatgagccaactcagcctttagcagagttcagagacaatgaggctgtctatgggctcagaacaaagcccactgatcctagactccagagttcgatgcattaagtgacgactgattgagctcccctgcctcacatggatcactgttcttgttcaccacatactatgattaggacaactgaggtcccaaaggttacatttgtccaaagagcctcagctaagaattgaagagaataaagaacgagtgttttctcaatgagttttctcttcccaaactcctgtcctgtgttctttttgtgaaagcagagcttaggccgagttctttcttccctgttctgctgaaagattgggtctgatctgtattgccagctgtaaagacaggaagaggaaggagtgagaaaccaatgagaacccatttcaagttttccttgaatactccaaaatagtttcttccacatcctggaagtaccaaagcagttagtgtggtctatcttgggccacatctacatgaaaccaacatagcccataggaaagtggaggacccagccaaccactgtttgagaggctgttgatgtttgttttctacagttctaaattacctacgtctgtgcaccacagatgcttgtgggtcacagtgcatgtgattgaggttatgtatgggttgaatgctgtaggaaccaggtttattttgtcctgggtcctttctcactttggccttcttttattgcctgtgtgaacttttcttatttggatctactgaagacatagaaacatccctgcccttaccccaacccttccatttcattcctgagtgaccttttggctggaggctctcttggcattgcaaagattaagagtgtctccacaggtctgtttcaggattcccaagagaatttgaggcataaggctgagaaaatgagttttaagattcagtgcttggaatatttttcctcaacatgtcatcctgaatctagaatttctgaagaagatccatgatatcagctaatttgggcaaccttggtatcttcctttaccattcaacttgtgaagtgtcataaaagggccatatcctaaatggctcccaagtgggctgttgggccaagattttggtgttcaagtaggccatcttgtgtttcactccgtagggaattgtgatcatacccaacagatgtgtagcttcaaaaaagcaaagggtggtaggctttagaaatatccatctgttgaacatttttcctttcatctgcaggatagataaagaccgtgtgaacggtcctacccagccccacacaagattatagccacatttcttctcatgaacagaagagtgaaggcaagtgagggacatttgaaaaatggctggcagtacctaggtcaggttgttggaagctttttgggctctcattctgggattaagttatgttggaaagcaaggccagcccctttcctccctcaacagatggagatcaaaagacagtgtcagcctaaccatccacaaatctctccagtgtttgacactcactatcaacaaattccatctctctgtgagggaggcagcaatctgaaacagccttattaggccacagggcttggggactggggtggtctctgcatcctatggccacttttcatttggaatcatttggtctactaaacctctccatttattaaaaaaaaaaaaattgagactatgatgagactttcacatgacagagtttctaggctgaaaagaaatggccacagaatgatgggccattttcttcctcacatcctgtcacacaaatacactcaaatttcccttttccctgtctcccctctctctcccttctgtctcttccttccttcctccctccctccttcccttcccttccccttccctccttccttccttctctccctccttccttccttcttcccttcctccattcctccctccctccttccctccctctctcctttcctccattctttcctttccttctcctccctccctctttcctcttcttccttctctcctcccctgtcttccttctttcctttctctttttctttcattttaaaaatactttagcctgcagaggctcacccagtttaatttcagcaagttcacaagcctgagatgtttctctctttctcaccttttcccctgttagcacttactggattctccaaaatggctattacagtttaagcagacacagagggggaaaatccatatttttgtgacttacataaggagtttgagccttgacaaagtactcagtaagtcttgagtttgcctctaatagtatatagctgaaggagtctctgaaatgacaggatttatggaggtgcctagaagtacattcaataaggaggaaaaacaccagatccattctgaaatcttctcacccaccagccggttgcctattacagggcattgttagtgcagcaacttatgtatagtaaataatcagcccctaacttgttcaatagtatattgtggattttttttcaaatggagcccccttttggggtaacatttatgacttatgaaagaatcctttgctctgtttcatcagaatcatcagttcttattgaggttcatattgatcaagggtatttttcttcagagagtggggatgtacctccaagcagctaattagattagtagcaccaacattaccatcaaagaggaagataactgagtattgcctgattttagtacagctaccacaggatgctccagagacactacttaacgtcaaaatagaagggaagagagagcaagagagagtatacaaggaagtacacaagagaactcaggcttcatggacttctgagcacacagctagctagggtattgggaccacccagagataccccgtcagcccctgcattccccacaaaggatgttatgataagcccttggaatttgtcaggggaccctgcgaggttatctaatgatcctggaatcccctgtacagttcccacaccaaatagctatacttcctctccttggactattccaatagtagggtcgtcaccaccagagatggtttcacactcttgaatggctctgaaaaggattttttttcatttattcaggctctcagtttcatttattgagcttatactatatgacaggcagtgtactttgtactggggatacagcagtggatgaaacaaatgggttccctgccctcctggggtttccattctagtgaggagatagataataaaggaacagaactttctccacccagctctatcactctgtatgcctttgcccatgggtttgtggtgcccaaaatgtaacccaatgacttgggagggttttgcttgatttatgaggtcagggcagaactcctttattccgaagactagactcttatgaatgcaacttacaacaatttttgctttttgtttcactggtgatatggtttggatttgtgtctctgtccaaatctcgtgtcagattggaagagggtcctagttggaggtgattggatcacgaggtggatttctcccttgctgttgtcctgatactgagtgagttctcacgaggtctgatggtttaaaagtgtgtggcactttccctgttgctctctctctctctctctctctctcctgttctaccatggtaagacgtgcttgcttcctcttcaccttccgccatgactgtacgtttcctgaggcctcccagtcatgcttcctgttaagcctgtggaactatgagtcaattaaaccccttttcttcataaattacccagtcttaggtagttgtttatagcagtgtgaaaacggactaatacaactggtcgcatcatacattgacttacagtgacctgactgtcaacagacactcctaagccttcccccctgttccccacttttaaacatgttttaccattaggtcagttttctcctgttttatattagtgcaattgatttttttggaccaaattataacattttacatttatttctgttaaatattattttgctaaaaatactctgtcatgccagtctattgatctagtttgtgatttaggaggacagaaagtcctttgcatttactcaggggtctgtttataaaacttataacactgggctatcacagagagaaacttggtcttagccaaaagttgaaggcctgacacccaagatgtcataggagtttcacctcatggggttaaaaatttttttaacaaatgaagaagcaaggcaatcacattatgctttggctcagtaaaataatgcaaggaactcccaagcatgttacagataacagccttctcagaaagatccccaactgctcaccatatggttgaattggggctgggaacttgaaacctgcagggtctttgttaggttagaatgggggaagggagtttgcagagaccaaatcctcaaggcaatgggtcatgattggcaaaggtgcccgtgactgcttgctcttggtatgagttgcatgagctaaggcatctccttgtcttatttgcatggcagggctggaggctacactgtgacttggcattcatgggacaacaaaatgaccagtcattctgtgttccatggaggccagtcagagcaggttccttggtggtgtgctcagggactgggatccagtggcttgtgaactcagccagctaggcaggctggcaagatgggcaagcaccccaaacctcacccactcccattcccacccccacccagctccacattcttgaggttttagttcaccagacctgaatgagagactgactgcctgactgctaattattcctggaaatggcatgatatgaagtctgcaaacattttctgcaaacattgacccacaagaggcaagctgttgagttctggaagctaggaggcaggaggtgggagggggcttgggaggcattcctcaggcatgaggcagttgggtccctttgcctgctggatttctgctgtaaggtcagcaggaaacagatgcatggaggacagtccccagggtggcatgggaccacccaggggtgttgggcttttcaggtgaacatagaaggctgggctgggagctcccaggtagcaagagccagattgttggtgcctttctgttgtcaaaaaaaaaagtttcagctgccacccagccaaactttgcttgcacacatgttttccagagacagagacaaaaatgtgtttctcagggtgggggtggggtggggagactggagtgacagttacattagccgtatgcagagccatcctcatcacctcggcatttcctggagatggttgcagcctcctgtgaaccccagccaaggttctttcgagatccagggcaagccccatggccaagagcagactggcctgactcagagggagaaacaggagacttcggggagagtagccgggctgtgtacggcccctccaccgccaagcccaccacccgcttcagccttgtcttccgctactgcggacctccagctccagaaacaccaagctgccccagcatcccgctcacaccaggcagttctcagccactctaccactgctcatgcccctttccccatcccaagtgctctttccccactgcttccctctcctaactcctacccattctgcaaggctcccctccgggatcacctcatttggaaagccttcctgtattccgtctgtctgagtttggccttctcctctgtgctcccccaccaagtgttgtgttttctccaaccacagcatttctcactctagagaataagagctcacacccatctccagcttacaatgcgcaagtcactgttctaccttctttacacatattaacatcagtatcttgattttattgatgagggccctgggaaattcagaggttaagtaacttgcccaacatcacacggctagggaatgatgaaatcaggatttgaacccaagctttctggctccaaaatatatcccactggaaagtgaactctttgagggcaggtgagtcaaatcatccctgaattctcagagtgggcactccagagatgtgggcggacttaattgaaccacatgaaactaggaagaccatagggaagatcctggaaagatgggatgggccagaaaaagaggtaacccctaataactcacacacctctccctcctgcccttgtggatgggtattcaggcctaacagatcctgctgtgggtgatttccaggaaccacaaaggccagaacaatgccgaaggccccacgttgggaggcagcctctgggaggccattttcaaaggccagacccattttcgctgggcctgcctgctctgttgccacccagtgtagccactacttctcatttggttttggttaaagaccacaatgtacttgctcactgggggaggtgggtagggtgggagagggcttggctcctctttgtgtggagtgttcacacttagcccatcctgccccaatctcagggaaatttggggaggccagaaggaagtctttcccggtcctagaattttctgtcttcagccttgaaacctttgtgtgaaagcttcacctgtgtggaattcctatagacaagtgtgagctggccattatggccggatttagacccatcactagtccttcccagggcccttagaggcccttttgaggaaaaaagcagacatcccttaaaaaaataaaactagaacatgatgcccaggatccagaatactgaattataagtctgagcatccaactctagacagagtgactctgggtgtgggtgctggagtaagactgaatggactgacatcttagccctaccatttcatagatgtgtgactttaggtttagagttgtgcaaccatcatcactagttccagaatattgtcattactccagaaagaaactgtacccattaaacagtccttcccattctctccccactccatcctctggcagttcctaatctctttctgtctgtatggatttgcctattctggatatctcatataaatggaatcgtgtatatgtgatctttgtgtctggcttctttcacttagcatcatgttttcaaggttcatccatgttgtagtatgcattagtccttcattcctgtttatggctgaataatatgactataccacattttgtttatccatttgtctgttgatgggcatttgggttgtttccactttatggctattgagaatactgctgctatgaacattcgtgtacaagtgtttatgtggatctatgttcaattctcctggatgtgtatgtacctaggagtggaattgctggatcatagggtaactccacagttaactttttttttttttttgagacaaggtcttgttctgtcacttaggctagagtgcagtggtggggccttggctcactgcagcctcaaactcctagtctccagagtccttctgcttcagcctcctgagtagctgggactacaggcatgcaccaccacacccagctatttaaaaaaattttttttttatagagatgggggtctccctgcatagcccaggcggatctcaaactcctgccttcaagtaatcttactgccttgacctctcaaagtgctgggattacaggtgtgagccactgtgcctggtccatgtttaactttttgaggaactgccaaactgtttttcaaagcagctgcatattacaaccccatcagcaatgcataagggttctgatttctccacattctcaccgtcagttgttattttgcattgtattttttattacagccatcctaataggtgtgaggtagtacctcactgtagcttggaattgcattaccctaattattgatgtcgagcatatttttatgtgctccattggccattcatgtatcttctttggaagacagtctgttcagatcctttgatcatttttaattgggttatttgtctttttgctttatggagtcttaagtgttttgcatgtaatctagatacaagtctcttatgagatatgtaatttccaaaatttttctctcattccatgggtggtctcttcacttttttggttgtgtgctttgaagcagaaagccttttaattttcatgaagtctccatttcatcaaagaaaaaatagatgtactttttccatggttgcttgtgcttttggtgtcaaatctaagatttacacgtatgtttatttctaagagctttatagtttgggctcttgcattttgacctttgatatacttttatttaatttttgcacatggtgtaagataaaggtccagttccattcttttgcatgtggatatccagttgtcccagcaccatttgtttaaaagactatcctttcccctattgaattgtcttgatgcccttgttgaaagtaaattgaccataaacgtgagggtttatttctggtccacaacatttttaactgacagaaaagaatgatcagatatggagggcctacaatagtcccaatatctcagcctagcacacccagaagcctcttatccctccatccactcagtagagaaaggatcattgcccagggaaatggtggtcaccaacattaggtctaatgactcaacctggaaggagatcatgtggaaaagttacacgtatttgcagaaccaaccttcctttctctggaaagttaggcttcagtgtagacctccattcctctttctgagcatgccgtcatgagtttaagaaaagtcttttctcctttccccttagctgggaagttcatcccatgttcaccctcctaagactgcccactctcggtttaagctatagttagagcccagaatttcagaaatcagagaggtttggtttcattttttttttctcgaaggaaaaatgctcttgcttgcatcttctttgccggtcacacagcttcacactttgggcagtcccccagcaagttggcaatggacttattctggacacgtccttcctgcttttgctgggaagtgagcacctcacagttgcagcagactgcccaggacagaaagggaacatgacctcccactagctttggccctacctagcaactgacgatcctgactcgtgccttcaggagattcttgacctcttgactataaggtttcctgagttagggaaggcagaatggcagagtgcaaaggagacgagctttgataccagacagcctgggtttgagtccccgattctgcgtttgcttgctatggcagacacagagatgcactgcttagatcccctgtcaagaaagaacccgttgaccagctgaaaggagtgtggttacttgacagtctccagctgttagctccttcagggtctgcctcagcttttgagccaaggtcatgctgttcttgaggtggcccctagccaatgactgatgaaggaggtgatacaaggcccatttccaccacccagaagactcctctaaaaggcagtatttgctccagagctccctgttgggcacagactttgacaggtctgcatcatgctctgggctcctcttgcctggtcctgctttctccccttttctttcacaggtatttcccgctaaacctcttgcactcccacctgtcagagcatctgcttcacagagaactcaacctgtcgtctctcagcttgtgtcttctcccctgtgacaggggaataatggcatcatcccacagggttggtaaaaagattagaactaagtaaaatacctgccacaaaggaggcattccatcaaagggagctgttactactagggaatctatcatttccatggctatatcctaacttttaaatgaaatagaagtacccattataatccaaacctagaaatagtctcaatgcccatcaacagaagaatggataaatacattgtgctgggtccatacaatggaattctaatcagcaataaaatgggtaaatctcatcagcattagattgagctaaagaaaccagacacacaaaaaatacatgttgtatgatgccatttctctgaagtgcaagaatagacagaactaatgagtgatgataaaggccagtgactcagtggtgacccttaggggataatgaccaggggcatgagggaaccttctaagaagctggaaatgttctctatcttgatctagattctggttatatcactcacacacacacaaacacacatacacacaaacacacacacacacaaacacactcacatacacacacacacacacacacacactccaaaatcacaaagcttgcaattaaggttaatacactttatgcacctacctatgtatgttatggctgcatttttacaaatggaaatatagcggggagttttttatttttaattagcatatgtacaagttaagttttttaaatttagaaaatccagaaaaatagaaagaaaaaaatctcctatggccccatctcccaaagatacccagtagagacattttagatattgcattgcattctctagccctcttggctctacttctctatggtcctgctctggctcatggagaaaggaagttccaccaccatttccaccttcttggaaatagtgcttctcacctctctttcactccttccctcagataaaacctgaagcttaatagtgccaaaatgtcaacgtcctcatctgcacatcaccttgcactgcatcttctgggcctctggctccctttctggacagccaggtcaggaagccaggttcactgtgtcttctgcttttgcaggagttgacatgctaactcaggccccaaaggactttctgatgggaatgtacctgatgctccccaaagctgaagtggtgcaggctcagagcagtcagagcagccaagctttttgcctggcagttgtgtgaattatgagagaaaggcatcttccagcttgcttagatgaccacaagctgtcaaagtgaccctgtaggaaatgtctcaaggcagaatataatcaaaaccaggcatgtaaaaaactggggctttctttctagactgctggttctcaaagtgtggctcccagaccaacagcatcagcattagcatctccggggaactgattagaaatgcaaattggggcccccaccagggacctagtgaaagaaactctgggagtgggacccagtcatctgtgttttaacaggccctccaggtgattctgaggcacccttaagtttgagagcctctgttctagaggtttctaaattccactgccagagaaagcaaggatgcattcacatgtgctctgctcatgtgcataaccagtgtcctgtgtccttggtatgacttagaggcacacgccaggtccatataacttcaaagtctcttgttctttatatcctgaacccaaggaaacacatttcttttctttttttttttctgttagcagagcaaagatgaaatatagcccaatgttccctcaacaaaaagatttattaatttgtactaatgactgtttagagaaaaacataaaaaccaatgtccttgttgaatgctccttgatggcaaaatgtggatgttatctgtaaaatcaacaaatttgtcaccaaagtgaaatgttatcttttcctgaagactttcccaggcagctgaaggcctcaaggactagacagcctcccccatcaccatgatcaaatgaagagggttagaacttgcagccgtaactcaaatgccttaagatggctcagatgtgtgtttgttttcaggttaggaactttgctcagaacccctgaagaaaaggaaccatgaacctattcaaagactcaaagaatcctctcagacctatgccccttcttaccagtgtgttctggtaaatgcttaacaatctgcacgtgtgcacacgtgcacgcgcgtgcgcgcacacacacacacacatatctttattttaaatgtgtggcacgtgatccaaaaataataaaatatacaatattcattcttgtaaatttcatacagctaattaacattcatactcatgccttagttgatttttacctaactcttgtatccatatccaacctaaggtggcaattaacaaacaagcatggttctgacataagtattggttgatacattggtttacatttatgaataagacaaaagcaaaacaacaaaatgcatgtcaaaatttctctgattcacatagtgacataaatgacttctttactaaatcagataatcatctttaaatactggaaggatatttcctcaaattttttgtgctgtttacaatgtaacagctactgagacaacacaatttttaagtttcagctgcactattaacatttcctccatctttcttaagcctagatcaggggtcgtcaaacatattttgttaaagagccagatagtaaatattttaggctttttgtttgtttgtttgagacaggatctcgctctgtcaccaaggctggagtgtagtggcatgatctcggctcattgcaaactctgcctcccaagttcaagcaattctcctgcctcagcctcccaagtagttgggactacagtcgtgcaccactatgcctggatactttttattattttgtagagatgaggttttatcatgttgagcaggctagtctcgaactcctgggctcgagcaatccacctgcttcagcttcccaaagtgctgagattacaggcatgagccactgcgcctggctaagcatttcaggctttgtagccacatagtcattttttttacaaccctttaaaaatgtaaaaatcatcctttgcttgtgggctacacaaaaacagactgtggggaaagttctcaactcttggtcaagacaatcaacacaacaatagattaagcactgctttgtagcatttgctagtttccctgacataaatagtcctaccatggccaacttcaggctacacaacttgatgtcacagaatgtggagttgggaagagatgtccagtggcagaacattatatagtatttccagtatactgatataaaagatataagtaacctcaagagcatggataatagcaaagtgtagtcaaataattagaaagggatgagtttcgcatatgtattagctttgtgggtttttttggttttgttttttgagacagggtctcattctgtcacccaggctggagtgcagtggcatgatcatagctcactgcagccttgacctcctgggctcaaacgatcctcctgcctcagctgggaccacaggtgtgtggcaccacacccagctaattttttaaaaattatgttttgtagagatatggtctccctatgttgcccaggctggtctggaactcctcagcttgagtgatcctcccacctcagcctcctaaagtgttgggattacaggcatgagccaccacacctagccaagctttgtttttcatataatttattttattgcaaggttatataatttaatttctaataatggctgaatttaacaactcagctctcaaaattaatttgtctcttgtaagttggtatgagcacaccattgtgaccataacaaatttcaacctgtctttttttgttggggagtaggtaaaaagagaatcttcactcaatttggtccattattccttgtaacaaaagaatttactacagggtttctttgaagctgggagtttccctggctcttctaaaataggaaatgattttagatgttatttttacgtattttcaaaaagaggtctgtctctattctcaactgcttcctgaccaccttttgcttccaaataatgaaaactatttaaaggaaaaaggaactactgtagtgtggttttaagaaaagcacatactttgctctttcagaagtagttacacaatacttctgcccataaactggggaagagttaaaatagctttccaaggctcctcccagggctgtgattttcctctcatctgctcaggtaatgccactcatggtgctcattcatttattcagctatttgagcatctaccaactgcccgccagtgtgctgagccccagggacacagcagaacgcgagagagacatggcccctgctgaataagtaattacgcagatcattatttacttatactttacattagtaccttaaaggagagcatataacatagcggcctgatctattctgggagattcaggatgtggcatttaacctgacacctgaagaatgagtagaaagccatgccaaggaagaggcaaaaagaagtagaacacccttccttccaggtgatggggacatcctataggatgcttgcccaaagcacaggtacacatacaatacatacacagatacacagcatctctttggtattaaaatttaatggggggagaaattagaaaaaaaaaagacgtctaaaaaggctcctgggatgaaggggatgataatttttttaaaacaacattgagaaacattggtttatataaacaacttggtgctcttgagctattatcacagcagtggcagagctaagaggctgactcctctcatgaggactagctacagacctgcaggctccagaggctgatactaagacaggaagttagaggactcatggtttcccacaactccagaaaatatcctctgttatctttcaaatactgcctcttctcattctctctcttccctccttctggaactccaactggacacttactggaacttctcattctgtcctccatgtagcttagctttcctttcttatttttcatctctttattcctctgctctgcatctggataatttcctcagctctatcttctggttcactcattctctcatcaactgtgtttagtttgttgtttaatccctctgttgagtgttcttttttccattgcaatgcctatatttcggttcttttttgcattcacctgtatttttcaaactattctattcttgccttctagtttctattcctttttaaaacctctttcggccaggcatggtggctcacgcctgtaatcccagcactttgggaggctgaggcgggtggatcacccgaggtcaggagttcaagaccagcctggccaacatgatgaaatcctatctctactaaaaaatacaaaaattagctgggcatgatggcaggcacctgtaatcccagctactcaggaggctgaggcagaagaatcgcttgaacccaggaggcggaggttgcagtgagctgagatcgcaccattgcactccagcctgggtgatagagcaatactctgtctcaaaaaaaaaaaaaaaatctttgaacattttcagcatacttattttaaaatcccttttagattttcttattagctgtggttcttaaggtatgaattcttccattggttgcactggtcttatggtggtttatttcctcacggacttagtaagttctagctatgcattcatcctgagtcatagatacaaacacagattcatgtgctatataccacctgggtttgaattctggctctgccacttagtacctgtgtgaccttaggtaagttatttaatctctctgttcttcagtttcagtatctggaaatcagggctgttctacaaatgagttattaggttggtggaaaatgattgcagtttttgccactaatttcaacggcaaaaaccgcaattacttttgcatcaacctaaataatataagccaagcacttaggacagcatctggcacataattaagcacttggctagtgtaattactgttatttggcaggaattgttttaccttggagtcttatgtactttgggttatgtgactgcctactctcagctcaaagtggccagtacacttctgaactgtgttttttcccccatccccacttatgggccagcacttaccactactgactttccataggagctcagattccactcccgttcccaccctgccattcaaacccttcgcccaggatatgtgaccacctttggttcttctgtgggctgtgtagttgctgctgtggctttgagctccctcttcatttctggcactagaatatgtttatttttgcttttgctctctacaacatatttaaatttttgaaaaaacaatgtgttttgagcaggggaggagcttcctgcaacagctcaggcaaccatactgaccagtaatccctaaaaattctttcttttttttttaaattttaagttccggggtacatgtgcaggatgtgcaggtttgttatgtaagtaaacatgtgccatggtggtttgctgcatcgatcaacccatcacctacatattaagcccagcatgcatcagctatttttcctgatgctttccacccgccacagccccccaagaggccacagtgtgtgttttcccctccctgggtccatgtgttctcattctccctgagcattcttcctgaagaggcttacctctcatttggcagtgggctccttgagagaactggggacaaaggctggattcctggtgggaagggacatatattatttgtttttgtattccctatgcctgatatgtgtttactgagtaaagacacgaaagactgccttggcaacagcaagcactacaagtggccagctcactgcttgatttctctaagaattaccaccaccatgttgtaaccctcctccccgcccttcttcctgtgaatgagttctgtcaaggtgacatggcttctaacacatgacagtaggtatcattcaatcactgatgatctcaagggtgagtagctttcttttactctgtaaacaaaatgccaaactgggaaatgctgcagaggccacatattattctgactttcagagtgttgtttcgaaagcaccagagtaaaatgttaagcaggtagctgatgcaatctggcaaagtcagtatatagctctatttatataaagacacacacatatatcagaccatcagaaggatttgtataaagagtgactctcctatgaaggtaaaggccacccctcttcagttccagtgactgagatacatttttccaatcctgggggcaaatacagacacagcaagttccttcttccctttggaaatttggcaggtaagtcaagtctgtctctgttgccacattctctcgagattttatgactgtgcacatggcctgtgtgaaagcttcgcttaggtcaccttatgccttggcagccagcatggtgtatgacgattcaggaagaccctggtgtttcccagatggggccagatctggccatgcaattattgccctccagctgggaaatgtgacatgggggtgatgaagtggctgctgagaaggaggcagttagactctgaatttggtctgttctttatttaaatctaaagattgaacacacacacacatagatctaaaatcaatatcatacattcacacacacacacactcacacatgcaccactccccaactgcacagggtattttttagggattcatgtgggattcccctacacatatttcccagtctaactgcctattctttcccctgtttacttgccatctcatcattctctcttcctttactctcctacttatctttatcattgcttttagctgtgtgttcctattaacccagatgatcagtttcagactctttgagaaagagacagggaccctaaatccattgtgagctgctttgtctcattctctcccatgaccacagagaggcatgtctctggaccttgattctgagaggaaacagattcacagaaactacaccaccactggtagcacaatgttactctcagggtggacattctcatttataaaaagagtagtagaataaattgcattctaatcccagcagctctaataacttgtccttctttctatcaatatactgatcactgttactacagaggcagcagggaacaaatatgggctctgtatttaaacaaacttgggttcaagttccagcttcagcagttaatagctgagtgacactgggcaagttgcttatcctctctgatcttctgtttctttatctgcttaattggcatcaaatagaatatacagacagtccccaacttgcaatggtttggcttgcaattttttgacattatgacgggcttattagggtactgaatgcatttttgatttatgatatttttgatttgtgatggttttatcgggacatagccccatcataagtcaaggagcatccgtatgttcaaggtgctggatacataattggtgctctataaataggtggaattactatgattatttggatgatggtcgcaacccttggtccttcctgtctcactggagttagagacaatcagagttaaaggaggactctaaagatgaacaaagcatcttctcacggtcaagtgacagctcggagctgctggatgctcagcatagcactagctctctaacaggctctaggagaaacaatgggtagatctactcctgctctcaaggggccctggccatccaaatgagcagataagatgaaaatgtctacaaatgttaaaaaagaaaaaaaaaaggctgggcatggtggttcatttctgtaatcccaacacttcgggaagctgaggcaggaggattacttaagcccaggagttcaagaccagcctgagcaatgtagggagacaccgtctctacaaaaactaaaaataaaatatccaggcttggtggggcacacctgtggtcctagctactcaggaggctgagatgggaggatcacttgagcccaggagatcgaagctgcagtgagccatcatcactccactgcactccagcctgggggacagagcacaaccgcatctcaaaaaagaaaagaaaaaaagaggaaaatgtaaatatgagtgggcaataagactagtatctgctaaattcttccctatagaccacaagtgctatggaaattcagagagggggtgctgctgtgaataagaagtcctcctggaggaggcaaggcttcagctgagacttaaagaaaggatgaggcttggagtgacccctagaaaaggtgggagctctgtgggcaaatgctggtcaaacttgagaggtaggcacaactgttatttccaatttacagataagaaaatggaaggccagataagcctagtgacttctctaaggccactcagcaagtaatggcagcactaggatttaggtagagatcggtctctgtctggtgttgaaggctacattcaaagctggctctgactgaagaaagatgagaaataggaaatagccattgatggttttccagataggagtgacgtagaaaaggcagtgtgttttctatattcacagtgcagcaggtgttcaggggacgattctggcactagaggggtcaattaggaggcagttgcaatactttagggctgaggtattgaaggcctgatccagggtaggggcatggtgggactagagaaggcattaagccattaggcatgtcaaagggcaaattcacagacttgggaactggctgaataaggagaaagaaggacagcgggatgattaaagaatctgatatgggaaccagaagactgggcaatgctgctactaggcatattgggatagcatactcattttaaggttgctgtttatataaaacagagcctggtttcttttattattattgctattaaatctttttatttttttaaaaacacacataccataagaaaacagacaaattcagaatatgagatattctacaagacaactagcctgaactcttcaaaaattcagtgtcacacacaaaaattaggagcatgcactgttctagattaaacgacactaaagggacataagtagatgcaatacacaaaccttggttttggattctggattttacaaagctatgaaagacatttggggaatattggggcaatttgaatatggattggaaattagattatattaggaattattgtttattttcttagctgtgataatatattgtggttaggagggagaatcttcttattctttaaagagtcattctgaagaatttagtgggaatgtgttatgatgcctgtgaccttcaaatatatgtgtgtgtgtgtgtgtgtgtgtgtgtgtgtgtaaatagattgactgatagaaacagaactacacagcaactatgttgaaatgttaattgtggaatcttggtggttatatgtatgttcattgttctacttctttgatctatttgtacgtttgaattttttcaaaataaaattcaggaaaaaataatgcatgaacattgtaaaaaacaacaacaacaacagtaaaaaagggtatggggggaacctttctgccccagacacccaatactccttcccagaagtaaccactggtcacatttcttgaaatgttatctgcattttacaagcctatgtatgtgtttgtaaattctgttaataaatagataggttcatgctatgcatctttttgttagctacaagtagactctcttatctattcaactgggagagtagttagttaattaaaaatcagtaaaagtggaagtgcttggacccactagggagtggtgaccaagtgcatccagaatactgtgggtatcaatcagtgcattttacacaggaaatggagagcatcctttaattgtgagagttggccccacagacgtcagctaagcgagcttccactgtaatggcagcagcctgcttttttgtttcacttcaggagccttcttggaggtgttaagaaggcctaggtctgccaacatggcctctgagccactggtagaaccttcaggaatgagagaggtgagccattgggcttggggagaggtgaagtcagcaagtgcatgaggggcctgggctaggactcttctcatctgaaccccacaggcacaccctgactgttccatataaccacgtgtagatctgtctcattctttcagtacagttatgtctcattctttcagtacagtttttaggatgaattgcttttaggatgagtatggttttaatcatattgtgctttgggagatggtggaacatctgggtagaaaaaacattgcctaggcttcctgaacttgcctgatcgtaagaatcatttgggtatttgtctaacaagctttccagctagggcagtgctgccatacgcagttggagaaccaggtctagggctccagcgacaggactgcactgacagatggaagctccactaatggtgctagttaaaggcctgagaatagacagagcaggcaagatgcctgagaaatgctgaagtccaaggatggagcccactaattcccatacaagcttcctcccccaacccctcccctccagagatgattgcctcctcttgcaatcgttggggtcacatttccaaagcatgtgcagctttgaatatgaaaaccctccctaactggcagcacctgggcaaattcaaatcacatacttggacataagactcctccttgcaaatgggaaggatgattggaaaaatgtgattccagaaaccagatctggactgaactgaaattgcctgaaaaatgaaagcactggcacaattaacaaaaagggactggattcctttatttattttatttatttgcagctaaatcctacacagcttgcagaccttgggagacagccatccttttatcattcctgatatggacttgaatttctaagaaatgacttttttaatggtctgtggaattgaactcctactagaagcggccctaggactcccagtcacaatgttttaagaacaatcctgagacaagagcaggagctctgaggggccttgtgtgcccacagacccatgaagccatatgctgacctcatattggtctcttcaggtgtcctagaaaacccagctctgcatctaactcaccctctgcattgggacaaggtagagcaaggcccaatgtcattttagggacccacaatggcagaggactgcattggcttgtcacactgcctgaaatgttcacatttcagtgtgaagcactgacgtcccctgtcttctctaaatcaaagtgtctcagaggtaaagacaggatctctaatttttttaagacaagcagcttttcacttaaggttaaaaaccaaatggagaagggtgggtagtgatgtgtctggtttttgttgtaagcctggagggtgagcaggtggttaggagagggaagggtgtcaagaagacccaggcctgccaacatggcccctgagccactggtagaaccttcaggaatgagagagatgagccatcaggcctgaggagagggcctggggagagtgtatgaggggcctgggccaggactcttctcatatatggccccacaggcacacctggactgtaatgattgtggaatcgggaagccatcaccacagtttccaattccttaccactattattaccatgactgtgctgagtgcatgtgctttgaattttcagtgagcctgctagcccagggacacttccacctgcgctgttatgcagtgacacagactgatggaccacagtagcagagagcagccgcggacctcacatctgggggatcaggcctcaaggattttgcatgacagtttattccagctctgccatgtctcttaagaaatccacagttttgattttctgtaactgcccccacccccgcccatgcttttaaaaacacatattatgtgccagatgctagagtaagcatattggatatatcatttatttaatcctcaccacagcactgtgaggtagatgttattgttaaccaattttacagatgtggaaactgaggcacagagagattaagtaacttggccagcactgctctgctccagcagaatttctggaagtcagctggccagctagactctttcagattacttttcctcacccaagcccacttctgaattttctctccctattgattcaacccctgtggtgacaggtttatcttcaaatgaggtttcctaggatagccctgctatggagtcaacctgaccaagggccagctgcaccactcacctgggagcagttgcctgtagaaccagagaacagaaataacaaacttcactagggttggccgcaaaccacaagatcctctagaaggaccccaaaatgtccgtgaagaccaatagtcagattactgaccatgccgccagagaagaaaagggcagcctaccaactatccatcctatttgagccacgtgacttgccaacgtgggtgttttctgaggaaaaccttcagttcacccagcaattccagcctaagctcttttccgagtctgcctgaactaactagatatttgcctctgggtcactgtaacccaaaaaggcttaattaaaatcaggaaataggctcaagttcctctgctgcaatactataaactttagataggccaaagtaggctgcaaggacacacagggataaaaggtactttggatacagcacagtcgtctgggatactcatacacacacccacatgataccctcctccccccgtagaaattaagaaatgagaaaaggaaagtatttggctctaggtgagcttcctttgtaaaggctggagacaatgcatttgtctactgaacacattttgtctgggtatgggggaagcaatctctccagcctgagggtctcaggcaggacttggcctggtgggtgactggggccaagtgggggatgactggcaggccgagggcatgaggaggacagaggaagaaaggggggaaaaaggtgagggggtgagagactagaaagtgaagggaacaggcacagaagggagagaagagggacgccagagatgtttggagtagggacagttgggagaacccatggcgctgacagctccgcatcttgataaagtcatttcctgtttatcagacatcattagggcattagagttctcataccaaagatttatccaagagtagacatttggcccctttgggtatcaatccttttggaactcagtttcatttttttgttgtttttatttgtttatttgtttgtttttactgtgaatataccttatttagtcatttttgtttacaagtgaaactctgggaattcaaaattaacttcgttacctatgagcttcttaaagacaccagaaaagtttcaaccttgtgtgccacattgttctgctgtgctttgtccaaatgaacttttgcgaggcagctgccatccagtttcaagtggattctcttgcccacaatttcacttggaaagaccaagtcctcaagatcgcatggtacgcagctatcagagtacagctcctgtgatgcttttgcttattttttgtatggctttttcaagttggcttaggcagaattctcctctgagcaataaagacaacatgcttctcactgaactttttctccaattcacatactagccagacttggattttctgggaagatttcagtcgagaaacaggaacaaagattatgatagctttctgactaccaccaacttcagtttccttggctgctgtgatattcagctccctgagctgagccttgaggtccacgttcatctttggctccagaagagcctgggagatgccgaacttgaacttgtctggcttcttgccgttgggcttcgtgatcctagtgttcaaactgaacgtggccttctccttgctgagtgctggcttaggaagaagcccaagtctcacagtttgggatagatagcttttgaaatgtattcacactccactgctttctgaaactaaacatcctgagtcttttttctggaaacagtggtaaaagaggcaaggagtttgcttgtgaatattggtttcattctttaaatagatatttgtttattcagggccttctgtgcactaagcactgtgttgggtgctgtggacacgacagacctggagccttcttatggaacttgttctgcctataatttggcccattttgagggggtcagagaatgaacacttccacttcctaaactgtgctgggctgtgatgcagtgaggtctttgagggtctcgggaataagtcgggttgtttacccttgtaataaaaggctccagattgtggtgccgagacttcccagtgtcagctgtctctccgtgctgctgtcaccgtgttgtttctgtaggagcagaaagatgtgatctctttcctaacccatcataagggtcatggccgacactcctataacaaaagacagttaacaagagaaaagcatttaacaaatttatttaatcaaagttttacatgacatgggaaatttcagaaatgaagacccaaagacccagggaaaattgagtatttttatgcttagattctataaagaatgtttagaaatgtgattggataaagggtatgatctaatggtaatagactgaaggcagagggtacccagtaaggcctgtctgtttagattcttcttggcttttctgtgtagcattccttcctccagggtatagggcaggaactctctggcatgagggtctacaaggaagaagtgacctttctagattgtatgggttgccttgggggagagaggttctagtttctgtgattccccccggggcgggagacaggagggtaggagaaggtcagagagagactttgcttctgaggtggcttctgagaccttccagtctcctttagttcaaagtactcagcatgccaaagcgccatcgtttgggttaccattttctgaggcccagcacttcttatctgccatgttatttaacacatgtttgcctaggctagggccttacagtggcttttctctcccacggagtataaagtggatgtgttttgtgataatggttggccatttggatgtatttcctcttcattccacatggttgaggttgctggaagtatagcttccaaggaagtggtgacttacattatagtatagtcagtggcgtgctggcctccctcagttgagcagggaggggaatgctggtttatagtgtttgctgatttccatggtgtaaatgctcccaccatggccaatttcaagctcccgacatgacatcactgaacaaggagtccggaatacatgtgcaacagcaaggcatcatagcgtatttccaccatacagatacaatagatgtaaataacctcaaaagcataggtaacagtaagtgtagtaaaataattaggaagtgatgagttttgagtattcattagctttgtcttttttttttttttttttgagatggagtctcccactgtcacctgggctggagtgcagtggcgctatctctgctcactgcaacctccacccaggttcaagtgattctcctgcctcaacctcctgagtagctgggattacaggcacccgccaccacgccctgctaattttttgtatttttagtagagatggggcttcactatgttggccaggctggtctcaaactcctgacctcatgatccacctaccttggcctcccaaagttctgggattacagacgtgagccactgcgcccggcctgctttgtctttaatataacctaattgtaagtttagatcatttcacttttaacaatggctatatttaacaaactggcccacaaaattcatgttgaaccatcgattctcactatctgggtgagtgtggtcctgcctcacttttctcttagcttaagcagtagagagtctgagtaaactgggtcccaaggctcttgcccccactttaaccagagcagccccacttgtattcatttcgtacataatggggttctgtgtttgaggagagggttccaatgttttttattttttaaccttttttttttagatggagtctcgctctgtcacccgggctggagtgccatggcacaatctcggctcactgcaacctctgcctcctgggttcaagcgattctcatgcctcagcctcctgagtagctgggactacagacatgtgccaccatgctaggctgatttttgtatttttagtagagacggggtttcgccatgttggccaggctggtcttgaactcctgacctcaagtgatccacccacctcggcctccccaagtgctgagattacaggtgtgagcacccagcctccacgttttttaaatgtttttttaaaaggcattggtatagatggtctatgaggttccttccgtttatggtatcttaagttagccatgtcttccattttccctttcattcccttgtcccctcttgtcactcaggcatcctattcctgctattcccagagatcattttgtcccatcccaggctctccatcttcactgaagagatagctgttatcagctgatagggttttaggtgatattcctcccaggcgtattttactcttcaacacatgactccagaagacacataaggtctttcaaataaaaggaatgaatttttaaaagctgaaattccaggcagggtgctgggggtgaggggtggggtgctatctgtactcagtgcccttaaaatcataacactgaacagtcagacctgattctactttgcagtatccttcaaaaatctcttgatttcgatgggttgctaggttacccccaaaaaactgcccaagggtgtatctctatttttctttacacaacacagttttcctgcagtgaaaactgaaaccttattctagcagatgtttggttcgtcttcccctgaatgcaaagttttcatccatggaaatgatagagaggctgcaaaggttatggatatgacacaatcctttctgaaggcaaattcaccctctttagcatgccagaaaaattatttttccaggaaaactaaacactaagcacatgcttggatgttcctttcaagcaagagaggagccctttctatcccattaaggtcaggcaattgcccaaatgatttgcttcactgcctatcataacggggagtgtgggatggaaccagcaggtgtttactctcatctctctccatccagcaggctagccaagcaaagttcataggcacaggcaccctctgaagcctggagtcagagaggctgaggctgggggacactcgggacccctccaacacacacacacacacacacacacacacacacacacacacagatgcatgcatgcccacacatagaagaccacaacattccctcagttcaacacagcagctcatgagagtcagtattatggaagcaaaagtagagcagagcagtggaataagatgcatggaacctggtggcccagaaggccacgggatggggcacaataatgagcttctcggccagctgcccagtctgctgggtgcatactgttcaaatgtagataggatagccagtggcccaggagctgtgggggacaagagggctgctatttcctgcctacacggctaccttcggaggcctggggtactttccatagctttgcttctcaggttctgtccccacttctgacaccagcagcaacctccctttggccccattttgctgaggacatggctcactatctgaaagcttcaactgtaaggaggtacgtatgcatgcccaacacacaaaacagacccaaagccaaactctgtccagttgaggccagcttaggcaataaatcttgctcaattccctggtcagaatacctctggctacctctgcaagcccggtctagtcttgatccagggccgtttggccaaggtccctgcacagtcggcactctttcctcttccctgtccaagctgagctcactctcccctggctttccccaaagtccttcactttcagaattggaatcttttgaaccaaaactttctttcttacaaaaatatcttctctaactctcacctctagccttccattctagatttctaggttctcttgtgtcttctaacacttgaattctgagggaatttggtctctccaggggaagcagagaggcactccttatttatccaataacattcagtggctaattatcatttatagaccatcgtggaagtcatcaatctcagagtgtgcttttcccgtatcacttgctcctgatgttggagagagattcgaaatctaaatgtaagtcaccagcaaaatactgtcttttcaatgcaccaaaaggagggaaagttagcttatcttgtagaatccttcaaagtactgtgaactagctgagtaagggtaattagaaaacggaaaagggaagtcaaggacaaactcccatgtagttggagaagtctcacaataaagtaaaatttcccaagaattgccggaaagcaagtcttacaaccactgggaaatgatgagtccaagaatttcagaagagcctccacccttcacctggccttgaaatcaccaaagagctcctactgctccactccaggctcaagaagcaagctgcttttcattgctactcttcaaaatgtgctcatatccattatctcatttgattctcaccatgaccctgtgaggtaggtaggacagatattagttttccccggctcacttctggaagattcccaggagtcagattttgcacaattgtaagttgacaggtttggctctatttgcacatgctaacaaaatctggcctggtccaaccgtatgtaaagggaagatttgtcatgcaacattgacctaagctatgcagagagaagcctgatcatcggggaaggggactaggggaaatttcttgggaaatgtaataattctactcctcctttcccttcctgggcctaaaaactcacgcttgaatgggaaggcttgcattatcctcaagctactcaaaaagtttcttgaagactggataccaaggccaaattcctatatatttagctatatttgatcaaccttaccaattaatcaactgtacatcgtgggcccagctcttgcagggaggaagagacagagaagtaggagatcagagtcaatggatcctgacctccaaaagcttacagttttgctgggagctaaacttgtacacactacacaacaatgcgtagcagccaaacaaaaggaagagaaggtcagagagggttgaggcagccaggggagacatcccagaaagtcagaacagaggggtggttaggagcatgacctctgaggttgggcagtaaacatggctttgaattccagatctaccattatcagcaatgtgaaccttgagcaaatcactatacgtgatccataaaatggggtgaaaatgaataagtactttaaaagttgctgagaagattaaatgagcacagtatggtatccattatctcacttgagaaaataaaatttggtgctgtttaagctaaccattaaaaatggggaagatttggagacactcagggggagagacaggacaatacgaggcgctgaattaaacaaaggtactgaattaaaaaggaaaggaggtggatgaggatattgagaatactggtattgctaaagcagagagtacatacatataaagggagtaggagacaataaactgtgttagattgggtgcagcaagatggcaaaaggctaccaactggaggagtttagactggatatgataggaagggagaagccaccagagatttttaagcaagagagtgacttgacgatagtagtcttcgaataggattggcctatggagcacttgatgacttggagagggactggaggatatccattgtttgaggcatgagttgacatgcgcctggactagagacatgagagtgagaatagaaaacatttgaaaagtattttgtaggaaaaactaaccagatagagtaggtaattggatatgggagatgaacaagaaggaagagtccaagagtcttccaaagtttttagtctaggtgacttcaaaagtggtggtgccattgttcttgcttataagtgggacctgaacaatgaaaacacatggacacacggagaggaacaacgtacactggggcctgtctcgggggcagggggaggagagcatcaggataaacagctaatgcatgcagggcttaatacctaggtgataggttaataggtgcagcaaaccaccatggcacacgtttacctatgtaacaaacctgcacatcctgcacatgtatcccagaactttaaattaaattttaaaaaagaaagtcgtggtaccattgacagaaaaatggaagtcaagaagagcagtagacatggaaggaagatgatggactcaatgttcaatttatagaaatgtctagaaaaaaagttgatactggaataccctagagagaagaatttccttcttttacttcttttctgacagacacagacctcattttttgttagatgattatattatctgcaaatattgacaattttgtttcttcctttctgatgctattaattctattttttattctatggcattggcttggagctctagtaaaatgttgaatagcagagtagcagtagaaatagacatttctatcttgttcttgactttaagggtgaaaacatctaatatttccaaatttgttaacaaacacttgtgtattgcttctgtgtgtgaaacgttattatgaacactttacaaatattaggctatttaatcctcctacaatgttatgaaatagatattattattattattattattattattcctcttttacagataagaaaactgaggcatagaaaagctaagtaacttgcccaaggtcacacagccaacaagtgttcaaagctccactgcttagctttggagactgtgttcttaactaccctgctacacttgctgcctctttttaagtatgaagttttctgtacctttctggaaagtactttttatcaagttaaagtttccttgtatttctaattttcttagagctttctaagagcaaatgagtactcaactcagttttatcaaacatttttgctgcatctattgaaatgatcatattatcttttcctttattatgcaaatataatgaattacattggtatattttctaatggtgaaccagccttgaatttctgagataaaccctacttggttatggtatagtcttctttttccaaagtgcgagatttgatttggtaataatttatttaggggttttgtatagagttagttttcggtcctcatataatttggcattggtgttatgatagctttggaaaataagttggaagtttctcatcttttttaatgctctgaaattgtttgtttggtaaagggattatctgttccttaaagctgttgtacactttacctttaaagactacttgtgtgtgttaagggggctgaggtgtacacatctttgattctatttccatttcttctctagttttgttgatacagtcagattttcatcttgctctcaagccaattttggtaaagtatcccagaaaattgtctatttcatctacgttccaaatttactggtataaatattaatacaaaataccaattatttataattttatacctgtaccaggacttacacaattactaagaataatattctcttatactttttaatatagtcttttttatttttattttttgtttagtcccacccttcatatctgatttttaatatattctaaatacagttctgtcctctctctctctttttcttcttcttctccctctccctatccttcttcctctccctttctctgcctctttttactcttgagtggttgttgatgtgttttgtttgtttgttttgtttcgtttttagcaaacttgctaatctttgcctattttcatggtcttcccaaagagctggcttttgcttgtattgatcaacatttcatttttgatgattgtgtattttgtaagtttttgctttaatctttcttagcaaaccttactcctgcaaagctcatctgtctagaatatcctttcccccttccctttcacttggctgactcctactcattcttcagtttatgcatcatgtctttcaggaagccttccctgacacttcagagtgatttaaatgctcatcctctgtcctcccccaacaacttccagacctcatcattccatgttataattagctgtctgctttatctctcttccctattagactgcaaattccttgagggcagggaccgtgtctggttcataattgtacccccaagctcctaacatagtattaatatttgccatccccaataggagttcaaatggaaattttattggaggtagcaacccacccataagctggtaggtagatctcacaaaggagctcctagtacagtctgttgcctgaagtttggggtctttttttaaaaaggaaaaaaatacccttggtagctttagtttcttgatttttaacataatcaaatcccttcaaatgtgtcattccatggtctgtctaccctttggggacgtgttctgcgcattctacctctgcactccagcatggatctagaggtttcaaccccaaagggcacaaggccaagagttggccctaaaggagctgagactgactagagttagagtctgcaggctgccccagggcttctttatttcaaagcagcttcctgcatgaaagccttttccttctctgtagttaaggttggggtacctcacccccacttccactcctcttgtttccaatctcatctgaaacacctttccctctatgttcatctttcctctcaattccctccccttatttgccattgactctgtagttttttattacttgtgtccaggaggtgtttcgagaatgtgaactgaagtagtagtttatgaaattggcaacatctgtgctctgctgccctcagttttcttctggaaacttatgtggttagcactcaggtccaaggaaagcagaacacagaacgaactgaaagagaggcatacccaaatcatggaacaccatcagcatcagggctggctcctgcccacgtctcagctcccacctccaccctaagctacaggctgatagaagactatttctagagacaaacatcaagctggtgactgagggttttcctgctcactgtgaatttacttcctgggaaagatggtctcacttcctcacatcatctgggttcctctttgaggaaggcatcatgaaactgaaatataaaaacacttctgaaagaaaactcattctgaaattgtagggaggtcagagaatacaggacccaaaggatacccactctgtgctacctgcctaagacagaactaaggaaagagagatggctacagggaaccatgcaggctcatggtggtgctaggaaaaggtaatggactgatgctgccaggcagcctatctcagtcttttctttcttctttcttcttcttctttttttttgtagagatgggatctcactatgttgcccaggctggagtacagtggtgtgatcatagctcactggagcctcgaactcctgagttcagtgatcttcccacctcaaccttctgagtatctgggattacaggcatgtgccaccatgtccagctaattaggtttttatttttttattttggagagatggggtctcactatgttgcccaggctaggcaaactcttggcctcaatcaatcctctcgcctcagtttccagagtagctaggactacaggcacatgccaccatcgacagctaattttgtacttctttgtagagacagggtctcactacgttgcccaagctggtctgaaactcctgggctcaagtgatcctcccacctcagcgtcccaaacctttgggattacaagtgcgagccactgcacctggccccattactcagacctttctaaggttgttttgttgacagcaaatgtgctccaggcactgtgctgggctctagggatatagcaaagaacaggacacagttactgccttgaggagcttatagtctggtatctgtgtgggacacagtgtccacatttggaactttcctggctactatgctatctggcaccttgacttgaatatgtaccatctcttcagcattttcagtggccccagagacagaaactgcatctcatttatctgtacccccaacatctagcacactacttaaaatatggtaggtacccaataaacatttgttagatgaataaaggaaggaaagaaaggagaagggaaggacggaaggaaaaagggctagatgaggtgtcccagaaatgtttcatattgactggagatgatgttgagtaactttcataggagccaatctcagggaaatgcttgagtccctgatgatcattgattggaccccccagaaacaaccctcccagtcaagatgtctctgaagcaactagaatcctgaagcagttcccaaagtcatgggacaaaagctcaggcatacctaggtcagcttcacagatgctagtgactttgaattggtcacttttattgtagtgtttattcatccttgaaggtattaaaataatagggtagaaaaatagtttgatggttcctcaaaaagttaaacatggaattaccatatgaccccacaattccacttctaggtatatactccccaaaaatcgaaaacagggactcaaatgagtacaagcacatgtgtgttcacaacagcactactcacaatagccaaaaggtgaaaacaacccaagcatccatcacatggtgaatagataaacaaaaaaatattgtatatctatacagtggaatattattcggctataaaaaggaatgaacttactgatatggattacaatgtggatgaaccttgaaaacattatgctaaaggacagaagccagacactgaggcctcatattgtatgattttatttacatgaaatatccaggataggtaaatttgtagagttggggcactgatgatttccagagtctgggagaaatgagaagaatctgcttaatgggtaagaggttttactttggaatgatggaaatgttttggaactagatagaggtgatggttatgcaacatgtgaatatactaaatgccacttaattattcagtttaaaatgtttaattttatgtgaatttcacctcagttaattattttactttggaaaaagtcaaagtagaacagcctcaattctgtggacaaactgggtagttgtgggaagggtagactagctgggtgtagagtgggaactatttccttccctacccaccaccccaccactccccaatgcttgttcctttcttcagctaagtcaagtgtttattcctatctccattcctgttcatatccaagaatcatctggaattattcttaagaatattctacttctctaaggactgttcatcagaaaaaggcagttgtaatttattgggagtccttctaagaaaccccaaatatcaaagattttaggaatatggaaaccatcatgtagacctatgtcagcttaagaagatggccttttgaggagagtcgtcagaaaatgttgatgtagccaaggtgatgggtgcatacaaaatgctgggtacctgggggatgctaggaaatgcttgttgattgactgattccttgattgagtaaaaaaagacatttgcattatcctaagtgaactaacacaggcacaggaaaccaaatactgcatgttctcactgataagtaggagctaaactttgagtacacatggacataaagaagggaacagcagacactggggcctaactgagggtggagggtgggaggagtgtgaggatcaaaaaagtacatattgggtactgtgcttattacctgggtggtgaaataatctgtacaccaaactcccgtgacacaaagtttacttatataacaaacctacacatgtactcctgaacctaaaataaaaggttttgtttgtttgctttttttttttttaaaaaagccagcaatggcaatagccaggaaggcacacccagcagagggaatggcaagagtaagagcaggaccaaagaattataccacccggaattatgctgcagatgttgacacagcagagagcttcaggagaaatagaggatgggaatctttctttacctaactctgctactgagatcctttggaaaagtagtgatgaaatgaaaaatacaaatatcaaggcaacaaaatctgaaaaaaatagaattagtgctgaaatataattaactgattttctatttgaatcatcgtatgacattcatagaatacttgcatcatggaactatttataagatttttctgctaatagtcaacacctcaacaactgtcaactcactttttgctcattcacaaaaaaatatcttagaaaacttaaggagaacaactctttagtctaaatggcaagtcttgttttataaaataatatctcaacatagctgcatgtgaaaaatggtcatttttaagcagtctttgtaaaagtaacaatgaattttgaagtagaagctgatgctttgtgtcttctgctatttgtgtggtcaatgacacggctactgctcccagagtaaacgatacgtgccagtgaatattttgtgcaagttaaatgttcatcatcctctttctgagaaataaaaatgcattactttaaaaacaaccaaaaaaggacatttaaacaaaggattcccctccagtagactctcgtttatgggcttcagaccacattttgtgtaagagctttcagtcatccattttttctttcattccacaaaaatttattgagcacctgctgtgttccaggaaatacagtaatagggatgcgccatcataggcatggataaaggaaattcacatacaatccccccaatttttttttcttttgagatggagtgtcactctgttgcccaggctggagtgcggtggtatgatctcagctcactgcaacctctgcctcccgggttcaagcgattctcctgcctcaacctcccaactagctgggattacaggcatgtgtcaccatgcccggctaatttttgtatttttagtagaaacagggttagaccatgttggccaggctggtcttgaactcatgacttcaagtgatccagctgccttggcttcccaaagtgctgggattacaggtatgagccactgtgcccagcctacaatcccccaaattctttgtaagcataatttcaaccctttactatctctaaactttgagcttgagtaagctgatgggcaagaacagggcaagttatggtgacgatagtggtgtgtccacaaactggaatatgtgatccaataagtatggttaatggacaacagagaagaatacttgcaaatagggctattgaaggaaatggccctttgacaagggaggtggaacagttgggggaaagcctggtcaatgtcttcttccttctgtcctgtccccttccccatgcctggaccacctggaaactatggattaaagcagtattctcttgcacccctatggctacacacacccctgggtgcagcggctgctttcccctatctccagcatagctcatgagggactccatgtgagcgctgggttgcctgaaattgagggaaagcaatctggtcagaactaagtagggcctgcttcttgttgcctatgctacagttaatccattgccatctgtctttattttgctgactcactgctttcatttgggttggcagttcttttgctgttggctgcagtctttaactgtttacggaggactgagatggatggagaattaggggctttgcattcattcgctgaatgaaatcctacccaggtactgtgggcctcttgtcgaggggctgaggccaaggcccctggattttgatggatggtggagattaagtgtagggtaacacatcatttagtctgattgcaaggccaggtttctcccaagcattgccaaatgagctgggaggtcatgcgaattgtctgcccaagcacaagggagcgtgatatcttttaattagagtaaggatgaaggatattagggaccttggtctgtcagagaacttggaacacccaaatgctatacttcattcaagtttctctttaagtttcaccttatccatggaagcttttctgcataaacttccatccccacactgcatcccatccctcctccgaaatgcacttccctgcgctttgaatctcatcagcatttggcttcaactgtatacaatcttggctcccacagccattttgaagctgcccttcagcagatttgagacccattctttatcctgtgagatagaaccttatcaagatgtgaaactctgtagcctttatagctcattttgttatatggcaattggatcctgggaaaaggtgacttggaggaagccatcattggcctttgagacctataggaattcagtagaaacactttcaggatgctttgtcaaatgacttgtgttaagatgccaagggtttgtcgtgggctcatgtaagttttaacccttttcaaggctactttctgtaagcattgtatcatttctggggtagagggagttgagggttttttggtatatctgcctactcagccttggtgtcaaccagtacttcctgggatttggggtaggaacaatagaagttaaaaaggaactttgtgttttaggtagggggaacgtaggtactggtttgctcaggatagtcctgtgttacacctgctgtcctagtgtcattatcgaaggcacatttgtgcccttcacccacaaaagtgttccagtttgtacaataaacttagctttaggcagcaccttagctttaggcagcaaatatgtaatgtacaggatcacacccagagctagaaagactacagagttttgcagttgatgagcttctatctcactgggataaagaacgggctttcaaatctgctgaaggacagcttcagaatggctgtgggagccaggattgcacacagtggaaacaaaatcctgatgagattcaaagtgcagggaagtgcatttcagaggaggggtgaggtgcagtgaggggatggaagtttttgcagaaaagcttccacggataaggtgaagtttggagagaaacttggctgggtgaggtggctcatgcctgtaatccctacactttgggaggccgaggcaggggaattgcttgggtccaggagttcaagaccagcctgggcaacatagtgagaccctgtctgtatgatttttttaaattagctagccaggtgtagtggatcacaactgtggtcccaactactcgggcggctgaggtgggaggtttgcttgaccccaggagactgaggctgcagtgagtcatgatcataccactacactccagtctgggcaacagagtgagaccctgtctccagagagagaaagagagagaaatgtgaatgaaatatagcatttgggtgttccaagttctctgacagaccaaggttctgaatatccttcatccttattctaattaaaaaacaccacactcccttttgcttgggcagataattcacatgacctcccagcttgtttggcagcaatatgttttataattatatattttataagcaagtgtaaaaaatacttgcttataaaagttgttcccttaacaacttaagattgcatggtcagactatcccagggaaagggcttctccaagccaccaaccctagaaagtatcctctaccaatcggacaggatcaaaacgtcacctccaggaattggagctctcagacactgctggcaggactgtaaaatggtgcagacactttgcaaaactgtttggaaattctcaaacaattcaacatagagttaccatatgactcagcagttccactcctacacatatacccgagagaagtgaaaacatatgtctacacaatagcttgtacatgaatgttcatggcggtattattcataatagccaagaagaggaaacaactcaaacgtctatcaactgatgaatggataaacaaaatgtagtatatccatataagggaatattatttaaccatgaaaaggagtagagaactgatatatgccacaacacggatgaactttgcaaacataatgctaagtgaaagatgccatcacaaaagactgcatcatattattccatttctaggaaatgtcaaaacaggcaaatccatacaaatagaaattagattactggttccctaggactgagcagggtggggattcagggatggaagagtgacagcttaatggtacagagtttcttttgggggtgattaaaatgttctaaaattgattgtggtgatggttgcagaactccacgaacatactaaaaaccactgaattgtgccatttaaatgggtgaattgtatggaatgtaatttagatctcaataaagccattaaacgtgtggcctccaggcataactcagactcagtaccagctacccagttaggcttgcactcctttagcaaggacatgggcactctcttccagagagctcttctcaggcttcaaaatgggcaagcatgaacttgggcaaatgcctcataagtgcaaaccagtgggaagaagccttgttaatacccataagcctttggggtttttttccccctttatagaaacatccaacccagagccacagagtccaataataattgacagacaagaaccttagagcttgcctactccaatccctctgtgtagatgctcagaaagaggaagtgacttgctcaagtcacacagctagtcagtggcaggacatggaccagaacctgatgctcctaactcccactccagtgctctttctcctgtcctggcttctccactacttccctttcccctgccttgcccaaatcagcccctttggcccttcttgctaaaatctaggagtcaagtctgagaatccaagcacaaaatcagggtgaatttacaattttggaaatatggtacaattttcctaagtagtagatcagaagatctgtattataggtcttccaacatcaggatgtggatggagtacaggatttgacccctggtacaactaaatttgtggaataatcacatgcttctttttatactgtatttggcagtattagaagagaaaaataatattcatcttaggaaaaccttggtaactgcaaatttgctggcaaccttatttcctcttgctttcttggaagaaatcaaacgaaaaagcagctgtacaaattagccctgaccaacaggctcaggaccaaaacaaaacaaaacaaaaaataataaagccaaaaacaaattaagcttaatatttaaatcagaatggaaaatatatccaactatacgcctactggaacccttgaaactgctaatctctacttgattattcacaacctgacctttgcaggaggtcaggacaaagctggggacagtctgaccgaaatgtatcagcaattttccaaactccttcatctgcattcacagattttcctgataaccctaagagcagcaaaaccattgatcatgcttgttggagtcctattagtaccacagtgaaaagaaaatgtgcttagtaggccatcagtcaacagaccctgtgtgccaggtacaatgccagtgctagggggagacaagacggggaagaaatgatgcctaccaacaggagccatacacccccaaaatagggtgaaccaggcatggtgtagggcaagagcatggggcaagagcaaagctgaagggctaggagagtagatgtatgttgaataacattgaggggactagtctttctggaatagagatttcttttgagggagttaatgggatgtttgattgaaaaagaaggttggagacagattgtggaggcaaaatggagcattttgaagaggtgagtggccagatgaaaaccacatcaggggagccttctcttcagcctcccctcaacactggttttggtattctctgggctcccacaaccccctgggccttatcctagcactttacacattttcctgtaattcactgcttccttgtacttcttccctcaaactgatttccttgtgggaacagcttacatctggttgatgcatatatccctaatgcctaacaaagggtttaacacgtggtcagcactcaggaaatgtgtgttgatgggatgggacaggacgggatgggacttgatagaaggttagatctgtggaggagccatctggaagagaaggcaggaagaggagatcagttagaaggatgttgccctgggagatgaggaaatatggccctgacccaaagcagtagcgatggtgacagagaagaagggaggatgtctgatgtattttgaaagaagaatagacaggacttgggaaccttagttaacactgacctgaggaaacaatgcaaaaggactgtggaaccaaagtaggttccccatgaggcagtgtggtaggtcctacagaccccaataggattaaccagcctccatttgcactttgtggacaattggttatgagcacagctgtacttttcatgtctagaggtgaaagggactagaccattgctgaggggactttgcccagctgtctctgtgccggctgtgctaagtccccagggagctcatgctgaccaataaggcaaagctcaggagtgatgaaccaccgtttggctgtcttaatcctaaggcctcaactcagctctgaccacctggaggtgtcacacaaagaagtccaaaataaagaagagtgtcagcccaagaaacaagagtctccttttcctagccatgcctatttcgttccaccttcagtctttctgcagctcaggaagggaggggtgagagaaaaccacggaacttttcaaaatcccattttccaaaagctaaatcagattcattctgtgtctcctgcgcagactgcattagtctgggtaatgtaaacactgtgaggccacagctgtctgccagctgcaacgttaaagcccgttttggggggcatgaaaaaacctgtctgtaactatcacagatgagaagtgttagttaatgaatggtccctgctgagtccagagcccagctgagttatttcagtcttgagccttagcagagatttttattgggtaacaaatttcaaatgctccagttacccctagaccccagattggagctcgttgctcaatccaacccccacgccccagccaaaactaattcactccagggacattcctgattgcagctcaagaatcttggtgtttggagtgttgggtgattgctcaaggaggatttggtaagggcttaataataacatcagcctccttgtgctccctgcagaagtgtggagagtgacctttttcaagagtagggccatccgtggcttccaccagggctggtcagcttggagcagcctaaggaatggtggctttgagttggacaccactgtttctgctgggccttggcttaaagctctgggttttgctggcacctttccactcctactattctttctcctcctacatgggctcaggtcaggggcaaggccaagagggccaacaaaccaccagctgcattgagacaggggctagggcccaggcctttacgtgcataattcagtggcatttcgtacgttcacaatattataccatcatgacctttgtttagttctggaacatttttatcatcgccaaagaagatccccatacctgttaagcactcatttcccatcccctcccctccctgtaccggctcccggaaaccactaatttgctacctgtctctgtggatttgcctattctggacgtttcatacaaacggaatcatacagtatgtggtctttgttgtcaagccagtattctttgagtacccactgtaatagacatgaggattcctcctcaggtgcagcagctactgctttttagaatacttagcttaatcaaggcacatgctgggtgattgatttgcaccattctgtttaatcttcacaacaactctctaaagtagataataataatgttcccatttcaaagatgagtagtccaagactaagagaaattgagtagcttggccaagatcgcactagtagttaagattccaactcaagtccttccattatttatcatgtattcagccctacttagagccagtctacttacttagaagcaacatactctcttcgtggtatgtgctgcctgccccatcttgcccgcccttaaatccccactgtgacagaccccataggcaagggaataatctcatgagccccttgtgaaaatacccatgtgttggcagggctagtagcctggtatgagtgcccctagtattcatatgcccttgggcacacccagagttttctttagttcccagagagctgaatataaccccacctccttctctcccactcatgaaagcatatgggtatgttagtgagagttatttatagagaaatctttgaatctgctcaaatttatttttaagtaaatcatatgcaagctttggtatttgattattagaaataaataataagtgaggccaggcgtggtggctcacgcctgtaatcccagcactttgggaggccgaggggggcagatcacccgaggtcgggagtttgagaccagcctgaccaacatggagaaaccgcgtctctactaaaaatacaaaattagccaggtatggtggcgcatgcccgtaatcccagctactcaggagtctgaggcaggagaatggcttgaacctgggaggcggaggttgcagtgagcttagatcgcaccattgcactccagcctgggcaacaagagcgaaactctgtctcaaaaaaaaaaaaaaaaaaaagggaagaagaggaagaaagaaagaaataataactgattatcaaacaccaacgtgtcctgacatcaaaggtgagaatttttggtccaaacacatctagaggctgcaaagagctacacctcagctcagttacctccagtttgcaggtgaattcccagatcagtgaagttctccctgaagactgaagatcggattgtgtcaaaggtctggggtggccttcatgaagcagcctcaaaggctgtgcacctcatgtctggacttttgagcagtgactctggctgcatctgacagggactctcatgtcccaaccacatgtacaagaaatcacaagggcttgacccaagttctgcaataaaactcaagaaaaaggaaaaggaaaatgtgagttgttccactgttttaaagacttcaggatatatgttttaaaaattcacaaatgggagcggcactcaggaaagttcaatggaactgaaagagacaaatattgatactcaacagtcagcttcaataataataataataataatgggaccgcctgaattcaaataaatggaacagatgttcctcatgtgttctgagttgaaaatcattccttcatgtgggatcagttaaaaatcaagcttgggacttactgtatgtttaatataaaaactctcaataaaaatactttggaggcaaaatccaagtgagggcatgctgcaatcatcagtgcaaataatcaaccagtcagcatttgcctgtaagagaccaagggatgtacatgtgtgaggatgagaattactgagatagaggtggtgatagaaagttatttgccatcacatctaaccggagctcagcatgcaggggttttctcaatgtaagtgggacttggaaattgaagctgtggtgagccatggaaaaatggaaaaatcaattattttgatatttagtggacattagaggaattttcaaaagatgggctcttagaaataaatgaaactgtcccacagaatagctaatttcaacttgaaccagcccagccccagtatgggggtggatataacgagaggactttagtactttagtctgccatcagtactccatccacacctaacatcagagctggaagacatactagaaactatgatccaacattctcacttcactgataaggaaacaggcacaggagtctcttacacatgcccagggtcatagaggaaattcatctccaggcagaattcagggaacccactaaaagaaagaggcagaatcaaaatggaatatagaaaacattgttgccctttcacaatacaggcataacattaggattctacaagaaacaccaaactggcatgccctttcattccacagtaccagctaacagccctgttcattttaaagaattagtggagtaaaacagtcacccaatccaaaaaagagaaacaccaaacaggcagccacaaagaaggtcttgacgaaaccaggaaagggtcaagggcattgggaagctgccttacaaggccaggcaggaaagattaaagcaaaatagttggggaagatgaaggcatagaagggatgtcatataatcaaagtatatagagaaactcctgaaggtcgtggatccaggggagttagacacattcatcagattctggagtacaagagagatgcacagcctttgcagtgattatcaggaaaaacagactgaaaaaagcagctttactatacacagtggatatgggatgcccagtaaatgtgaaggaagtgtgcaaaccttattctgaaggtgttgtgaagttaaaaagcattttaatgcttccagtaaaccaattcttggtttaataataacattaataatagctaccatttattgagcacttacgatgtgccaggcaccatgctgagctctttacatggttttcttatttcctccttttacctttatttcatccttttttatttcatcctacagttgtgatgtaggcactacctccatttttcagatgaggaaaccaaggctcagagaggttaactcatcttccctaagtcagacagctagtcagtggtggaacctcccctcaaatccaggtctcccttaattccagagcacagaaacactcccccatcctgcctctgtaattgggacagcttggttgcttgagactctccctctgacaaaagtggtattttagaatgttcattctggctggtggaaaaagtgaactggaaagataggccccaggaccaaggaaccagttaggaggcagaaccaatgaaagggaatgaaaataaagaattctgtgaaatagaactggaaggagaaactgacagactccaaagacgaataggatcttactgtgccaggatctgcttttgccatttaggatatcgtggagatcttcctatgataagacatataaatctgccttgtaccttttgtgactgcttaggcattcaatctgtgggagtactactacgacaaacactgttctagtgagcatgctggatatacgtatatctttgtatactggtatgtatataagatcaattccaatcagtggaatttctggcctgaaagaaacatattttaaattttgatagactttttcgggaagattttcatagttgagtgattattattttaaattaggggtgtgggagggaaccttccttggtagatatactatagcagaaataaattagttggtcatcattcaaaagtgtaatcaaaaagcacaaggcctttcataccattcctaccaaacaacatcaatgttgtcgaagctaattacaggaagaaagggaacagaagacacagtaacccttttgggaaccattttcaaatggagaactgggaactcatctctcttcattacttaattttgagggaaggggaactatgctgaagtgttgagcagctggatagctgtggctgtcatttttttttttaagggaaagggtctcactctgtcacccaagctggagtgcagtggtgtgatcatatctcactgtagcctccaattcctgtgctcaagtgatcctcctgtgtggctgtcatttaatagacagcctattgagaggcttctaggaggaagattggcaaactgaatacagggcaattttcagatataataataacaacttgattttgtttgtagttgagaaggttggctattgtttttagttaggggatttaaataacttctttaaaacagctcccaaagggaagggaaggtaaactcaagtgttattatgaagtataatggtctgtccctccaagtgataagtttgattcactgctagcagagccagttctgcttggcacctccccagtactaactgcctctggccaaaaagctaccaggccctggtgccagatcctgggtgtcatgagccaagtaagaagaagggagtagatggggagagaagatagctgaggcaagctgtctctcccagagagatgggttacaacagaatccaatgcaagcttttattggagagacctatgtgtggagacaataggcctactttttaaatttccacaaaatgaactaggtacagaataccactattttattcattcacttgacaaatatttactgagcatctactatgtgccaggtactttgataaacactgggagtaaactgttgaacaaaacagaagtgtcccctgccctcagggagcttactgtttcataggcaaggtgagtgaaaagcaagtaaacacacaaatatagaattacagatggcaaaagaaaaaatacaggtggggcatggactaagggtcaggatggtgtcgccatggtggcctggcatttagagtgagttctgaataaagagaagggagccacctttcaggctgaagggaacgtgtgtgaaagcacttttgggattcaggctcttgaagtcgctggtcaggcaggaggctccctgaaatctgctccactttttgctcctcactgtgcaaaccaaagtgctctaggctttgtggttgctcagggcacagaggaccagatgggttccagagaccagcctgaaagttccccagtgaggatgcatggtgatagcctgcgagtttcagccagttggatgaggtgagcttccaaaatattcttaaaccctacagcctccgagacccatttcccagtgatttccattcctggtcatcactttctttctgcaggggacacttgcctgtggaaaagcagtgcctcgccttggttagggttaaagattgaggcagtgctggccttcaggaaaagtgcaagcagcaatggagagagagcaaaaactgaagccaaggaagcagcccctgccaacaacttccgttctttccctttccttcggcatggctgcccaaggagcccccagtgactgttcatggtgatctgtttgtttcacaattgacaaagaaggagggagccctttctgacatttttgcccagaggacccagatttctcagtttgaaactgccaaatacgcaactttgggtggatatttggctgaatcactttgaagggcttgtcagtgcctaaaatggaaattgttagaaagcagaggagggtggttgccagcaaccatgaaatggtaatgaccaaatcatttatttttgcaatgaaatgtcatcccctaacactacaaaggcaggttttttctagcttagaagtactgactacctataaaaatcttcaaaagtgattctgtgtgccatgcacatgtacacatataccccatttctctcaccctctgccttccctcctaaaccaagcttcttccatgttcctggagcccagctgcaacctgggatgaattaagatattggctgattatgaaaggtaatcaggcttcagctatcatataaaatgaaggggagttcatttggttatttgtaagatggtatgtggctgactttctatgtgggaaagtcagtaggctgtaatagatcatgccccaaaatacgatgtggatcttttaaagatctgtttgagtctagctgtagttgcacctaggagacatgatacttaataaggtttctcctatctatctatctatctatctatctatctatctatctatctatcatttatctgtcatctatctatctgcttcattagcaggcaaattaggcaagatctcccattgtgtactttgtatttttaaatgctgacaccttttttctgagtttaggaggaagatactggaaaatacattgtgggttgacactggggaatgcaagaggatctttctttgaaaacagccattaagatactattcccctgggccaattcctgggcagttttaaccacatacaaagccccaggttcttcttctagcttttctatattgactcctgtgttaagatcagtgaaaatttatactatcatataatttattttaaagtaatactttacaagcctttggcttgaaaatatttcagtaacatctgcacattcaatactgaaaagtaagatggctccattctgctctcattatagtaggctttgagaggtatcttttctttgtatcacagtcattagtccagtggttgatcagcttctttttcaacagaagtggctttttccaaagtcctttgtgattgttgatgtgggatctattctgaaagcaggtttgctgttaaggaaggttataggaacattaccgtttagccatggaccttgatcatctgaatgtggtagctgggtgttatctcagtgcatttgaagctcatgcttatggaatccctgttatgcaaggggttggggaagcccactggaaaaagtggctccagtgtggatgaatccgtccttcagattcctttgtagggttggcttaaagggcaattataaattagtctgtgtcatttctgtccatttcccaaccttttaagagctctcctggccctcgatctgcatgtatctaataccactttctcagcctcagtttcctaatatgtaacacgaaggacttggactagacaagctacaagttctccccaaactctgacacttgataaatctaatgcacttatcagcagagaggaatgtggctattttccaactctttctttagtttggggaaactaattttatataatgttctttccctgtgtttcccttttaaaaggaaaacatgacccatttccggtgttgtaaagtcaacactttgcagctctgcacgaggaagcttctttctatgtagaaggggcacagaatgccacgggaaccagggcaggaaccaacacctgacaagagatgcaggcacatgcggcatgtggggcgggctgtccctcacaggagccagaatcatcagtactagcctcagtcctcccatgcagctggccccactcagaagcataatggtgtggagcagagatccctgagctagcattcctggattagagtgcttactagctgtttacctccagtgagttaattaacctttctgtgcctcaggttcctaatctgtaaaatacgaataataatcacactactgcagagtacagttgcaaggattagataagatcacgtgggcatgtaaagtgcttagaacaacgtgtagcacacacatattaagtgctcggcaaatgttaactatttgtccattgggctcaaatgtccaagtatggatccaggagttgaaaggttggattccacagggccatcctccctcttgtgtccaagactctttgtggtctaggacaacttttgtgagaacaacttgtatctgctctggaatagatgactttcccttttctatagagctactgtccaactagcccagccttagtgtccctgggttcacaagtcagtgataatgaccaaaaatatgaaaaactatctgacgagagggaaagtgtgctcattgagaccccagcaataagcaattgtctgccattgcagaggatttaacagagctcagacgtgaaggctcttgtagttgacaaaggatctttagaaaagaatgttccctgagggtgctccatgtctacagaggcccaaacaagagaaaacagattgtggttagacccagggaagacatttttaccacacacagataaaatgctgggccacattcccaaaacaggttatgtagtgtcttcccctggtaaattgggaaaagagtggctggccatctgtcctagattgtttcatagaccaccagagcaggaagaacccttagaggtcatcatatccaaacctctattttaaggattgagaatgctaatacacagagggaggagataattgccctatagtcatatagcaaattattagcaggaccaggatttaaatcttaggccaacacagcttgccactgcaccttagttatctcttaaggcactcaaagtgctgtcccttctagttctggaatgctccatggtatcaatgtactaaaaaagtaactgaggcccacccagaaggactcgaaggtgttgagcagtatccaaattgcaattcctctagtttacccatccgattttggagctccagctgtcaaagtgtttcagccaagcctcctcattcaactaactggtcttaacttaccatttgaaagcagctgtggttaaagcagagcttgctgactcagcccatgtagtaaggatgactaaacacaagaatttcctgtggaggggggaggagggggatggaaaatatctttcaaatgcatttgtttcagggaacccttctgatcagtcaggaggtagcccaccgtgggcccatgaggaaaagcagcaggctgtccccgctcagcaccaaggcaggatttgcagatgtttcctttcttttttctaaacaacattgtggctgtctcggcaccattttggtctggccagcatttgcacagagcttcatctgccaactgatacagcccaaagccaagcggagcagatgccttccctgactggaggggcctttcacattcctctgctcagagcccaggggtgaattggggctgatctgctttatctcaagacagtttcaattctgagcccaccttgaactcaaaagagaggatcacttatgctgaccgatcagaaaatattgtgggctggcttccatctccaggatgcaccttggggagtttgcaatctggagtaacgttatcattttcaggtctgagtaccacacggccattggacaacttcaggaaacaaacattgaccttcagttgggttgctcaccagcttaaagcagtaatccagtgaacccaaaatttgggtaaatattttaagactgttggctggaaaagagtctgccttgctcaattagaaagtggaagacacctggtgcatttgggggtgacagattttatttacaacttgcaaaatagaaaagggcagcagggaaaaagagagagtgaacatactcagccatattctgaaagccatatacaactcaaacagttcagtcattgaggattcaagtccaagaggcctgcctcaccctcatgctcacaaggagaaaacaggactaactgcctccgaggtctcaaacaagaccgaggattttcttttctttttttttttttttttttttttttttttgagacagagcctgctctgttgcccgggctggagtgcagtggcacgatctcggctcgcggcaacctccacctcccgggttcaagcgattctcctgcctcagcctctcaagtagctgggatcacagttgcgcaccaccacacctggctaatttttgtagttttagtagagatgggatttcaccatgttggccaggctggtcttgaactccagaccttaagtgatccgccagactcagcctcccaaagtgctgggattacaggcatgagccactgcgcctggccaaggatctatttttcataagcaagtaaaaatttcttcatctaatgggggaaatgttctggaacaggcaatgtggagtaatggaaaacaaactggtctggcaagaggagaggggagaaggaaggagggagtgtcccagttcccttgggtgtgaagggtgacccaagaagtgtaagctttgaagtgttatcttacttttctaagcctgtttctgattcagtaaatactttagctacacatagtgcctagtaataatgttttctgaataagtgagagtgagagagaaaaagaaagcaatgaatatatgaatgaatatgtcaagaaagtgaattaatatatgacagaatggtaaggatttgcgtagttcatggagttggtttgaagcttaaatgaaataatggttatgagttctcattttctaacactacgcttaatacattatctgtatactcactatcttatttgaatctttcgaggctcctgtgagataggcagggtaaggactgtcacctgtctgatagagggaattgagtatcggagaggtggagaggcaatagatgatggaactaggggctccgcatgcagtgctccttctaacgtaccacacaacctcttactttcagatgaaaaaggtttttaaagaagaaagttctataggaccaccacataggatctatgacttacaactaagcaccttttatatgagggcttaaacactggaagtgggcttagaagaagaaatatcaggctaggactaacaatgctattgaagattatggtaagaacttgtcaactcaaaatacaagaggccagggggaaatggtgttggaatgacttgggtttggattatctaatatttttgtaaaagaacaatgggacctctagttggcaaggaactaacagttgctatttgaaataacatgggccactataagaaggttgactgtagactcaagtaagtcagccagtatctacttagtttgtcccatcaggtgtctggcctttcatgaagccataagctgtttagcaggaacagacttgtggtctgagtcttctccaggtttacatgggtcttagaacctttgactcatgatactgaatggtgctgtttaataaagtcatatagtctagtccccatccagtaaagctattcctatctgatgagtcactgtccaccctccagtgacaaaacaaatgaacaaacaaacaaacaaaaaacttactgcctactgtacctatagtttccagctttctgttctggacagttatgatggtcgtctgtgccatcatcatttctaattgcatggggcactagggaaatagagatatgttcattgtaagtgtacctcatgcaggcaattagacattgaaaacaaaattttcataaagcaaatccttatttttgtgccctagatcggcttgttatttaaagaaatcattgatctctagtttatcattttctaaaacacagaattaggttttctttttcttttcttttttcttttttttttttttgagatggagtcttgctttgtcacccaggctcaagtgcagtggcgcaatctcagctcactgcaacctccgcctcccaggttcaaacgcttctcctgcctcagcctcccaagtagctgggattacaggcgcatgccaccatgcctggctaatttttgtattttcagtggagatggggtttcaccatgttggccaggctggtcttgaactcctgacctcgtgatctgctcacctcgccctcccaaagtgctgggattacaggcatgagccaccgcgtccagccagaattaggttttcttaatgcaggagttttaaacatggggtctgttgctcttggactagctatgggaagctgggtgaatttttctgaaactatgtgcagaattgtgtttttgcttttacatacttttctgagaggatctacagctttcctcaaattctcaaaagggttaacacccaaaaaggtgaagaaaaactgggtgaaaaaaatggtggaactataattgtgtttgtgagtcctaaagtatgcagcttcaactgcaattttttaagaaggtggctttgtctctgtcaattgcatggtctggttctcttccttctgctgcctctgaaggataggtacccatgggacatagtgccaagctttgactttttctctgtcgtatttgcagggtattaaccatgctaataggagttgaatggcaattgttgtagactaaaataaggtattatttgataacatttctaattccttgtcctcagttgtcaaccccagagtacagcctataaggcagacatctttgttgcatgacttcagctttagaatcagagagctctgtgaccttgggaaagtcacttaatctctctgagcctcagttttcatctggcagatgggaataataacagggttgttgtgaggattataagtgagatgatgaggctgggcatggtggctcacgcctgtaatcacagccctttgggaggctgaggtgggcagatcgctggagcccaggaattcaagaccagcctaggcaacataacgaaaacacgtctctactaaaataaaaataaaaataaaagattagccaggcatggtggtgcacacctgtagtcccagcaactgaggaagctaaggtgggaggattgcttgagcctgggaggttgaggctacagtgagccatgatcgcaccactgcactccatcctgggcaacagagtgagaacctgtctcaaaaaaaaaagtgagatgatgtatataatgtgctggaaacatagtaagtgcttaataaatagcaatgccaatggtacctgtgctgataagcaagttcttaagaagatccaaagctctttcctgaggatatggatagctctgtctgggagctaccttgctgcccggggccatgctcagtggtccatccatgggcatgggaacaaaaacagtcggacctttgtcactttattcaaaacatagggtttggcctgttcaacacttgtactctgctagaaactgttgaggagccctgaaaccatgtttgactattaaacccagaagttctatgtagggaaaagggaggaacaattggtgcagtcacatcagctcaaaagttccagtcggtgctttgacccagcagcaataatagtgtccaaagggccttcccatccctgttctcattttatcctcaaaacagccatatgaggtaagcagagcaggtgctggagaagccacttattgcagcaatgatacaagcaggtccagaagttttaaggactttgtgaaaatgcagtggtttgtaaataagtaaaattcgtgtgttagcaggaaatgtttattgggtattcgtttttgaatattgagtttattgagtataactgaatatagcacagagctgggcacatggaaaggcttatatagtcagattggtgtggcaagaattccatgacaatgcatcaaaaagattatatatcatgaccaagtgggatttatccctgggatgcaaggtgagtttaacatacacacatcagtcaatgtgatacacctcattaacaaaatgaggctaaaaaccacctgatcatcttaatagatgcagacaaagtatttgacaaggttcaacatcctttgttgatacaaactctcaacaaattaagtatagaaggaacttacctcaacacagtaaagaccatttgtgaaaagcctgcagctaacatcataatcaatggggaaaaactggaagcttttcctcctctaagatccagtactaggcaaggatcccaatctcgccacttctattcaacatagtattggaagtactagccagagcaaccacacaccttttttgaaaggcatccaaataagaaaggaagaagtaggccaggcatggtggctcatgcctgtaatcccagcactttgggaggccgaggcaggcagatcacttgagttcaggagttcgagaccagcctggccaacatgacgaaaccctgcctgtactaaaaatacaaaaataagctgggcatggtggcttgtacctgtagtcccagctgcttgggaggctgaggcacgagaatcgcttgaacccgggaggtggaggttgcagtgagccaagaacgtgccagtgcactcctgactgggcaaaagagccagacccagtctccccacccccccaccaaaaaaaaaaagaaagaaagaaaagaaaggaagaagtaaaattatgcctttgtagatgacgtgatggcggctgcctataatcccagctacttgggaggctgaggcaggagaatagcttgaactaaggaggcgaaggctgcagtgagtcgagatcgcaccactgcactccagcctgggtgacagagcgagactctgtctaaaaaaaaaaagtgatattcagatttgatgtaatccctatcaaaattccagcagcatttttcacagaaagagaaaaacaattctaaaatttgtgtggaaccacaaaagaccccagatagctgaagcaatttttttttgttgttttgttttttttgttttgagacggagtcttgctctgtcgcccaggctggagtgcagtggcgcaatctcggctcactgcaagctctgcctcccgggttcacaccattctcctgcctcagcctcctgagtagctgggactacaggcgcccgccaccatgcccagctaattttttgtatttttagtagagatggggtttcgccatgttagccaggatggtctccatctcctgacctcgtgatctgcctgcctcggcctcccaaagtgctgggattacaggcgtgagccactgcgcccagctaaggtgaagcaatcttgagagggaaaaagagagaaagttgggggcactttctgatttcaaattatattacaggcaggtggtccagtggctcatgcctgtaactccagcgctttgggaagccaaggtgggaggatagcttgagtccagaagtttgaaaccagcctcagaaacacagcaagatcctgtctctacaaaataatttttttaattagctgggcatggtggtgcatgcctgtagttctagctaccagggaagctgaggtaggaggattacttgagcccaggagttcaaggttacactgtgctatgattttgccactgctctctagcctgagtgatgagcaagaccctgtctcttaaaaaaaattatattaaaaatctatagtaatcaaaacagtataactctggcattaaaaaaacacatagaccaatagaatagaatagagagcccataaataaacccaagcatacacagtcaactaatttttaacaagggtgccaagaagacaccatggggaaagggcatctcttcaacaaatggtgttgggaaaactggatatccacattcaaaagaatgagattagacttttataccatacatacaaatcaactcaaaattggttaaaggcctacatataagacctgaaaccataaagctagaagaaaacctagcagaaaagcgccttgacattagctttggcaatgatatttcagatatcacaccaaaagctcagattacaaaagcaaaaataaagaagtgagactacatcgagctaaaagcttctgtacagcaaggaaaataatcaacaaaatgaaaaggcagcctacagattgggggaaaatatttgcaaataatatatctaataaggggctaatatccaaaatatgtaaggaacacacacaactcaatggcaaaataaatcaataaataacctgatttaaaaatgggcaaaggatctgaatagacatttatctaaagaaaacatacaaatagccaacaagtatatgaaaaggtgcacaatatcactaatcattaaggagatgcaaatcaaaatcacaatgagatatcccctacatctgttaggttggctattgtcaacaagtcaaaagataacaagtgttggcaaagatgtggagaaaaagggacccacctgtacactgctggtgggaatgtaaatgagtaaagccattgtggaaaacaggatagaggttcctgaaaaaattaaaagtggaattaccatatggcctatcaattccccttctggatatatacccaaaggaaatgaaatcaacaccttgtagagatatctgtcctcccatgttcattgcagcattaatcacaatagccaagattcagaaacaatttgtgtccatggatggatgcatggataaagaaattgtggtggccgggcacagtggtacacgcctgtaatcccaatgctttgggaggccgaggcaggaggatagtttgaagccaggagttcgagaccagcctgtgcaatatagtgacaccctatctttacaaaagtaaaaaaaaagaaaaagaaaaaaaattagctgggcatgataatgcacatctgtagtgccagctactcaggaggtggaggtaggaggatagcttgagcccaagagtttgaagctacaatgagctatgatggcaccactgcactccagcctgggcaacaaagtgagactctatctctatataaaaaatgaaattgtggtatgtatgtatattgtgtgtgtgtgtgtgtgtgtatcatatatacagaatactattcagcctagaagagagggtgatcctgccatttgtgacaacatggctgaacctggaagacattaggctaagtgaaataaaccaggcacagaaagaaaatactgaatgatctcacttatatgtagaatttttaaaaagagctgatgatgtacagcataaggactatagttaatgacattatatgtaatttcctaagagagtggagtttagatgctcttaccacacaaaaaagtacttatgtgaagtgatggatatattaatttgcttgattgtattattttactgtatatatatatacacatcatgttatacacctcaaatatatatgcaataaacattttaaaagaatatgtgaaagtaaaatcataagaaagtataactagacactgggtggtctggtacagctaagagctgtgagactgtagcaaagggaagatgtaggtcggttgcaggatccagggaaggcttcctggaggaggtgggccctgggctgctagggaggtggagggaagcagtgtggcaggcagataagcaggagcatagaggctgggatgagcaggctgggggaatggaggggctcacacagtggtcagccggggggtcgctttgggaaatagtggtaattttgattaaagaggttatggaaggcattgattgctcaaacaagggaaggggactggacttgatttcgtaggcggtgaggggctgtgaggtatggcaacagagcggcaagaaaaggcagtggagttgggagagtccagctgggagccaggagtaagaatctagccatcaatgatcagagtctgggctaggacgaagccatagaaacagagaaaggggaaggatgaaagcgctcactggtctctagagcctttgcttggagtaacacaaagacctttctctctgtaaggagcaagtccatttttggtctttatatttctacagcatgagaaatgcctctttcatccaggagcacgtgccctgcttgaagaaaaccaggcaagacagcttgcaaaggagagagcctgggagatgacttttcatgttgcacaatggttcttcaccaaaggagtcacagagggtcttttgacatagacactgccctaacttatgtgcaagttactgccctgcatcctagggaggctttggggtgtgggatgacaaagtacctccacagtccccttcctccgcctctgcccatagttctacttgatgtaacaggtcttgtgagtcttttcaggtgggaaaatgctctctcagccttcacaggtcagtcatgaacctgatcccacatggacacaattctgttgacattttagcatgaaaggtacaaaagggaaatctgcaaaggggtctcaggattcagttccctggatcgtcctgtgcatttctttctcagatttgaggtttttccttttattttggagatggggcctcactatgttgttcaggctgatctggaactcccaggctcaagtgatcctcccaactcagcctcccgagttgctggggttaccagtgttagccacccaacccatctcagatttgagcatttctttcagaaatatgagtgaggtggtttcatgtggagacccctctgaggctctgaagcatcatttctacctgctatgtgtgcctgagaaacccatgcctggcccaatccccatataccctcaagtacaaatgggataataggaccccctgggggtccatgcacttgaccaaggttgctcttagaggctggattcagcacagattcagctactccggctcaggggcagggcaaagcaaaggtaccaatacattcatctggctggaaaaggaggattttgtttttacgaactttaaaggaatataaaaatgactttgttgtgattgaattgccttgctggatgaagtgccctgtggctccagggcttagagaggcttgtatggagactgtgtatttccttatgtatgtttctatatagatatatttccttatatacaaacatctgcacaattgtgtttgggagccccaggctaaaactaagaccctgacatgtttgaaactttgctggatagaaactaggggtggagaaatcctgtttaattgctgcaagtagtttttagcttataagagatgaaacatttgatattcatttaggacaaactcttcctgttttaatgatagcatctcctatgtattgagagcttcctatgtgtccggcactgtgctaaacgctttacatacataatctcatttaatcttcacagtgtccttaaaagtgaggtactattgttgtcctccattttacagagaaggaaagtgatgggaagagaggttgagggacttgattaaggcaaggtggctaataggtggaaagctggggtttgaactgtagtcttaatgactgtgcaaaacatccttgtgagaactacttaagtttcttctccctgcaaatttaaagcaaatactttctaatgaaatcaggtgtggtacaagaagcaaaaatggctttgcaaggaggaagatatacaaagtcatctaccagggaggcagagtagcatttctgcaaactagtttgctattggagcaattacatctcggctgaagagagaacaagtacggtgaggtgatggagtggagtttgactttgagtcccttgagtgcaagaaggccaagagccagaggctgacaggcctgagaaaccatagcacccatggagctgcttctaagcccaggggttcaagtgtgacctagagttgggcagagcagacaaccagctcgttgcactaaacctacacctgccttgtgtctcgtgcctttttatcatggtagtttttaactcgttatttctggcacactggaaagttttcatttttgggttgtccactgtgcatctaactaccgcattgaactcttattcattcttttgcgaaattttaattcagttacacctcttgggtttctagatatgcaagcatatcattgcaaatatatatgcatatatatatacatatgtatatatgcatatatatacatatgtgtatatgcatatatacatatgtatatgtatgtgtgtgtgtgtatatatatatctatatatataatctatatatctatatccactttacagataaagaaactaaggcactcagagaggtttagaaattactctaggtcagacagctaataagtgatagtgcacagatttaaaaataggcctaccttcagatcctgagctgtaaagtactatacaatatctctcatacataaattacatttttataaaaatgagatgacactgtatacattctttgtaatgtcctttcacttaataactttcttatatgcctagatgtattcaataacataattttaaggatgtataaaatacctttatcataaaagtataggccaagcgtggtggctgatgcctgtaatcccagcactttgggaggtcaaggtgggcaaatcacttgagcccaggagttcgagaccaccctgggcaacatggcaaaaccccatctctacaaaaaaacacaaaaattagccagccatggtggtgcatacctataatcctataagctactcagaaggctgaggtaggaggatgcacacctataagcctataagctactcagaaggctggggtaggaggaacacttgagccttggaggtggaggtttgcatgagccttgatcataccactgcactctagccggggcaacagagtgagaccctgcctcaacaaaagtaaaataattaacatttattgagtgcttaagatggatgagacatcttaacatggattatttcaaataaatttgtttacatgaggcaggattactggttgttgtagtcatatcagttcagaaactccagcttgtcactctcctacttgctggcaccccagcctgtcaccctcgaccagctttggagctgtgggatctgcatggattgttatgctatccaatgcaaaatgcccttgttttattcatatgggtaaggagcaagcagcaagtatctggactgagcacagggcatggcaaaggcagccagagtgaccctccacgttgacaaggattcctgggaggatttaacattactagtctaaattagggaccaaggaaaactgttctcatctagtttcctggaagctttgcaatgatactggaaccctaggaaaaccatggccgagaagagattttaggaggtacaggagccaaaggtgaagagacaccattggtgggttgagggggaccaggtatagtgaaagcatcaacactaacatcttgcccacaaataagatcccttccagccaggtgcggtggctcacgcctgtaatcccagcactttgggaggccaaggcaggtagatcatgaggtcaggagttcaagaccagcctggccaacatggtgaaaccccgtctctactaaaaatataaaaattatccgggtgtggtggcgcacgcctgtaatcccagctactcaggaggctgaggcatgaggatcgcttgaacctgggaggcagaggttgcagtgagctgagattgcgccattgcactccagcctgggtgacagagcgagactgtctcaaaaaaaaaaaaaatttcttccactgatgcacaatgtctatttaatgctgctatgcttatactatgaactgaactttgtctcctcaaaattcacatactgaaactctaacccgaaatgtgatggcatttggaggtggggcttcagggaggtacttagatttagatgaggtcatgaaggtgggttccccgtgttgggatttgtgccctttatagaagaggaaaagaccagagcttggaactccctcactttctcttcacccagatgcaccaaggaaaggccacgtgaggcaggaagagggccttcaccaggaactgaattggacaacaccttgatcttggactttccagcttccaaaactgggagaaatcaatgtctgttgtatatatttttgctatggtggcctgagcagactaagacactggccatttacttcaactgattgcctacattttgaaagtgttagagaagaatggtttatgcttctcagatggctctcagaattacgttagaaaatatattttattcattctttaagaaaaatccgcaaacaattaccgagtacctgctatgtgccaggcactcttctaagcagtgaccaaggcagacatgatccctgccttcgtgtagcttacaatctaatggaaaaggcagatattgaacaaataatcttataaatagtgatgttatttccagttgttatgtggtgctaatgaagaagtgaaggagctatgaacagatataagaggggcccatgacctgaagagggaggatgagatggcttccctgtatgtgtgcatgcgctttccagggcatggtgggagatgacaatgacattactagcagaaagaatggcaccacaggccaggtgtggtggctcatgcctataatcctaacactttgagaggctgaggaaggaggatcatttgagcccaggaggtcaaggctacagtgagccatgattgcaccactgcactccagcctgggtgggagagtgagaccactgtctctaaaaaaagaaaaagaggccgggcacggtggctcactcctgtaatcccagcattttaagaggccgaggtgggtgaatcatgaggtcaggaggtacagaccatcctgaccaacatggtgaaaccccgtctctactaaaatataaaaaattagccggacatggtggcgggtgcctgtagtcccagctactcgggaggctgaggcaggggaatcacttgaacctgggaggcggagattgcagtgagcggagatggcgccactgcactccagcctggcgacagagcaagactccatctcaaaaaaaaaaaaaaagaaaaaagaaaaaaagaaaaagaagagtgatacaatttgatggaataaagcacatttacagtgttctccaaccaccaccactatttccagaacattttcatcatcccaaaggaaatcctatgcccctttaagtactcactccctgttgttccctcctccttgccctacataaccactgatctattttctgtatctgtggatgtgaacattctggatatttcatgtaactgggatcatatagcagtctttttgtgtctggctgctttcacttagcataatgttctcaaggtttatccaaattgtagcatgtatcagcacttcattcctttttatggctgaataatattccattgtactgatagactacattttgcttgtccgttcatcagctgatgaacatttggattgtttcaacctcttggctattatcaatagtgctgctaaacatttgggatacaagtttttgtttgaacacctatttccaattctattggatatgtatctaggaatagacttgctgggtcatatggtaattctgtgtttaacttactgaggaacaagaaaatagcactacttttattgttgtaaagaaaaactcaacaaccaaaacataatcatatggagatatatatttgtatttttcttttgcagcttgaaggaatacacatttgttgtctccatttttatggttcagtccaggcacagcttagctgggtcctctgctcagtgtgtcatgagcctgcagtccaggtgttgtctaggatgcattctcatctggagatctggagcttggggtccgcatccaaggttgttcaggttgttgacagaattgagttccttgctgctctagtgccgaggctctcacctcccggaggctgcccctctctccacaaccttgtttgcttcttcatgtccagcaggaaatgctgtctctcttcagggagggctaatagctttcacttgattacatcagccccacccaagataatgttttttatgttttgttacagtccagaggccttttttttttttttacatatatacctattatgccatgaattcatgcggagtaggttccagcagctccggctccttcccactggttcttgcacagtgtgcttctctgggtggagcgggctggtgcttcagttgaacccaggtacctttctctttggcttcctttttctctgaacagtttccttcatgcaattcaggatgctattttttggctcttaataaagtgcttaatatgctcaatatgcacattaattctcttggcaagaatcttaaccttgtgtttttaaaataatgccaacagcacactgggtaacaatgtaggctcttccagttttgccatgaaaacatttgtggggtattcctttctgaacagtgcccattcccttgatgtctacaatatcacctttcttgtagattcacaggtatgtggccaaaggaatgaacccacgttctctaaaaggcctagagaacacgtattgggtgcctcttctctttccctttgtgttcattattttggcaaaatactagaagatggtggttctggccaaaagtgatcatctgtcttttttattaactcaaaatcagctgatatgtgactttaattacatcttgaagctatattttaaaatattttgtacagatgtagagggtacaagtgcagacttcctacatgcatatattgtaccatggtggagtttgggcttttgatgtactcatcactcgaatagtgaacattgtacacaataggcaattttctgcaaaacacatgatttcattcttttttatggctgggtagtgttccatgatgtatagctaccatattttctttatccaatccaccactgatggacgcttaggttggttccattatctttgctattgtgaatagtgcagtgataaacatgagtgcaagtatctttgtcatataatgatttatttccctgtaggtagatacccagtagtgggactcctggatcgaatgatatttctaattttagttctttgagaatggatcaaatgacatttctattttttgttctttcagaactatccctactgttttccttaagttgtgctaatttacattctaaccaacagtacataagcattcccttttctccacatcctcaccaacatctatttttctttttaattatagccattctgactggtgtaagatggtatctcattgtggttttaatttgtgtttctctgattagtgatgttgagtgtttttttcacatgtttattggccacttgtatgtttaaagctatatttttaagcattatgataagcaatctagccagattagtgacaaaatgaaccctactctcaaggaggagaatccaagtgagtaattcagcacacgcacatcactacagttagaaaaactacacaaatacaacttttttttttttttgagatggagtctcactctgtcacccgggctggagtgcagtggtgcgattttggctcactgcagcctccgcctcccaggatcaagcgattctcctgcctcagcctcctgagtagctgggactacaggtgcatgccaccacacccagctaatttttttgtatctctagtagagacagggtttcaccatattggccaggatggtcttgatctcttgacctcgtgatccacccgcctcggcttcccaaagtgctgggattacaagcgtgagccaccatgcccggccacaaataccactttctattggccaacccaggaagaaacatgaacttccttcctcaagtttgaggctggagtctttgtcttagccttcagtcactagagtaagactggtgttctcctcatccaaccatgaacacattgaggacaagggcacatctgagtcatctctgtcatcccagtgcatggcacagtcaacatttgttggtggaaggaaggcaggaatgccacccatcccccccggggagatggtcttgggcacagtctctctttgcattgctcctgcagggtactgagccacctctaccctcacagcaacctcctctccatcatccatcacttcaggtcactcaatgatgagcaagccagctgatagcactttttagctacacaaatggataaatcacagaaaccaacatttgtcagactcagctatcctgattcttcttgtgaacaaaatgatcattaattcctttagacgagtcccccagtctccagccatttgtctcctttccccatgggcaaataaaaatgggaatcttattagtggtctctagtcatctcatagcattgcggggagagctgaagctggatgaatggacatccctgagcttgtggagttctcaccaagtgggcagtgactgggtatgatcccctttggagcctgtcactgctgttgacattgaaaataccggtgtggaaacaaatgctgtctttgtcacaggctcaactacaggggcctctccttccctaagctggcagctgagactaagtacttgagatccctgggccagctgttgtgaagtaaacgccaggcagtaggtaaggcaagattcagaactgggcagaaagccaggctggagagggagcactgataggaggggagcacaaaagttggcaaacaaatgctttccaagtaggttttaaaaaacacaatctggcctctaaagtagacaaagcaccaatggggggtgcaggggtgggggtgctgcctgaaaatgcctgctctgactatcagctcaagaagattctagaactggaaaggcactgtgagcaatgtttcccgaggaggcttcccttggagcacagaaagatagccacaccctttgaagttagctgggagcttacaaagggcagtgttgtttccactaaggaagaatgatagccctgcataatggtgtccttattctgtaaaccccagaccttgtgcgatgaggggcaagtgagcctgcaggccccagcaaagggggaggaaatggttggcaaaacacatacttttagcttgcttactggtcaacatggaaggtcttccctaggaagatggtgtggtcaaagtcaggggtctgtttcaactctcttccaaggatgattgctaaatcatatcaagatacctttttaatttgatgatggctgatgtaagtttccaaatgcttgcatcttctgtcatgtttgatgtatttcagtgaatcatgccacaagctgagaggccctagagatgaaaggctgatgagaaaaaacggatgagcccattgttttacatcagaatgtgaatggtgatatttctgagtagtgggattcctgtcacacaaaaggggaagtcagtaggctggcagtagctgccaagggcagcttattggacaattattagggaatggaatcctaaaattggaattttaacatagccttgatcaactttggaatgcctatggtattgcatcatacatgcttatgtcagggaccacttccaaaattctgactcatctcccaggccaatgaaaccatttcagcatgtgaattacacccctggtgttgtccaagggaatttttgtcagccctggtgcccaggactgattccattaggcctaggagaagctgtgtggtgcaacagaaagagccatgaggagccctgagctctagtcctagctctgttgccaattaactgtcattccaagtgaatcttttagtgaatctgtgtcttggtttcttcagcagttgaaaagagacagttgaatttgatgagttagtctcttacggctttaaaaataaaaatgcatgtttcatagcttggcatttaacaaagaattgtggatatgtaagtaatctaattttataattttctttaggtatgaaagggaccttaaacatcgtatagtccaacccctttatcatacagatgtagaaaccaaggtccagaaaggggaagggatttgatcaattagtgcagaattagggttagagatcaggtttctggattcccagtccagtgcattttccactacatttatttttaaatcaagtaatacatgagcatggtttaaaaatatcaaataggcagctgggtgcggttgctcacacctgtaatcccagcactttgggaggctgaggcgggtggatcacgaggtcaggggatcgagaccatcctggctaacacggtgaaaccccatctctactaaaaatacaaaatacccaggcgtggtggcgggcacctgtagtcccagctactcgggaggctgaggcaggagaatggcgtgaacctgggaggtggagcttgcagtgagtggagatcatgccactgcactccagcctgggtgacagagcaagactctgtctcaaaaaagaaaaaaaaaaaaaaaaaaaaaaaaaaaaaaaaaaatatatatatatatatatatatatatatatatatatatatatataaaatacagagagctgataataaaaaacaacagttctctgccccactcctccccatccccagtcccactcctcagaggcaaccattttttaacagattctgttggcaattcatctgatagttacttctgaatctctaaatattactctgttcccattcttgatttatccattttggacattatctattaactcctgttataaaaatggaagatttagctcacttaacattactcccaactgcctctctttcttctgcctccccatggttgatagcaatattttatgagatttttaaaaattcactttttaaaatagcatgctattttaaaaatttacttttttggtgtacagctctatgagtttaggcaaatacataaagtcatgtaactgccaccacaatcatgatatagaacagttccattaccccccaaatcccctcatgctgccctttgtaattggcttctccctttaccccctacactgatctgttttgttgctacaattttgtcttttccagaatgcccagaaattgaatcatatactatataaccctttgatactgacttctttcactcagtataactattttgagattcatgtatgtgttgttcattcttttgtattgctgaatagtactccactgcatggatgtaccacagcttatccattcaccagttgcagaccatttcagttgtttccagtttgatagcattatttttagttattctattggttactttttaactgaaaatcatatactgaaacctctacttcttgcaccatcatccactatatagtaagtaggtcttctttttcagaatagtaaatgctttggactgattgaaaaacataatactttcatttctttagtcacagttttagacggatttaatttgagggtgtgatttttcatggggttgggaaggtttgctcaaatgctgtccagcagccctattcaaggctacagccattctaaatgcctcctgtcacatagggggccttctctagtaccagatatgcttgttgctgggaagatacgcatgtactttctgttctgaccgttgctaactcaggcagtagtttttgggaaaaagacctttcttcatgtggatttcagcttttgtctgtcatgctttttctgttccagctgccttcaccagtgagcacaaagccacatttcaaaggaaactgacaaattatccccagctgccagaagaaggttagttttctgtgtgttcagtgtcccccttctctgataaccaacaggttaactttctaaagggaactgacaaaagcagaaattgtccttttacccaaatgagttgtgattgttgatttttttaaagatgtggatttgtaatattcctctccattcctactctaatttataccaggaaatagagtgtaagtgatcacaatggaacctctattgtttgcaagattcatattaatgcattctggttttttaagtgcttacaagatctaaattaatttttaaattagctagcatagtgtctttactcaatgagtagccatttaaaggctgaatgatgtcagccctggccatagagatttatgtgttgttatatttcatttgcatttttaaccatctttgtacatgtgttatgcctctagcacttatgctgtataacaggagagagtctaatgcctagcacagtacactacatatagtaggtgctcactaaatgccatttgaattgaaatgatccaaaagagtgtcatgtatatatgatggtaaaatattctgtgttaatgcagtgagtcaggcattctcaaacactaataggaatgcaaattggtacaactctcccacagggcaacttggcaaaatgctcgaaagccttaacaatgttcttatcctttcacccagtaattctccttctaaggatttatcctaaaaggaaatagagatgcacaaaaaaatacaaatacatggaaattcattgtggcaatatttaaaatagagaaaaagtggaaaaaacttaagttgtccatactatgaaatcctatgcagtaacatttatactatgaaatgcaatgtaattatttaaaatcatgtttagaagaatatttaatgacatgagtaaatgctcatggtctaacttaagtgggggaaaggaggatacacaaacatacagtgaaatcccaagtgtgtttgtgtgtgtgtgtgtgtgtgtgtgtgtgtgtgaagaaaaaaaatgactagaaagaaataatagaaatattaacaatgattagccagccatggtggcacatgcctgtggtcctacctactcagcaggctgagatgtgaggatcctttgaagtttgaggctgcagtgagctgtgattgcaccaccgtgctccagcctgggtgaccatgtccctaaacaacaaaccacaaagctataattatccctacgttgtgggattatgagtcattttcattttcttatttttgtaatgagcttatcttactttaaaatccaaatttttttaatttgaaagaagtaactactacttatgctagagggctgacattcataaaatcctagtaatgagatgtagaaccatttctccaactagtgtcaaatcttcatccttaaaaaaaaaaaaaatgagatcgggtctcactctgttgcccatgctagagtgcggtgggctgatcatagctcactgtagcctcaaactcttgaactcagtgtcaactcttcagatgacatgtggatggttacggcagtggtcagtttttagaaaaattaaataaagcccagaagccatttcagatttaaatgctctgaggggtggggtacagtggctcatgcctgtaatcccaccactttgggaggccaaggtgggtggctcacttaagcctaggtgttcaagaccagcctgggcaacgtggcaaaacctcattatacaaaaaatttaaaaaattagccaggtctggtgacatgcacatgtagtcccagctactctggaggctgaggtgggaggattgcttgaggtcagaagttccagaccagcctgggcaacataggaagaccccatttcaacaaagaaaaaaatgtgaaaaataagtcagacatggtggtatatgcctgtagtccgagctactcaggaggctgaggcaggaagatcgcttgagcccaggagttcaaggctgcagtgagctgtgatcatgccactgcactccagcctattattatttcaataataataataataataatgctctgagccttagtttgatattgaaaggaaaatatgtttatccttttctctaggcctagttaattttcatccttttctctccatccccacccctttttaaactttccagatctgtggaacaaatgttgagcaaactggaaataaataaaatccaatggctttaagataccacaaatccctcccttcctgtgtactaatggctacctgcccattctactccccagagtgaagggctagagtcagccaaaatggaggcttttctgattcaaacatgaaaaatgcaaatgctcaaaagatagaaaaacttaggaagtctgaaaagattgagacataacatgtacaactctccctcccctagattcttagcttcacgtgatataaactgttgggctctgctgggggaaaaacccaatcatagaaggcagatatattagtctgttctcatgctgctctgcagaaatacccaagcctgggtaatttataaaggaaaaaggtttaattgactcacagttccacatggctggggaggcctcaggaaacttacactcatggcggaaggggaagcaaacatgtctttcttcatgtggtggcaggagagagaagtgctgagtaaaagagagaaaagcctcttataaaaccatcagatcctgtaagaactcactcactatcacgagaacagcatgagtgtaggcacccccatgattcaattacctcccaccaggtccctcccacgacacttggagattatgagaactacaattcaacatgagatttcggtggtgacacagccaaaccatatcagcagatgtattaaggacagttcatatttcaaagaaatcacacaatcctagacctttagatctggaaggaaaatattccagcaagtatagggctccttccaaataccagatactatgctaatccaaatgttatctcataaaaaaccacctaccatcgcacctcattttatacatgaggaaactaaagcccagagaggggttattaactatcttagctcacatcatttgttggctgctaagttgtgatagttcccatatcttctggaaactctcaagtgaaaagatgggtttttctagtataatctttccttcagctccaaatattccaaatacttactgtgtacttgtgcttggatgttttgctaacagctcaagctaatcaggtacaaagtcaaactcatggtgtttccctcatctccctgtcacccaggatctgaaccaaagtctgttttgctttttactgaatttcatcccccacaaacagtctgttaacaagtcctgtcaattttttccttcaaaaactaccgccaggtcctaacatattgtcaaggaaactcaacctctacctccttaaaaaaacaacccttctcgaccacttcagccatactgctgcctctcttctggcttcatacagcacttttaatctgcatcacacagtttagtttagcacttgtcattcaggggcaattagcatgtgctcagcagcattcactcatgcaacaagcatgtattgagtgtctactatattctacaccctgaaatggagaattcacttttcttgttttcccatatagacatcaaataccctgagagtcgaggccacatctttcttcatagtttcttaaacacccagtgcagttctgggcacatactgaagatctgttagttaaagagcagtacagactcaaggaatctgtcaccagttcagcagctgacgagctcagctcaggggacactttagtctatagttctgcttcaacatctcacaagctacacgagtatgatccactcattcaacaaagacaacgtattaaaatgtgagtttttaacaccataccttcagagataagtaatgagatctaataactaatcagagacgtgggatcctaaaagtcaacttctgcttttagaaagatggagtagatgtacttttccctattcctttcactaagtacaactataaaccctagttattatatatacaacaaacataagacaaccaagaaaggtggagagaagatagactgactaaggaccttgagactcaaagagtgacatgagttcgtgagttccctgagctttctttttgcctcaaatatcccagactggctgctagagaagctagcaattcagaaacaccagtgggaacagatttttctaaagtcccaacaaaagcctactctctctagccaaaggaccagaaaaggggcatcctagaaagacagaaaacttttagaccattactgctctactatagccaaacaccacaggaaaaactgcaaccctcacctccaactgtccatgcaaaggctgagtggtgagcctgaacttctaccccaatttggcagtaacaaggcaacccttccagttttttctactagagcaatgtcagaaaaaaaccactaaaacctaaggtttaaataagatccagagtctcatgacataatatccaaaatgaacagtattcagttgaaaatcattcatcataccaagaaccaggaagatttcaaactgagtgaaaaagacagtcaattcatgccaatactaagatgatgagatagaattatctgacaaagattttgaaacagctatcataaaaatgcttcaatgagcaattacaaacatgcttggaacaaataaaaacggaaagtctcagtaagcaaataagaatacataaagaaccaaatgtagactttagaactgaaaaacacaataaccaaaatgaaaatctcagtgaatagggtgaacaacagaatggaggggacaaaggaaaaaaatcggtgaacttgagtatataacaacagaaattatgcagagagcaaatagactggaaaaaaataacagtctcagggacctgtagaattattacaaaagatataacattcatgtcattggagtcctgggatgagaggaggagactaggactgaaaagtatttcaaggaataatggctgaaaattttccaaatttggcaaaagacatacagattcaaaaagcttagagaatctcaaacatgctaaacccaaagaaatccacactaagacatatcatagtcaaacttctgaaaactaaagacaaagaaaacaatcttgaaagcagacagaggaaaaacaatgatttggccaagcagagtggctcgtgcctataatcccagcagttttgggggccaaggcgggtggattgcttgagcccaggagtttgagaccagcctggacaacatggtgaaaccccatctctgcaaaaagtacaaaaattagccaggtgtggtggtgcacacctgtagtcccagctactcgagaggctcaagtaggaggatcactgagcccagggaggtagaggctgcagtgagccatgatcatgccacactgaacttcagcctgagtcacagagtgaggctctgtctcaaaaaagaaaagaaaaacaataatttgacagagaaactgataaacaattatttaaatggcagttgatttctcatcagaaaccatgtgaccagaaggaattggcacatttttcaaatgctgaaagaaaagaactaaatcctatatcccacaaaaatatccttcaggaatgaagtgggaatcaagacattctcagatgaaggaaaattaagagaacctgtctccatcagagctactctaaaataatagctaaaggaagttatctaaacagaacagcaatgataaaataaatcttggaacatcaagaagcaagaaataatacaataagcaaaaatatgatgaacacaatagactttccttcctctttgagtcttcaaaattttgtttgatggttgaagcaaaaataataatactgtctgatatagttctaattgcatgtagaggaaatatttaagttggttatatcataaactagggagataaagagacattaacagaagtaaggtttttatacttcactcatactggcaaaataacattaccagcagactgtgataagttatgtatatacaatgtaatacctagagccactcagaatctatacaaagatatacactcaaaaccactacagataaatcaaaatgttacaatattccccaaaatattcaaatactcataggaaggcaggaaaaagaaaacaaaattaaaaataaaatggcagacttagatcctaacatatcaccaattacatttaatgtatataaggtctaaatacaccaattagaagacagagactggcagagtggataagaaaaaatgacccgacagtatgtactctacaagaaactcaccttaaatataatgatataagacaactgaaagtaaaaggaaggaaacatatttatcatacaagcattagtcaaaacaaagcatgagtgtctatattaatatcagatagacttcagagaaagaaattatcagatatatatatatatatacacacattatatatatattatatatataaatggctcaacccaccaaaaagatgtagccatcctaaatgttcatgcaccaaacaacagagctgtttgtgaagcaaaatatgtgaagcaaaaactgatagaactgaaagaagaaaatccacaaagccacaatagttggaaatttcaacactcctctcttacaattgatagaacaactagacagaaaattagcaaagatatagaactcaacaataccaacaataacaggatctaatcaacatgtatagaatactccatccaacacaagcagaatacacattctgtagaacatagaacaagatagaccatattctgagccataaaagaaaccacaacaaatttagaagaattgcaattgtacatagtgtgttctctgacaataatggaatcaaattagaaattaataacagacagataacaggaaaacatccaaacacttggaaaataaacaacattcttctaaataatctataggtcaaagaggaagtctcaggagaaatgtttaaaatacattgaactggattgaaaataaaactataatatttcaaaatttgtgggacacagtaaaagccacgttgaaagggaaatttgtatcactaaattatacattagaaaagaggaaaggtctcaagtcagtaatctaagcttccacctcaagaacctagaaaaagaacaaataaacataaggcaagcagaaggaaggaaataataaagataagagttgaaattgaaaaaaaggaaaacaatagagaaaattaatgaaacaaaaacctgttcctttgcaaaaaataaaaaatttaatgaaattgacagacctctagcaagactgatcaaaaaaagagagagagagagaagaaacaaattaccagcatcagaaacagaacaggggatactactacaaaccctgcagacatcaaaaggttaacaactttatacacacaaatataacaatgaaccaattccttgaaaaacacaaactaccacaattcacccaatataaatacaggtagtagctccataactattaaggaaattaaattcataatttaaaaactccccaaacagagatctctaggctcagatggtttcactggagaataaacatttaaagaaaaagtaatgccaattgtacataatgtcttccagaaaatagaagtagaggaaatatttcccaattcattttattaagctcatattaccctgatactaaaatcaggcaaaaacagtaaaagaaaactgcagaccaatatcactcatgaatgtaaatgcaaaaattaataacaaaatattagcaaacagacttcagcaatatgaaggaattatacaccatgaccaagagaggtttattccgtgtatgcaagtctggttcaatatttaaaaatcaatcagtgtgaaccaccatattaacagctaaagaagaaaaatcacatgattatatcatttgatgccaaaaaaatgacaaaattcagcatccattcatgataaaatctctcagcaaacagggaatagagaggaatttcctcaacttgataaacagcatctgcaaaaaaacccctacaactaacattttacttaatggtgaaaaactgattgttttcacccttagatcaggaaaaaggcaaggatgtgcactttcactactcttattcatcatagtgctggacattctagctagtacagaaagtccagaaaaggaaataaaaggcatacagattagaaaggaagaaagaacattttcttattttcagatgacatgatggtctgtatagagaatagcaagaaaactattttttttaaactcctaaaacaaataaatgagttcagcaaggtcaggagatacatgcataaacaaaagataagcatacaattgtatttctatatattaataatgaatacataaacaccaaagttaaaaatacaacaccatttataattgctcaaaaaagacttaggtgtatatctaacaaaacatgaataagacttgtatgttgaaaactacaaaatgctgaggaaagaaatcaaatatctaactcaatggagaagcataccatgtactttaaatgctttaaatccattttaaagattaagcataaaggtgtcaattatttccaaattgatatacatgtttgacataattcccatcaaaacagcaacaagatttttgtacaattttatgtcaaatttatacagaaaagtcaaaggaacacaaatagctaaagcaagtttgaaaaagaagaataaagtgggaggaatcagttgaccctatcatatatctacagtaatcaagactgtgtggtattggtagaaggacagacacataaatcaacagaacagaacagaacccagaaatagtcccatataaatatggccaactgactttttaaaagatacacacacaattcaatggaggaaagatagccttttaaacaaatgatgatggagaaattgcacatccatggcagagaaaaaagaaccttgtagtagtcacggttctccagagaaacagaaccaataggatgtgtgtgtgttggggggcctgtttagagagagaaaaagagacacagcgctgggcgcggtggctcacgcctgtaatcccagcattttgggaggctgaggcgggcggatcacaaggtcaggagatcgagaccatcctggctaacacagtgaaacccccgtctctactaaaaaatacaaaaaattagccgggcgtggtggcgggcacctgtagtcccagctactctggaggctgagacaggagaatggcatgaacctgggaggtgtggagcttgcagtgagccgagatcgcgtcactgcactccagcctgggcgacagagcgagactctgtctcaaaaaaaaaaaaaaaaaaaaagagacacagagagagagattgattgattgattgattgattaaggaattggctcatggaactgtggatgttggcaagtccaaaatttgcagggcaggccagcaggctggagactcagggaagagttaatgttgcaacttgagttcaaaggcagtcagctgacagaattccctcttcctcaggggaggtcagtcttttccttaaggccttcaactgattggataaggcccacccccattatggaaggtaatctactttactcaaagtctactgatttacatgttaatctcctctaaaaaacaaaataccctcacagcaacattcagaggtgtttcaccaaatatctgggtactgtggcctagccaagttgacacataaaattaaccatcacaaagctcagtctaagactcatactttatacaaaaagtatctgaaaatggatgatggagttaaacataaaaactattttaaaatgtttaaataaacagtagaaaatgtttgggatctagagcttaggcaaaaaggtcttagacttgatcaaaagcacaatccatgaaaggaaaaatcaataaattggacctgaccaaaatataaaacatttgctctgtgaaagaagatgaaaagacaagttatataacataatgggagaaaatattttcaaaccacacatctgacaactgacacatatctagaatacgttaagaactttaaaaaactcaacagtaaaacaaaatccaattagaaaatgggcaaaggacataaagatacatttaaccaaagaggaaacatggattgtaaagacatgacaagatgttcaccatcattaatcattagggaaatgcaaattaatacttcaatgagatgtcactacatacctattagaacagctgaaataaaaaaacagtgacaataccaaatgttggtgagaatgtagagaaactggatctctcagacattgctagtgggaatgtgaaatgctacagccactctggaaaactctttggcagtttcatataaaactaaacatgcaattaccataggacccagcaatcacactcctgggcatttatcccagagaaatgaaaacttatgtccacacaaattctcatacatgaatgtttataacagcgttatttgttaacagcaaaaaactagcaacaaccaaaatgtccttcaataagtgagtagttaaacaaaccgtgctacaataaaaaagaatggacaataacttggatggaccttaagggtattaccttgagtgccaaaattgtttgcacaaagatctccactcctcactcctctgccattgcaaacatgctagcttcgattcattgggattcaaaagacaaattggcaaaagaagcacccaggtgatttcaattttgtagcagtgtatgagaagtggcaatctctgaggcaatgtttcttaaatattattatcccatacctgcaagacacacatattcacacatgtgtatgtgtacacacacacacacacatttccaagatgacagattttcatgcaatgagatttttgcctgtattgattcattttcaaagatgaaagatagagacctacctgagctgtgctcgaatgaggggaaagggtgatggttggtagtggcataaggaaaatagcagggaagaaaggaagataacacagagttgcatgaagaggattgtgctgacctgggctccagctctgtagtgctggtcttggccattctctcgacatgtgctgtcttccccatctgcagccccaactctgtatctgacaactgatgttaaaatgtctcttctggccaggtgtggtggctcatgcctgtaatcccagcactgtgaaaagctaaggggtggggtggggggggagggtggatcacttgaggtcaggagttcgagaccagcctggccaacatggtgaaacccggtctctactaaaaatacaaaaaattagctgggcgtcctggcttgagcctgtagtcccagctacccaggaggctggtgggaaaatcgcttcaacctgggaggcagaggttgctgtgagccaagatcacactccagcctgggtgacagagtgggactctgtctcaaaaaaacaaaaaagtctcttcttcagggaggccttgccagatcccgagaataggttagatccctctgttatgcattctttattataacacttgcatataacccttgtatcatttatcgcaaatgtaattacacatttttgagatcaactatctaatactaagtaatgatgtgtgaatttatctatttacttcgtgtctcccatttgggactgtaaactccattaatgtagaaaccctgtgttagttccctttttgatattcccagcacctaacacaatactggtccaaagaaggtgctcagtacgtatatgttggatgaatgaagccaggtaataagaccctgattgacttaaacacagttactcaaaatcatgttaaggaaaaataaactttcatttttaatttatttatttattatttatttatttatttatttttgagatggagtctcactctgttgcccaggctggagtgcagtggcgtgatcttggctcattgcaacttctgcctcccaggttgaagcaattctcctgcctcagcctcccaagtagctgggactacaggcacgtaccaccacgcccggctaattttttgtatttttagtacagatgggttttcaccatgttagccaggatggtcttgatctcctgaccttgtgatccgcccaccttggcctcccaaagtgctgggattacaggcgtgagccaccgcgcccggcccatttgtatttattttctctcttacaaaagaggaaaaacatccctatcccacattggataagactgaatagctacagggatgccctggaataaaaagtactgtttgactacatggactaatgataggaaagcaatggtttcctaccctttgagtctgggggtccactgtatttttttttttttttttgagacagagtcttgctctgtcacccaggctggagtgcagtggtgtgatctcagctcactgaaacctctgcctccccggttcaagcaattctcctgcctcagcctcccaagtatctgggagtagaggcatgccccaccacgcccggctaatttttgtatttttagtaaagatggggtttcaccatgttggccaggctggtctcgaactcgtgacctcaagtgatccactcccaaagtgctgggattacaggcatgagccactgcgcctggccccattgtatgttctttgaggtacagaatcccaagccctgaatcttctgcacatgaaaatgcagacatcagtactcatgtatccatcactggaggggtttctttccacccacaaaatatcccttgaaatcatccagtagagcccaggggttgatggaaccatttgctactcaagctaaaaattacgatttccatcccccatacttattttccccaagggaacaagcgaattaggcaagcacaaaggatttgagaggaggctgcactttagactttgactttaggaccccaatattcttcctcaggcttctccaggtttccagttccctgtcactcacattggagccctccctgccagccagttaggaaatagagattccaccagtgggagaaactggaggggttgggggaacatgctcaaagtcggaacacttcagggacaagtccaacctgtttagcctctcacacataagcttgccttttcttctcaacataccatgatttagtgccaggccacctaggttccccgcatctcctccacccagtcccttcagggaaacagggtcctttctggctgagttccatgttcagtatccagtgctctcctcatggccacctgacaccggagctgttgctcaacccctcccttgatcggatgccctgtattgcttgaactcatttttctccctgggcccctaaatcagtcaaatttttccccagctgctcttctgctctctgctactcttgattgaattcatcccttctctcaaatgtctccttctcacttcctccagcttgtgttttctccatccttcagtattctccaggctcctctctctcctggccaatggtgctctggtgagatcattttcttcacagcaccctcaccccacatccatcctgggcctgctccccagctgtagatgcggtcatttattcaccagcattttgcaatcaccaaacaaccacaggttcctgtgggttccctacacaaggagggtctaactccagcacacacataacagaaaagagggttctacgggaggcagaggttgcagtgagccaagatcgtgccactgcactccagcctgggcaacagagcaagactctgtctcacaataaataaataaataaataaataaataaataaataaataaataaataaaataaagagttctagaaaaaaagggtgcaagattcagatattactgagtttgaagatgagagtatttttcagcaaaacagctagaaaatcgctagctttccccctaaagagggggtaagctaatcaaatcatagttaaaatctattcaagggtgtttttatatcactttcctatatgcatcctctttgtatataaaccttcttcaaaatgctctcagaaagaatacaacaagtaccagaaccttataaattgggcttttctagggtcaatcacatttttaagtgggggtaaaactgtaccagttcatagaaataagaaatatcttgacagttgttttattctgcatgaaacgtgccctttttcttacagtttggaggttatgaagggaggtaacagaacaacatcgattttaatccctgtccccttcccgcactgcctgcctcattgaaagctagtgggtcttatgaacaaccttaagatgcctgcgagccacggcagaggccaccatgaatagcacttgaatgaagtgagagaaaaaggaaaattgggaagcatcttactggtgccatctcccctacttaccattttctgtgatgtacctgggccctctcttcatgaaattgttctggagaactgagggatttaaagggctacgcctccctagagcagtctgcatcttaacaggatccacaagtggaggcttttttttttgaaacagggtctcactctgtcacccaggctggagtgcagtggcacaatcatagctcactgcagcctcgaaatcccaggctcaagcgatcctcccagctcagcctcccaagtagctgggattataggtgccaacaaccatgaccggctattttttaaatttatttatttatttatttatttatttttgtaaagacaggggtctcattttgttgcccaagctggtctcaaactcctggcctctagtggtccatctttcttcctcggcttcacaaagtgctggcattataggccccagccaccgcacccagcccataaagggaggcttaaggaaatgtctgacttctgtggggagagaaccagctgtggagtgagctcagcctggccttgactcctggtcacttactaggatgtgacctgcatgagcaagtcatccaaagtctctaggcctcagtttcctcctctctcacatgggaataataacagtccctacctcagaacactgtgaagcctacatgaagcaaggctcacaaagccctaagtgcagtgcctggcatgttgttagtactccataaatgttaatgtgggctgggcgcggtgtctcatgcctgtaatcccagcactttgggaggcttaaggcgggcaggtcacttgaggtcaggagttcgaggccagcctggctaacatggtgaaaccccatctctaccaaacacacacacacacacacacacacacacacacacaaattagctgggcgtggtagtgcacacctgtagtcccagctactcgggaggctgaggcaggagaatcacctgaacatgggaagcagaggctgcagtgagccaagatcatgccattgcactccagcctgggtgacagagtgaggctccatctcaaaaaaaaaaaaaaaaaagaaaagaaaaagaaaaaaaaatgttagcgaggagaaggaagaggaggagagggagaaggcggcaagatgaccttggagtcccctggaaagaaggggcctagctgccctctgcgtccttcccctaccactcttcctttcacggcctaatccaaaggtggcttcacggcccctcgggtttaacagctgagactttgtttccagactcacaggtgtgctgtagtgagcacctgggtggaatgttgctctctgtttcctgcaattactaaatcgctttaaggggaatgctgtacatttttttttcaaatgaagtctgtgcttgtatttgctcacagggaattttaaaattgaggagatgatgagcttgtttactaaataaatatgtgtgtttggaccatttgccttctcctccctccagatgccctctcctcctcccctcgctgtgggcttcaaaagcagggcaggcggtggggcaggaaaatgccagttgttggtcttcttggacccaacaattatttacagagcacaggatttacagtcaggaagaattttttttttcacagaaatgggcaaatcctagatgctctctatgtatacaaacttcctttccaacagttatgaaaggacattttacattttaaatgagagccctgttggcggtacattctcaaatgctaagttccatcaaaacagcatgttgaggggaagaagggcacatggcaatgggcacctttgggtcccaacttctccccagcaatgctgtgactcaggaagtcagcaggggtccttcttttcacccctagttccctcccccaactccttgtacatctgatgtcaaagcataagctggtaacctataccgagagggagaattcaacccaggggcagctcaacttgaacagttctatccagaagtccaactttaaattctaccccccatagaaatagtcccattcctgcagctgctctctaccagctgcctaaccagctgccattgggccaaaattacccccacctcagggtccccacctcaggacatcataaacacactccctggggctcattcattaacccatgagctggagttgcccactttggaagtcagctgtggtcttcactattttttttaacttaaacaataaagagcaactcacagatatccctcactctcagcacatgtggaatgagataaaaacaaaagcttgctaagtcagaccccagaaccaactcaaggcagagatgatgtgaatgtggaactaatcaagaagttacacgtgttagaaagatctggcttaatggttctctttttaaaaaaaaaaagttttttgagacagagtctcactctgtcacccaggctggagtgcagtggcacaatctcagctcactgcaacctccacctcctggggttcaagcgattctcctgcctcagcctcccgagtagctggggctacaggcgcgtgccaccatgcccggcttttttttttttttttttttttttgtacttttagtggagacagggtttcaccatgttagccaggatggtctcgatctcctgacctcgtgatccgcccgcttcagcctcccaaagtgctgggattacaggcgtgagccaccgcgcccggcctaaaatactttttaaattttaagtggcatcatgaaaggtggaatccttgccccgtttttctgattccttgttgtttttatttatttagggagaaagacgttctgcctgtgtttatgtgtcagttgcagaatttgtgggtaacaggaaatcaggtatgaaattgaggctaggagctcacagggagcaagagataaataatccaggattcaagattaaaatcgctgttgcttctgtggtgagagcttgtcacacaggcaattcattgtggattaattttccagtgatgtagtaacaaaatcagcacatcaaataaaatatttaacacccaggaaaagccaaatgcatattctgcatgtgtgtccttaagtggtacttttatggaaggaaatcttatttgaaacaaatgttggaacagaagttgagcttatgaagggcaccgagaaaccctcacacataaggttttaaaatgttgcccagaaaaagcataatcttcagtgtcagtcccttggatggtcagcgtgcacgttcaatgctcgtgtttatccacctgtgtgcacaggtgtccactcacttgcaaatccttcacgtcaaaatctgatagtcatattgcttacctgtgttaaatggaaaatggaagtcgactggtgggtcctgttgtctagcaccctactacttggtctcaggacaagaagggaatctcagaatgatgaatggggttatatctggataccccttgctgggctgcctgcgatcagcatttctgcccacagctaagcaattcaagtgctctgaccccaaagtggtgagcccccaagcttctatctggatctcttgaaggaagtgtgtagggtgttgcatgtgatctgtgcaaaaggaaggagcaaattggagttattgagtgaaccgatagccaggggaggcccctgtatagacagatgtcgtggaggcatagtcaggaaaagtttgccatgactcggatttctttctctgcctgcccagatgcctgcctgcaacctcttttttttttttttcattcacttgtacatacattcctcaagtatttaccaaacacctatttcaggcatgggcctgggctagccagggcagtagtatacagaagtcgtttgttttctcctctccctctcaatgggtcttctctccttctctctctccccataattcagtggtaacaggggtggatgaaggaatatccaaaactcgtctctgtaggagacatctgcgccaggaatttccagcaacccctgaggagagtggcagattgatgggactctagttgggactaaccagggggtggagggaggtgggggcggaaagagccctgcagccaggctgtctgcctgagcctattctatagctcccattgattggacacttgctctgtgccaggccctgtacgtgcagtttttcagacctcattcactcctccaatcccattgaggttgctattataactgtccctattttatatgaggaaactgaggccaggagagggaagggacttacccaaggtcacacagctaggaagtgacagagcctcaattcaaacttaggtctgtatatctccaattctctgggcatttaaaaaaaaaaaaaacaactcagatgtggtttagacgtaagccaaaaaaaaaaaaaaaaaagccaggcatagtggctcacgcctgtgatcctatcctttgggaggcggaggagaagcatcgcttgaggccaggagtttgagtctagcatgggcaacatatcaagaccctgtctctacaaaaaaattaaaacaaaacaaaacaagaaaaccctccttatcattatatcaaaagtccagacattttaaaaagagagagcttaggagcttctaaaaggtgctatgaactctgtttccatgtgtggtttagtctaatttctatattcaacaataataattttaataataactaacacttactgagcacttgcatgacaggagctacactaaacagttttacactcatggtgtcatttaataatcataacgacccgatgcagtgttatcgttattattattatcctcattaacaaatgatgaaaacaatgcttagaaagtaattcccaaagttagttagcgccgtcttattccaagtctctcttggtacatcaaagccactcaactactagactatcctgcctcaaaccctccaggacctcattgcttccaaacttctttccctagactttcttctcacctttttttctgtccttataagtctgtccaaatacattgcactcatttctgtcctatgagtgagctaagtcattgtcttctccataaccttgccttttctcctcacccaaatcacttcttatctccaatatccaattagacagatctggaagttccaaggatgtgtccatatagggaaatcagaacaagaatactactaacaccaagttttcagtcacccttctaggttcacagaatcttaagaagtcagcaaaaccataagcccttgtacttaaaaataatcaatactacttaaaacttggtatttattttattttatcttattttatttacaaacactatggtgactttaaaacttagtttaaaaaaatactccccgaggtctgtaatctcccacatacaaaatctctaaaggagaggcttaaaagagaagtactcctccctgaaaatcagactattttataaataatgataaggtggcccttttgaaagtattgcttatttagaggctggggatttaaacttagatcactagtgagggtgtgttccaattaccatatccctagataaacatgaccttctttaatcagctctttgctccctagtttcttagcagaactgccaatgagccagggcagctgccattttgtgccagagtttctttttccattttccaaggaagcaaagaataaggaatgcctcacttccctccccattccctgtttggagtcatgccctctgagaacttattctatttcagcttctacctctatgcagtcagaaaaatgattccgaacaacccatagaatgagcacctgcttcagttattgtcccaatgtgaaaatgctaatccctgggtttaggcgaggtttgctttccacacaaaatggtcaggcccctctaataggccagcacttctggttttaataccccagtcttgatttctaacaggtgggtgccacagttgttcagctcttattatgagctggttcatagctcgaacaatataggattcttcataaagagtctgagaaactgggccgggctcggtggctcacgcctgtaatcccagcactttgggaggccgaggcgggtggatcacttgaggtcaggagtttgagaccagcctggccaacatggtgaaactccgtctttagtaaaaatacaaaaattagccaggcatggtggcgggtgcctgtaatcccagctactcggggggctgaggcaggagaatcacttgaacccaggaggtggaggttgcagtgagccaagatcccactactgtactccagcctgggtgacagagtgagactccaactcaaaaaaaaaaaaaaaaaaaagagtctgagaaaccaccagatggtattattggggggaaataaactcagttcctttcttcagcaacccaagctagtggttttaatcaggaatgaagggcgctttcaccctgctgctttcttcaaactcagtaagtgccccccaccctttttccagtttttacaaattaaaatgtttgtaaaaacccaacttatgccagggaactagggctgcctagctctggttgtttccaacatggcactaatgagacattgcccattgattcagtcatttgactgtctgtactctttccctccctcccatccaagccctgacatccaggtctggagtgtcacaaacattcaggcttggcaagagaagcccattctttttaaagatatgatgaaatcagaaagacacacaatccctgtcctcagagtggaatcaggaatatgtgattctccacttccataacaaatgcaagagttggagaatgtgtggtaccctttttccattcaggaagatttattgggtgagtctacaggccattcttcttagtttggggttgccgtatctggtggctttgtacagaagccatacacatttccctcgtcaaaacagattgagaaggcctgaatatacagtgtgtctcgaggttcattgtgttctgggtatgcatgcaacccacggaataaatgtgttacattgaaataaggaatgactgtgtgctgacaagaagtccaaaatatagagagtgataaaatagaaacagtggtccagaattatctactctaaatgcccttgaatttctgtctcccatttattgcctctatttttctcaatttcccctgcttgaaaagctattaacttccccacctctccaccaccctagactctgatacccataaacaaccgttgccactcttttatgtcctctgttatgaacaccttcactgtgtttactttcttggcactggcatagactagacagagaactatagaagcttctcgttctggctttgccacttatgacctttgtgtctttaatgaatttcctaacctttctgatcctcaattcttcttccataaaaggaagctaataataataccacacagagttgctatgagggttaagtgagatactgcacgtacagccctaaacacagtaatacagtgtctcaatatatatccatttccctccttcctgttttccttcctttcttctttctgcgggaatctcagtcgctacgtttaagcaactgcctatgatgaaaggttttgtctagtgggtggacccagtttctgtctttgttctcatcacttaggtgtaaaaagaaagctttaaaaagtaggattatttttgagggcatatagaaaagttgttgctctttgtataagacaaaatatccaagtttcaaaaatcccagtggcctgcctaccttgaacctctttctgttcttctactcccaagggtgctccaattggcggaaggtagccacgtgggaaattaaacggcccatctatatctatttatacccagcgtaaatgcagagcgatcaattttagaactggtggcttggcctgagaaatagctatgtttggtggaagcagggcaggttcataaagaagtgcacagagctcttggaatacaggaattatctgctcttcttggatgtgggtgtcctcctagggatgagcatctgccctcactgtcctaagttctagaggcctcagctttccgggaaagcacaaaccaccgctcagctggagtctatctgggtctcccctctccaacttgtgacacaagtcttgtgtgaaagcctgagaacactccattcttcctcttgttgttttcaggaaagatttgtccctgtctctcactgccacataccatcttagagcttctctcagcttccccgagtcatgcatgggaaattgctcccacagcccctctatgctttggtttgctcagttttaaagttgattctgtcccctctcctaaaaactcagccatcagacactgaagcagaatcacccaagtgttttagagccatagtccggaagccaagccacctcaggactttccttttctttcatggtgattaaatttattgtaatgtctggccatttttctctgagttgtaaggcagagaagcaaggtgggctggtggaaaggcctgaggccccgattgacttatctaaccttgatcttggccaaggctctctgcccttctgggacccccgtttccacagttttaacatgtgatgcctgtctttggggcccttacaggagagctgcaaggatcaagagggataacaggagggagtgcattctattggggtagggctggggaatctctagacaaaagatatccaaattaaagcaaaagtgctgtattttgagatttgttgccatatgtaatccatacacgtttaaacaagctttttagaacccctggtttctgtaatcacttaagacattgcaaagaagcataaatatatatttttaaagtcatcactactactactttctaggtgaaatagaaagtatttctactttgaacatttgccctataactgtgacagggcctccatagactgcagttccaaggatcagagccccaaccttttaaattcggtgcaagaaatttgctttaatttggatatcttttgtctagagatttccccagccccaccccagtagataactccctcctgttatctctcttgatcagctctcctgtaaattccccaaagacaggcatcacatgaacccccagttcaggctttcagagaccatgctgcttagaaagaccatttcctcaaaaaaaaagtagccaggcgatcccagctactcaggaggctgaggcaggaggatcgcttgagcccaggagatgaggctgcagtaaactgtgattgcacgactacactccagcctgggcaaagagcaaacccctatgtcaaaaaaaaaaaaaaaaaaaaaagaaagaaagaaagaccatttccactgccccacccccaggctttagggctgggcagtaagctccattctgagtttttttttcttttctttttttttttttttttgagacagagtcttgctctgtcactcaggctggagtgcagtggtgcgatctcggctcactgcaagttctgcctcccgggttcacgccattctcctgcctcagcctcccaagtagctgggactacaggcgcccgccaccacgcctggctaattttttgtatttttagtagagacggggtttcaccgtgttagccaggatggtctccatctcctgaccttgtgatccgcccacctgggcctcccaaagtgctgggattacaggcgtgagccactgcgcccagctggtttgttttcttaatgactaatacttagaatcattctgagtattttcctctatatcatgacctgccctcccttctcccctgccaccttccccttgtaattgccaccaatacacagtcacatccagtcacaacaaaaacctggctgagaggtcaagtccctgttagaaaatgttatataatcttccgtatctcaggattagaggcttcaggcatcaatgacattgtaagactttcaagagaagacctacataaataacctctgtatgtgtgcatgatgtatgtatgtgtgtgtgttcccatgcatgcatttgttcataatacatgtgctaatctatccctccactacacacacacacacacacacacacacacacacacacgcatgcatgcacacatgaggcattctgtgatagaaccttaaacaccatcttttttttttctttggtggagtctctctctctgttgcccaggctggagtgcagtggcgcgacctcagctcactgcaacctctgccccccagttcaagcgattctcctgcctcagcctccagagtagctgggactacaggcatgcgccaccacgcccagctaatttttgcatttttagtggagacggggcttcaccatgttggccaggctggtcttgagctcctgaccttaggtgatacgcccgccttggcctcccaaagtgctgagattacaggcgtgagccactgcacccggccaaagatcatctactctagcctctgacgtaggacaggatctccctctccagtgaccccaacaagtggacagccagcctctaactgaatgcctacagggaacaaagagatcttagtttcactctaggtttctccatccatttttggacaacttttatagttgggaacgtctccctgatattacactgcaattctagttcagtttctcctgtaggcatcaaatatcagcaccaataccacttttaactggcccctttctttctaagtttttgtctctattccttgttgcttcatcatatttctaattctaaatggaatttaagattgtaacaaaacacagagtcagaacattaataattgcaggctcctatctcagaaaggaggcatgtgtgtctgttccatttgttgggaagatataattgttagtttgctagggctgctgtacacaaactgggtggcttaaaacaacaaaaaatgtattgtcttacagctctgggggctggaagttcaaaatcaaggtgtcagcagggccatattgtgtgacggctctagagaagcctcttctagttctggtatttgctgacaattcttgacgttcctggggttgcaggcacatcattggagtgatgcacatggccgccttcttcctacatgtctcacattgtcttacctctgtgtgtgtctgtctctgtgtccacattttccccttttgtaaagacataagtcattggattggagcccaccataatgatttcattttatattgattacctctgtaaagagcatatttccaaataaagtcacattctgaacactaggggttaagacttcaatatatctttttgggaggacacaattttttttttttttttttgagacagagtctcactctgtcgcccaggctggagtgcagtggcacgatcttggctcactgcaacctccgcctcctgggttcaagcgattcttctgcctcagcctctgagtagctgggactacaggcatgtgccaccatgtctagctaatttttgtgtttttagtagagacagggttttaccatattggccaggctggtctcgaactcctgaccttgtgatccacccacctcagcttcccaaaatgctgggattacaggcgtgagccaccacacccagctgggaggacataattttatacatatatatgtatatataattatctagctatatagaatatatagatatagaatagatatagatatataatgtatatatagaatattagatacatagatatagaatacatagataggtattcctaaacatttgtagtccagtgatgtaagttcaagtctcagtcctggagaaaaatttcagaaagaaagtccttcattctttgttaagggaagatagattaccagtggggggaaacttcctttttgttgttaataattatattaatatcatatatgtatatattattagatatgataagacttttatatttatttttaacattatatatggtgtattttaaaatattatgtattataatatgcaaatgatgaacacaagtttaaccaattgcttttttttaaacaagtaattaatttcaggaaaaaggcaccaaaccaacaccctgttctacttttttttttttttttttgagacggagtcttattctgtcgcccacgctggagtgcagtggcgccatctcagctcactgcaacctctgcctcctgggttcaagcaattctcctgcctcagcttcccaagtagctgggactacaggcacgtgccaccacgcctggctaattttttgtatttttaatagagacggggtttcactgtgttagccaggatggtctcaatctcctgacctcatgatctacccgccttggcctcctaaagtgctgggattacaggcgtgagccactgcgcccggctcaacaccctgttcttgctcttttttttttgtttgtttttttttggagacagggtctcactctgggctcaagcaatcctcctgccaagtagctgggacaacaggtgcgcaccaccacatccagctagtttttaaaaaattgttatgttttttgatattgctagtataaggagctatcacacccaaagtcaaatcttcgttatatagaaagtccagatcagagaagtgtatagtgatatttaccagtacaatactctatcatatgtggatatggggtcaactgcaaagcacttttgggaacattcaggctcggggacactcaaactgacgtgaagttagcctggatctctcttttagtccagagttggcagagtgaaaagcccagcccagagggagccaagggtcaagttggggtaggggagaattcacccatcttgcctctgatttcccaagaacctctagcattttctgatttctgtatctgtgtatggaactgggagtggatgtgtaggtctgctctcaggaggaacagatatccagcctgtggtttaggttcctttttctagctaagggaatccttggacaacctcagggctaagtccatttgcctgggtaaacttggggactctagcaagccccttcgaggcaccccaccattcttcagtacctcgtgaacctgaggcttctgcttctgattatgctgtctctcaattgcctggacttggtctagatacggcttgataatttcttctttcctcccatgtaaaggccagactaggggagagttccactttgtcttctttccagaggacgacttatcacagggatggaggaaaaggggtacaaagagtgctggctgcacttggagtcactgactaagagctaattgacaggacattgggtaccgttggatgggacagacatagagcccttggcatcaatgatcctagaagataagcaggtgtgcaagtggacaggccaggacgcttgttaggactctgtactctctaactattatagaaaggctctactgctaccccaggccttcaactggtagactagagaaggagtgggggaaggggttagccaataaccagattcaggcccttaggggctggacaaggaggcacaggggcaggtggtgatttctggtggtcattcattaatttcttccttctttcatttaaaaaatatttactaagtacttactgtgtaccagatactatagtagatcaagaccccatttttaaaggaatttatggtacaataattaaggaatggggagaaatagtagggatcagggcaatagtaagaaacagatttggggattttcttctcctcagtatgtgtgtgtgtgtctgtctctccatcactgtgtgtgtgtgtgtgtgtgtgtgtgagagagagagagagagagacagagagagagagagaaaatttatcttcctacaatgtcctcatcacaaagcaatgcatctttacctactccgatatgcacgcatgcctcccaaattgtaggctcgctaacaatgaccaacagccttcctatcaaaggaaccttttctaaaaccttctctacgtctcaggagccaaatgatggtgaatggcctcagtcaggatgttatacacatgcaccaagtgaccacattctgggtggggcatgcacaaggtagctttgggttttggaaagatgcattctggtcaagtcagtgaaaaatcagccaagtagcctataaagtcaactgtggtttattttggacttaggccacacctaaggggccatatgcgtgcacctcactttaagaaaacctgtactcaaaaatcccaattttgaaagggagacgggaatgtgcctgaccatttttggaagccatctagagccctcatttattgacacaggtgtatcaaagaggtggtgaagcccttgaaggaacatctgattcaatcctctgccttctgatgatttcagatcacctcaggcaaatgggcctttatctggttttggcagactcccagagactactaatgggttaaaaatgtggccgtggctgccgtggagttgagaggtctgcacagacacaaacctaccttgtcttttaaaatgagaagggactctggggctttgtggaaaagggtgtagttttctgaaaaaaatcaaactcaaataaattgttaagttaaaacataaactgaattaggggcatacatttgggatgtccctcacacttcatggaaattatgaaatacatctctttgttcaagtttaaaattcaaccaactcagcttctctgcacaaaaggggaggagttcccatgacctgatctttgcaatttcctctaaagtatggctttctgtatttatttaggaatatttatgttcagtcagggcatggtttacccttgttgtgtagccttattatggtttgatttcacattggactactcaccttttagtaaccaaatttgcgacccagcggaaatttctctcttacaaggagcttggattcttatttattttgcaacctttatttgtgtatgagatgaaccatgacatttaaactatgcttgatagcttaacagattataagaacaaaaccagatggcccaaacaaaaataatgctttgattgctttaaaattcaatgtcaaaaattaaaaacagctttcaaaaagccttgacttttttcccccgagataattttgaatcatatatgtggacatatactttccccccaaattagaaatatataaaaaatttaacaatggttatttgggggttgagaagggtgtttccttcttttttcttttcgacaccacccaatttttctgcagttagttttagaatcagaaataaatttttaatggctgctttttagtttaattttaatgaagcctttttaagggttcggtcaaggtgtttttctctgctgagaaaatggacattgttaagcattagcagttcataattcttcttccacacaaaatgatgaataatgtgcggttactttaacactgtgcttcatgaggttggaaaactaaaccggtctcagcgtctttaaaattaatgtaaattctacaaaagcagttatttaattttctaactcgctttaatgtactttcaacatcattagtattaatcacaattgtcactttctttgagagcagtgaaccaactaattccttaaaactgggctttaaaaagaacctccattttaaaaggctctcaaaccttgagatagtttgcaggtcacagtcagaatgtgactgcttgaatgtttaaactaaagcacccacaaagtgttaggattcctttttttccgttcttgtcttgtaaaagaatctttattctgactcagattcatttttctttaaatcagctgcaagagagtgaacaaactttgctgcaaatcaaagccctgacagttacatttccctgagataattgcatgctgctttggagtttccttttccctgctgtttccttttgttttgacaacaagtttctgggaaaacaatatacaaatgataactatgctgtcacgagtatactgaattttaaaaataaataactgtcgacccaaaaagcttccaggagcctatggagtgaattctttttccaaaccgttccaaaaccagatgtggaaatgtttagctaattccccttcccattcttcatgcaaagagttcatacgtgtctctaacgacatcagaggagatggggaggcaaaaaatcctgtctgctttcaaagcgatttctcttacacttctcaattctctctctaacgtcacaaaactaatttggacttcagcttttgtctctttttaaaaggatttttttggggtcctgagattaaaaatgctctgtgcttagaccaatattcaatctcttcattataaaacattaagaaatagagctcatggtaagaacacttaaaatctaccctcttagccattttgaaatatacaatatattattattggctgaactcaccatgctgtgcaatagatcactagaacttattcctcctgtctaactgcaactttttactttttgaccagtatctccccttaccccttccactccaccccaataaccaccattctactctctacttcttaaagtaaggcaatggtcatgttaaccagcttgatctaaaataatcattccacaatgtaaacatagatcattgttacatgtatacatagaacactgtatcccataaatatatacaatttttatttgtcaatttaaaaacaaaacaactgctgaactttataagcagcattttcagcataaaaaatttaacgatgggggagttaagtggcagctcttcttcctctttcctttttttgttttggccaatccattctcttcctgtctataagaagaaaagggctgtcttggtttcacaagtactacgagatctcagtctggctttgctaatcagattgtatcactgtcagtgactgatatagatagctcttaaacataaacactggcatttttctgaacttaattaaaagagcatatgtgtttatgagggaagaaaggaaatacagtttatattcccaaaatgaaatgttttatgattttttaatgtagaaaatttattaaggcttattagggagttcttgaaaaaaagggaaagaggaaaactctgttaaaggagctagtgggaaatgtatatgcataaactccatttacaaaaaaacagaaagctacttgtactctgtagcttcaaggaaagcaaacattttgcatccaggtgttattagaagctctgggtttgcctgacctctctatagctcagttcaggacgctgtgtaccaacagctgagccctacttggctatacaaatgcatctaggctcattgcttcgggcatgttgcaaggctaatttgcaatcgagtcaaaatggggctacagtgatacagaccctgagactgctttttttctcagcacagaggcctccccaagaagctggacagtagtcccaaaatgagtgctcccttctttgcatttatttcttccccagtccccaactccacgtcagctctaaagagttctaaagactttaaatagaattctgcccacagctcctgggatactgtgcatggcccgcatgatggctaaaaataccttcagctgggcacccccacacagccctctcttctggcatctccttcccatctctaacccctcagccttcttttccctctgcccccaataactagagcccactttctccctcccttgttcgggatcccattcttccagcacatctcagcaaggtgttagaaaagtcagctgatgaattcacactgtgttgtgaatgacttataaccatcccccctgccggacgtggtggctcacgcctgtaatcctgtaatccgagcactttgggaggccaaggcaggcggatcacctgaggtcaggagttcgagagcagcctggccaacatggtgaaaccctatctctactaaaaatacaaaaattagcagggcatggtggcgggtgcctgcctgtagtcccagctacttgggaggctgaggcagaagaatcgcttgaacccaggaggcggaggttgcagtgagccaaggtcgtgccactgcactccagcctggacaacagagcaagactccgtctcaaataataacaataataataataaccgtcccccaacacacacacacacacacacaaacacacacacacacacacacacacacacacacacacacacacacacactactctacccttccctaggaattgcaggtagcaggagaagggaggctgccctgctttgaggatctgttctcagcaagaaggagtaagtctcaaagtgtgccaatgagctgggcattcgcaagctcattagaaagtacattctgctttccccctaatctcctttctctccccttagagatgagcaaccttaaacctgggtctcagtgacctcttctttaagctttatctgagctgaagggtgtgctgtcacatgcctagtcatcttcgtttatttctcctatcacatggtgagctgttcttggctttatgaaagtcagaggaaagagattctgccgtgttcaaatttggagagttgtactaaatgaacccctaaactcaatgacattattgagccccttcctttgagactgactcagtgcaacataatacaagaagtgaacgtgtgggggtgggaagtgaggtagtctaaaatgattgcttgagggacaacagtctcatttctcagaaattctagacattttataattatatttggattatctttggggaaggaggagaaggagtacaggaaagatgcttgagggagggggaggaaatggatggcttagctctctggaaaagagtagccttaaacttgggtgttaattttggggtttgaacaaaaacagttgtttccttggcctagtccagaactacttaaggaggaggttttcattcagggcaattaggcccaggttgtgggatgatgttaaagaaagaaggaaagaaggagagagagaaaaagagagaggcaggaagggaaagaaaacccacctaaagcacatttaagacaaggtggtcttctatagatcaagacaatagtgcagtagtgatggggtgattatctcagcttccaaaaggcacctcagcaaatgttatgcagtattccagagcaggtggtttctttacttaactgttgagtcatccaggaccagctcacatcagaatttacttatttgtgttgttattattgtttcctttttgtttgttttggggatttttggtgcgggggagagaaagggagtaggtttttgtttgttgctgctgcttctacttttgctttgtgaaaaaaacccaaaaaagttgtcccagaagagacatttcagaaggaacaaagaggaaggagcctggcagacctgtggggcttctcttttacacccacaacacccctgagagaatgaggaatcattaacggcagagtgaaagacagtgagaccaatccgtaccaatcagaaacaaaacatttcatccaggccagtgcgtttttctagcgggctcctgtgccatggtttccattaaacaatgcagcaaattcgtcactatcaagggaagagaaagagctgtatttttgcaactggggaaaaagagaagagagaaatgtcttgggacgttttttggcccattgccgtgcacatagtaggcattcaacaaatattagtcaaagaatgaatttgtgcaggggttacttatctcagcagggaacaaaagtgaatccctatatgcatgtacatttccttccaaactttaggtactttactatgtgatttatgtcattttcacttgtaaaatgaaagttgagttggaaaacattggatgatgttgctcttgctttcttctttcttcatctgttacctccttctgatagcatgttttagatacttattcctagcactgctttttctcctcactggtctgcctgtcactctttgagagctagaagcaataggactaggaagtggccacagagcttcctatggaaaaagaaaacaataaaaagctagagaaaataaaagacgtaatgcaaagattttaggagatatcttgtcaatcaatgtgtaaagtacaaactcaatcctccctctctccctccctccctccctccctccctctctctctctctttctttcctttcttttctttcttccctttttttttttttgagacagagtctctctctctctgttgcccaggctggagtgcagtggcacactcttggctcactatagcctcaacctccaaggctcaagcgatcctcccacctcagcctcccgagtagctcatactacaggcgtgcaccaccacactcagctagttttttgtattgttttatagagacaggctctcactatattgcccgggctgctcttgaacttctgggctcaagcagtccttccaccctggcttcctagaatgctgggattatgggcataagccgcccctttctttaatataagacttttacggtagttttcatgtgtaatatgcattgaaaaatgtaaaattaaaaaccagcatgtttttatgtttccacaattttagtattttacaaggtgtcctaaagaatttatcagggactctattggtcataatgacttatgatgctgctgccagagtttatgaagcattcgtttgatcattttaagtaagccactcggcaaaatttcaatatctggttgttaagaataaaccacaattccttcataggtttttatttgatcaaatctgttgtaacaacaacaaaaaagcgatagggaagggttcattagtatggcctatgagaggacatggaggcccctaaagagggaagtattgccatcttgaattaaactctatctcctatctctttattcaacgtttgacacaaaaactgttctgttttgggttcatcttgaggttaaacacaaaaggatgccactcctgatcagtgtaaactgttgttctacatattagggatatgtgttttatgctagaacagcatgggaaagtcactttaaaaagccattgtaatcgtccataaacacgtgagttccaacaatgaaattaaagttcagttctctctcaaatgagtgttttcctcttcttaatgctttaggaacagccctttgcttaaaaaatatatcatgtttgaactttcaatagaaaataagatgacttgcctcttgtgtttttttgtgctctagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgg

SEQ ID NO: 3737 - DNA, 92645 bp, human; identical to SEQ ID NO: 3733

SEQ ID NO: 3738 - DNA, 167759 bp, human; identical to SEQ ID NO: 3734

SEQ ID NO: 3739 - DNA, 162765 bp, human; identical to SEQ ID NO: 3735

SEQ ID NO: 3740 - DNA, 197753 bp, human; identical to SEQ ID NO: 3736

SEQ ID NO: 3741 - DNA, 86 bp, human
tcctgtccagttgtgcactgggagagaggttcattcactcaacagatattaactgaggggctactgtgtgccaggcactgtactag

SEQ ID NO: 3742 - DNA, 167759 bp, human; identical to SEQ ID NO: 3734

SEQ ID NO: 3743 - DNA, 162765 bp, human; identical to SEQ ID NO: 3735

SEQ ID NO: 3744 - DNA, 197753 bp, human; identical to SEQ ID NO: 3736

SEQ ID NO: 3745 - DNA, 26186 bp, human
aggaccacaagcggggccgggctacagatgctgcggctgcccgggcagcgctagcaccgaggacctgacagtcgggtaggacccggccgggcggccttggcggctccagctccccatgctcggggacccggtccagccccccatgctcccggacccggtcccggaggctcctcagccctgggatcggtgcttctcccctccctgcccccctcccgcctcgaggacaggttgggggttcggcctctcagccgccgccgcggtgcctcctcttcctctctcgggttctaatggtctgggggaacccgttggggccaagaccaaaatctacaacctgcagtctcttccgcctcccacgcttcagaagcgggaacctccgctgggccagttcttccgcgtccgggcacccatcgggtcctgcgcacgcgtccagcggccactccaatgggcccgcgggcacggagcgtgcgtgggagccccgcctcgaaatccgcctccaaaggggaggagcgtttccagggggcccggcgccttcctcgatggcattggcctggggaccctggcgcccaattttgaaaagaaccaatagtttgaaaatgctggagcatcagctttcaggaggagtttgggccaatattcatgggaaatagagaaaaacatggggtttccatgttatttcactcctaatttgtacgctccgacctctgtgatccccactcatgccttaaatccctcgattttgttggtctttgtctgcaggggctgatttctttttcagatcatccattcggatgcactagacaaaagagaagtgggaaaacaaacgcaatgggtaaaaataaagcgaatatcatgacagttcgtatagctaatgagaaactcagctcccttttgcaagcacctttagattcaacaaaactaggaaaagtcctgaagaacgggtagcaagcagaaccaaatgttttttcttactaggaattacagagtccctaacaatcatgcctcagcgtgggtgagatctggattttttttttttttttttttttaaacagagtctcgctctttcgcccaggctggagggcagtgcacgatcttgtctcactgcaacctctgccccaccccgcctgggttcaagcgattctcttgcctcagcctcccaagtagctgggattacaggcgcctgccaccacgcctggttaattttttgtatttttagtagagacggggtttcgccatgttggctaggctggtctcgaactcctgacctcaggtgatccacccgcctcggcctcccaaagtgctgggattacaggcacgagccaccgcgcccggtcaagatttggattttttatttaacaaacacctacataacacttgttatgtgctaggcactattctaagagttatagaaatattaactctgtcgtgggtgtgactggccagtggtgcaggtgctaaagaaatttacggagacagtcacaggtaacgaaaggcagatttattagagaatatatgaaaatatgttgcaaggatgcaatgggcagcactgcagaggagctgtctgcaaagaggcaggggctggagggaagttttatagggtcatgctggaggcgggtaggtgcagaaagaggtcatgctgctggggccactgtgtggaaggtgtgccctctggttgtttgtgttcattgttcttccccacctggggcccacctggcccctttctcattgttgcttattctcaggactccacatcccaccaccgtaacacccctcagaacaccaatgacaaatctttgacactggggctgaggtctcatcttccaactgcttcctgctgattaggggtgtggagttgaccccacctatggttgttggtctgtcaagagaccctgtgggtcattgtcccagattgtgggacttaggatattgaatcttgctggaggaagggactcatcacagagtgggagtatgtcaaggcaaaactggtgaccagccgaatccaggggagactcataaaggtagcaggcatcactggggagagactgatatcccatttacgcattacttgaaagtgaaactgctgaattctagaagataaaagtttgtttcttaagccagttactgaaaaggcaaacaaacaaacaaacaaaccccacaaccatttgcagtgtgactgtttttccttattggaagcccatttagttagcctggaagttaaactcaatgaaaaagtgtttaaatgtaattagacacaagaagagtgtattcagggttatgagtatagcaggtgaatacataactcttaggaaaagcgtgaaaagtttttttttttacattgagaatttagacatattttttaaaagccaagcgtacagaattaagttatattagaggaaaacattgcttaatttttttgattttcaagatgaaatattttagcattaggccataataacagaattggaggaaaaagttacaggagctgacaaaaaatgaaggagagagttattatctttggcattctccgggaagaaaaagctgaaagcagcagggcacagcaaaagttgaactgagatattattctgtgaagctttaacttcttacagttttattaagaccagattaatatcttaagaaaatcttgtttttaacataggggaccaatgttagactatcctaaataattccctttcagttataaccaacttaaacacatagaaaattcctttcataacttctcctttgcgaaccttctcactacttgcacagaccatttatgacatggactttctgacttggacatcagggctttctgacttgtcctaaacacccctttcttaaacaacaggtcattttactttaggacaaaaatttgtcatacaagatcctttcttggctgggcgtggtggctcatgcctgtaatcccagcaatttgggaggccgaggcaggcggatgacttgaggtcaggagttcaagaccagcctggccaacataacatggtgaaaccctgtctctactaaaaatacaaaaattagctgggtgtggtggttggcacctgtaatcccagctactccggaggctgaggcaggagaatcacttgaacctgggaggcggaggttgcagtgagctgagatcacaccactgcactccagcctaggcagacttggtgtcaaaaaaaaaaatcctttctcatataaaatttttatttaaaaccttccttaccggccggatgcagtggctcacacctgtaattccagcactttgggaggccgaggtgggtggatcggtggatcacgaggtcaggagttcgagaccagcctggccaacatggtgaaaccctgtctatactaaaaacacaaaagaattagctgggcatggtggcaggtgcttgtagtcccagctactcggggggctgaggcaggagaatcgcttgaacccgggaggtggaggttgcagtgagttgagatcacaccacggcactccagcctgggcaacagagcaagactccatctcaaaaaaaaaaaaaatagccgggcatggtggcatgcgcctgtaaatcccagctactctggtggctgaggtgggagaattgcttgaacctgggaggcagagattgcagtgagagatcacgccactgcactcagcccgggcaacagaaccaatatttctggctttggaaccttctactaaaggtaacctcctatgtgaaattaagaagccttggccaggcgtggtggctcacgcctgtaatcccagcactttgggaggccgaggtgggcggatcacaaggtcaagagatcgagaccatcctgaccaacatggtgaaaccccgtctctactaaaaatacaaaacttagcagggcgtggtggtgctcgtctgtagtcccagctactcaggaggctgaggcaggagaatcgcttgaacctgggaggtggaggttgtagtgagccaagatcacaccactgtactccagccttgcgacagagcgagactctgcctcaaaaaaataaaaaggaagccttaactgaggggatgatttaaacatggacacatgaggtgtctccaaagagatggcaagcaatttataagatctagaactgcccgaaaggtaactcagagaaaagaaaatttcaagacaggaaataagaagctgtccatggagggaaaaataatcaatacatggcaaaagtaccacaagtattaaaccacaaaggactgactttcaaagccaggaattgaacccaggcgccattgtgatagggcaaagccttagcaactgacctacagcacaaggtgactactgttgttttaccatgagtttagagcattttcaagtttgcaaaaggttttaactgctcaagagaattttctaagactagccatgttactattatgcatccttcttttaatttaaccattttcttttcatggtgcactcaattccaatagtgactcaatctaaataaaagtccagatagtaattttccaggtttttaccacataagcaaaaggtatttccagaaaggggtagagggggcatctccatgataggcagcattttaactcaaaagggaagtttataatacttgccacctccagagttgcccttggttttgttttgttgatgactcatgtttgatctggaagctagccaaagcagaaagcccccattcagcttaaggcctgatgatcatcaggggttgggattatgtcccagggaccctttggccctccagggcagtcccatttccagtggccgagcttgtggcagagggggcaagccatgcgggggtttttcgtcattcatgccatagggccagtttgccttccagtggcctgggcttctgcactgatggcagttatctggaggagtatccttagggcagcctggaatggaggctgggggcttgcaaagcagccaacagttgagcctgcttcttgtccctgcatttttctttctccttagccctgtccttatcctgctcttggttataaaagactgaggagactgatttgaggttttctgcataggggccatgctgtattacaaaagaaaattcgactttttttttttttttaatctgagggttacatttgtctcagcgttttgggatgcaactcataggtgagtctgacggaatagaggaggtttgtcccatggtgggactggaaaacgatgagctgccggggactaacgtctgctgcagacacgaaccacactctctcgccgcccccacccccctgccccaccaggaagagggctcaactcacatctgctgagggattccagtgcactttcttttcttttcttttgagatggaatctcgctttgtcgcccaggctggagtgcagtggtgggatctcggctcactgcaacctccgcctcccaggttcaagcgattctcctgtgtcagcctcccaggtagctgggattacaggcatgcaccactacgtccagctaattttttgtatttttagtagagatggggtttcgccatgttggccaggctggtcttgaactcctgacctcaggtgatccacccacctcggcctcccaaagtgctgggattacaggcatgagccaccgtgcccggcctcaagtgcactctctaaaggggcatcccacctattagaaaggacatctcagcgctggggccttacgctggatggttagccccggtacaaggaaaaagggtaaaggaagaactcagcctggtcccatcccaggagagaggaccagaatggggagactcactgctctgaggctgcttgctatcacctaatttgggaacgtccagagcaggaggtctggctgtttttgcaggactatttagagtaagaaagaggggctctgagctccccaaaacatatgtgccaattgcactacatagggattgcagaccttttcgccagaagagataggagagggccttcttcccttctaggcaaggcagccaaacctgttcacacccgctggccttgaggccacaccaggaaatggccctgaccagttgccatcaattgccagagggatactagaatttgtcctctggaagactgaaaagtaaagcaaattctgaagtctcacagaatcgtgggacagcagtctggtgtctttccaccaggaccttctggttccctggggagcagccccggccagggacttaaaattatctcagggttttgacactgtccaacgagaggttggaattggaggaaagggagaaagtaggggagaggcccatacgaactaccaaaatgttgcaggtgcagctggccagtggcgcaggtggtaaaggaattgaccaagacagttgtaggtaaagaaaggcagatttactagagaaggtatggaagtatgttgcaaggaggcaaagggcagcactgcagaggaggagctgtctgcaaagaggcaggggctggagggagctggagggggctgcatgtggaaacaagtcatgctgctggggccacatgtggaaggaggtctttgtgccctaggtctctcagaacaatttttcattgttcttccccacctggggcccctttctcattgtttcttacttatcttatcaggactccacaaactcttttaatcctcaccacttgaatggccctggggaagagaaggccattgcattgaaatgtaatagttctgaaattgctttcaaaattcagccagaaataataattttgcctgcctcttttcaattatcccatactaaacttgccaaggccaattatcattttattcctcactgtttatgctttctgcctgcagtatgagggatttgtaagtacttttagatagtttcctttaaattgcctgtatttttctcccagctagattagaaacaacaacctctgtttttgagcaacttaggtatctctttttatctcaaggtctcagcaacccttaaggccagccccacctcctactccctgctcaaaagaaattataatacattcttttgttcacaatagctactaaacaatcatttgttgaccacatgcatgcactgacctcaggagcttaacaatttaggagaacgcgaggagaataatgctactttggccatcatttctaggttttattaacatcattcttgcctgctagttttttttttttttttaacctttcatgtaaatcttttgggaaggtttggggtgtttgtggtttgtagatttgggtttgacttgtatttgacttgctcttgtggtaactaaaggttacaacgtagcttcaaggttgtcatgacaactggtaaaataaagagctgattatcacatgtttgttggttcccttttataggtgagggcctgggacagacgcagcagactgggatatgcaaagagaggagtagcctaattgtcaagtctagatctaacaaaagcagtgtcccaagatcatggcatatttccctggaactggaaggactgatcaagaaacacagctaggttggtataataatgtgtgcgtagaaatggggagaagtaaaaacaatttctttaatgttgtgtttgccattgtagcatatagaattcttgctgtttttgtattacttgttccttttgatattccaatttgtgtatgtactatgagtcctatttatatctttacaggtttggggttcctgacatgtagctgttcttttgtaaaagagagctccttctctttgataatagctgtaaacttattaccatctcatatatttagttatttcatattactccttttcttagaaacatagtcccttagtcactcttcccttgtcattttattatacctattttcttagtgttgttgtacttatttaaaaattagatacttgtaatgcttaggcaggatgaaattttgtctatttattcaaaatatacgtatgaaaccttactacctgccaagaatactagcaaaagttgaaaattaaaatgaacacaatggaggtaagattcccttgttcactggcctgcttcatatttttctgttattcagacaatttgttttttgactctgttctgtctttaatcactgccttctgcattcatcctgaatttactcagctttaaccaccatcttttataaacgttcaggtaccctgggaattttaacagtggcttttaggacatcttgatactagcctgaattctcctgctatctaattatgtgccattaatctctttggaattttatccaactgtaaaatagaaatgatttacctactttacaagataactatgaaagataggctatttaaacctgcatttattcataaaataatttcagaagtatttatcaagtgcttatgagtacagaaattcaaggagatattctgaggcatctcatttttttttttacttaaacagaagggcagaggaatcttggctttgccacttagtagttgcaacttgagtaaacccctctgggctttggtttcctcctgtgaaaaatgggcattgtgatggtgcctacctcaaagaattattgtaaactttaaatgcaatcacctatttaaagtgattaggacagtacctggcacatagtaagtgcccaacaaacggtagctattactaatctgtcttatataaggaatggagactccacatcatcctcatgtctgggatttaagtaatctaattctgcctaatatactcaagtttgtcttattctattcccagaatgaacaaagaatacatatttattaccttacatgtcataacttgtcacgaactatctcaagactgtcccattattttaagttcaccactgggtagctgagcagggttgatgattgaaccaatccagataagtatgtgaaaacattttgtaggccaggcgtggaggctcatacctgtaatcccagcactttgggaggccgaggcgggtggatcacctgaggtcgggagttcgagaccagcctgaccaacatggagaaaccccatctctactaaaaatacaaaattagctgggagtggtggcacatgcctgtaatcccagctactctggaggctgagtcaggagaatcgcttgaaccagggaggtggaggttgtggtgagccaagattgcgccattgcactccagcctgggcaacaagagcgaaactccgtctcaaaaaaaaaaaaatgttatccgtaaagtgctataccagtgttatgactattttaattaataactcccatttcactaggtttatttgccttgtctgccagttctctatatggttactaaaatgtgtggttttacaaaattattagcatggagttaagatttcagtactcagtgtggctcattaagtgatggtgaaaatttctaaaagagtagttcttaaaacgatatgagccatggcagcattcttagaatgtatgtagcttctaatactacctgaaatgaaaacactgatttgcattgatactaaattctgagatatttgtttttaaaaaagcctcactgctttaactcaaatctttgtaaattagctgaggtctttattttttatatgaatagctgtgaggagccagattatatataatgtaaaaatacacactgaggcaggcgcggtggctcacgcctgtaatcccagcactttgggaggacgaggcgggcggatcacctgaggtccaggagttcgagaccagcctggccaacatggtgaaaccccgtctctactaaaatacaaaaattaaccaggcgtggtggcgagcacctgtaatcccagctactcgggaggctgaggcaggagaatcgcttgaacctgggaggtggaggttgcagtgagccgagatcgcggccactgcactccagcctgagcaacaagagcgaaattccatctcaaaaaaaaaaaaacaaaaaactgtacgattatggtttaaaaaagaaagaaagaaaccacactgaaaacagtaattcgtttgccaaatgagctcagttaggttagcaccttagcaagaccctttgggaccaagtggcctctaagcacttaggtagcagtatctttttttttttttttttttcagacttttgcttttctaaaattacaaaggtgtagtgtgtctgctgttacaggatggaaaaatgcatcataggaggttagaagcttgttggcctcagtcataaagggataagaaaaatgagaattaggcatagggcaggaaggacctcactcctcccaacgctttcatttctaaataatgcttaaggaaaccatgccagggttagtaaaagagtagaggcacaaccacggtaagtgggcattggggaaagaggaaggagggcaggacatggggataaagcggtttcttaactgcgcgtgcgcccctggcaaagctgactaaggcgcctgaagtgacgtcattgcctgcatcacaacaggcgtcgtccggctgatagcttatcgcaggctctgaggggcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttgggtgagccgggttgagatactggaggaggcaagcggtggggaggaggtgttcgggaaagtgatttcctatagaattcccgtccctttatttgttgaggttctgcaggtaactcccttgttcctggtgtccggagatcccaccctcaaccttgggtgggggtagtgggacgggctgacctgagggggagcgcgcacccaccctgaggttgacaaacatctgaatctgaacatcctcccctgatagtccactcggacccgaaagtagcagccagttggtgtggagcacggcttttttctaacttcaacccatttcttacccactcctttgaagaaacttagtatcctcccccactcacctccagatcttctgccatgactgtaatatttgtcatttcagctgctttgtcacctctgaccttcacctccagccgcttgaatggaaatggttgtcaagcaaataagctttggacttttttacatttttttttttgtctttttttgagacggagtcttgctctgtcgcccaggctggagtgcattggcacgatctcagcttactgtaacctccgcctcctggcttcaagcaattctcatgcctcagcctccctagtagctaggattacaggcgcccaccaccacacctggtaattttttgtatttttattttttatttatttgtttatttatttttgagacggagtctcactctgtcgcccaggctggagtgcagtggcgtgatctcggctcactgcaagctccacctcccgggttcacgccattctcctgactcagcctcccaagtagctgggactacaggcgcccaccaacactcccggctaattttttgtatttttagtagagacagggtttcaccgtgttagtcaggatggtcttgatctcctgacctcgtgatccgcccgcctcggcctcccaaagtgctgggattacaggcgtaagccaccgtgcccggcctaattttttgtatttttagtagagacagggtttcaccatgttggccaggctggtctcgaactcctggcctcaggggatccgcctgcctcagcctcccaaagtgctggtattacagacgtgagccactgctcctggcctacacctattttttattggagcagaaagttttggtaccacagaagcttgatctcctaaattacacattctcactgggtgatacttcccccaaggggaagagaaaatagttcttgggggagtgtgaaaaatttttactctttttatgtataaagcgcagatatacatacagtatgtacacagatatatactatatatgtgttattaaaatttcacgaagggggagcaattaggggaaaaatgtctaaaaaggctttttagagggtcaataatgaaaaaaggatttagaaacactacactaaatgatggttaactgtatttctgaagatctgggattactaaatcttgtttccttttttttttttttttaagacggagtctcactgtgtcgcccaggctggagtgcagtggcatgatctcggctcactgcaacctctgcctcccgggttcaagcgattctcctgcctcagactcccgagtagctgggacttcaggcacccgccaccacgcccacctaattttttgtatttttagtagagacggggtttcaccgtgttagccaggatggtcttgatctcctgaccttgtgatccgcccaccttggcctcccaaagtgttgggattacaggcgtgagccactgcgcctggcctaaatcttacttcttaaactagacttttaaaatgagatgttggatttcacatttcagtattataaggttttctagataccgtaaaaatgtctgaaaaatgcattcactacatatgttactaactttgctcttcaccttttgttgcatcatactaattgatagttgtaattcacagtaccatagactatcaggaagggattcagagaccagctttaccctccttgtttaacatatgaggaaactgaggcccataaatctccaaaatgacgtttagtggcagagccagtactaggaagctctgtttcctgactcctaaactactgttctggccactactaaccaatacctaagctgattaactctaaatgaatgcagcttttgggtcatttgaggtaggagagaatatattgttcacaaaatgaaaagcaaactaagattgaccaaaaaaaaatacattacctttttaaaataggcaggtagaaaaacatagaagggggactctgcatgttgtgctgagaacaagaacattttattcactcaggattttgctctaattctgttgtgggaaaaaggaattatgggacccactctactagtagaagagagcagtagggagaatgttggatttattgaagacaatataaaaagaagaaataggttgcaaatagacgatggaagatgtgtactggaaggaacctgtggatcctctttaatgtattaaatacaccagagaaggagtggacccttccctaatccttaaagccctggaaacagagagatctcagttatcccttcataccttgctttgttctgcaaaggatttttttgttttgtttgtttgttttttgcttatattagagcatagctacagtgttacattccatagcttaagatcctgatgcatgaagtaaaatttgtacagaaagataagggtcactagcatatttctgtagtaggagtttaaagatacagaaaccacaaagtggacggagtccagggactctagtctgtcagaaagaagtaacataggaatgatgtgtgacatccctgagattaggggacttgcccagatgatctgagggcatattttgtgctgttgtagaaaatgtagggcatagtcagagaagttattctgaagcaagaaaaatttagagtaggattacactgagccttagttgaattcattttcacctcagttctcatttgcatatgtatactgctcacttttctccctttttttttccttccttggccctctaatacttgagtacttcctctttctaaactatacctggccagtaaagcattcttttcagaaaggtgaaagtcactagcatatttctttagtaggaattaaagatatagaaaccacaaagtggacagagttcagagactccagtccctcagaaagaagtaacataggaatgatgtgtgacatgcctgaggtcagggaacttgcccaaatgatctgaggggatgttttgtgctgttgtagaaaatatttagcttgctaaacattgttgcacctctttcaagtaattttcgaactttgcttgatgtttcttctatataaagaccctcttgcaccagcatttgcagaattaaattccttaggtttgtttctttcatatcaactctttaatacagtattactgttttaaagaagtatctgcactgttttatgtatatcttgaactaataaaaattccaacgtcaaaagttttgaacctcttggttctttatactctttatctctgtaattggctgactttattactggtgtcaataactatacttaaagctaggagttttttcttctctttctctgacccttattcaaagactcagagattaggttcttgtattcctgccagtgcctccctaccttaaaaacctctaccttgaccctgcatttaaactgttactgcctcaattcttttttttttttttcctgagatggagtcttgaggctggagtgcagtggttcaatctcggctcactgcaacctctgcctcctgggctcaagcgattctcctgcctcagcctccgagtagctgggactacaggcatgcaccaccacgccaggctaatttttgtatttttagtagagacgggtttcactatgttggccaggctaatttttgtatttttagtagagatgggtttcactatgttggccaggctagtcttgaacccttgaccttgtgatccacccaccttggcctcccaaagtgctgggattacaggcgtgagccaccactcctgaccctcaattctatttgaaaggcaaattactgccccagagccaaatgcagcccaccacctggatttgcaaataaaattttattggaatggaaccatccccatttgtttagttgttatctatggctactttcccactgcagtggcagaactgaggagttgcaacagatactgtatggcccacaaatcctaaaatatttactctctggcccttcgcagaaaaagtttgcccatcttctggtttattgaacttttacgaacgtggaagaatagcagccatgagaaatgattgctttgggaatataagtgacataaatctattatagtttagacagagctgtttattgatcatttgatgtggaacattgaacatccatccagttatactacttctgctttttccgagttaaaagtagcacttagttcagatatcagctagggttttataaattcatgttgaatgatgcataccagttgaagtatatattgcctgaattctttctttcagttatagtcttactaaaattggcaaacaaatttagggtagactatatcattgtcagccctaagtattaagccccctacacatgtacacaaaaaagaatggaaagaaatagcccattagtgtccctccaattttcttatgagtgactgccagaacatattcctattctcacaaagaaaatgactgggaaagtaagtagaattagatacatccatataccttccattcacaaaatattaagttactgcctgttatatgcaaattatgatgttgcaaagatgtatctcagggctcaataagctttaatagggaatataaatactagaaggacttaaatatatggtagagtaagataagtgcgtagggagcttaagataagtgcgtagggagctaaataaagtgctaggggaattcaaagaaggaagggagaaattacagcgggactggtgagggagaaggaaaagtttatgaagaagttggcatttgagatgggccttcatggattgataggatacaccctggaaaagagggggaacaatggttgggatagtattttaagtattatatgtagaacagacttgaaggcagaaaagcatagatgtgttccagagaactgaatggtccactttgcctgaacccctgactcccagatgttcatctgctgatcagtgctgatctcaggtgaagtttttaccaatccgtgcttttaaaagagttaagtacagcataattaaagatgtcattatgtagttgttaattatctttcctgggcaggactgtactgtactctgagattgttattctcttattttcttaataccaaagggtcattttacaaatgaaatgatggtattggtcaatggtgggatttaaaaaaaaatgacttggcaaaagaaaaaggtggcaactgtatgtttctgcctagattttgttttgaaattgtactagtccttgaaattgaagagtctggagccaaaccgtggatggctttgaatgtcatagtaaagaacgtaactgaatttgacaggcactgaagagagtcactgaaagttgtgagcaaactgttctttaggaagatgcccctggtagtctgttagcctagagaagggaaagaagagaggcgaggagcccaattagactatgcagtctgtggaaaaggaaaaagaccttgaattggtttttggcaaggagcctgacaagaatcaggtggttatcagagagcgagtatagaggtaaaatctaaaatactggcagttgattggatataggcagctaaaacaaaagtattacagatgatttctcacattggaggaacctggatgaagggtacatgtgaaccatctgtattctttttgcaacttcttgtgagtcttaaaccgtttcaaaataaaaagttataataaaaaggaaaagatgccgggcaccgctgggatctgtagtcctagctacttgagaggctgaggcaggagcatcgttgagcctaggagtttgagggcagcctaggcaatatacagcgggacgacatctctgaaaaaacaatgaaatgatgatttcttcaggattacaaggtcaaataggaccaagttcacttgagtgggcaaccatcaaagctgaggacactgacctgtcttcagtgggcatcagctgcacaacttcagtccattgttatcatgggaatgtggcccagtgttgcaaaatcttgcaacttttcaatagaagccagaacgttggaatctgggtgttttttttttttttaatgtgaaatctttcagtgtgcaaaacaaattcaaaaacatttttaacactgtaggccaaaccaaacacatctgtgaaaaatctgagttccatcaacccctgctattggttattcctcgtattcatgtgaaactttgggagttgagagggaattggtatttgcacgttgtatctctgaccataaatttaaatcatttacaggtttacactgaaaatgatgtatttccaagttcacaataaattatattcattctccgtagcatgattaggagtaaagtagtgtgcttgagaattccttaccttatatggagacttgtttaggcccagccaaccaaggctgtatgtgtgtgtgtgttttaatttctacctttgcacagcttgcctttacccttgctgtttaggtatttgaaatctttaaaagaattttgtggccgggcatggtggatcacgcctgtaatcccagcactttggtgggccaaggcgggtggatcacctgaggtcaggagttcaagaccagcctggccaacatggtgaaacctcgtctctactaaaaatacaaaaattagctgggcatggtggtgcgtgcctgtaatcccagctactaggggaggctgaggtaggaggattgcttgaacctgggaggcagaggttgcagtgagctgagatcgtgccactgcactccagcctgggcaacagaacagagcgagactccgtctcaaaaaaaaaaaaaaaaagaattttgtaatggattttatataacacatgtttttgtttttctttttagttttaattcacaggtgttgcaagctgacatgttaagaattaggacaaacagaacaacatttaggaatcgacgctctctggtaaggaaatgcttatagtggcctccctgtctaagacttgtgcttattggtctcaaccaatggtcttcaaacttgagcattcacagggagggcttattaaaacacagatggccagcgggagtctcacccccagggtttctgattaagtagatgggggtggagcatgagaatttgcatttctaacaagttcccactttgagaaacactgctctaaacattactgaaggaaaaataaacacattgactacagttatgattgctgcagctgcaacagaattaatttttaaatcccatatggatttaacatcgagattttatgtataagaccatctggtttcccttttttttttttaaagaaaattctaactttgagaggaaaatttgcagactctcctaaaagtaattttcaggcttttagacttttatctcacatttatcttgaattgtaaataagatttgcttttcatggtattatcatgcaatctctaaattataactcttttctactaattatcctgtaaacatagggaatatacttgtagatcagtaagccaaggtgaatacatgattcattatatgattttattgaggtgaaattcacataacattcaattaactgttttaaaatatacaattcaatggcatttagtgtattcacaatgttgttcaaccagtacctctctctagtttctaaagtgcatacatatccttgtcttgttcctcatcattgaatatgattttagctgtgagtttttggtaaatgtcctttatcatgttaaggaaatgtccttctactcctacttgctgagtatttttctttttcttttctttttttttttcttttttttgagacagagtctcactttgtcacccaggctggagtgcagtgacatgatctcggctcactgcaacctctacctcctgggttcaagctattcttctggtcagcctcccaagtagctgggactacaggcgtgcaccaccatgcccagctaatttttttgtatttttagtagagacaggatttcaccatgttggccaggctggtctcgaactcttgacctcaagtgatctgcccacctcggcatcccaaagtgctgggattacaggtgtgagccattgaatccagccttgctgagtatttttatcatgaaagtgtgttgaattatttcaagtgctttttctgcatctcttgggatgatcatgtgtttccccaccttgttcaattaatatggtatattacattgatttttttccatgttgaattacccttgcattcctgggataaatctttttgtatctgtattcataagagatattgacctgttgttttcttgtggtatcttttgctagctttggtatcagagtaatgctggcgtcatagaatgtattaggaggtactcctttgtcttctacttttgtaagagcttgagtaggattttatgttgattcttgttttttgtttgtttgtttttgtttttgtctttttgagatggagttttgctctttttgcccagctggagtgcagtggcacgatcttggctcactgcaatctctgcctcccgggttcaggcgattctcctgcctcagcctcctgagtagctgggattacaggcacccgccaccacgcccagctaattttttgtacttttagtagagacggggtttcatcatgttggccaggctagtctcaaactcctgacctcaggtgatccacccgccttggcctcccaaagtgcagggattacaggtgtgagccactgtgcctggcctggtgttgattctttaaatgtttagtagagttcagcattgaaaccatctggtcctggacatttctttgttgggaagtttttgattacagactctatctcttgttataggtttgttgagattttctatttcttgaatcagtttggtaatttatgtgttatgtgttatgtattatagatttctcttataatatgatttgtaatgtgatagaatctctagaatacattttagtgaaatgttatagcttgataccaatttaaaaatattgctcgtggccaggcgtggtggcttacacctgtaatcccaacactttgggaggccaaggcgggaggatcacctgaggtcaggagttcaagaccagcctggccaacatggtgaaaccccatctctaccaaaaatacaaaattagttggatgtggtggtgcatgcctgtaatcccagctactggggaggctgaggcaggagaatcgcttcaacccgggagttggaggttgtgagccaagatcgcgccactgcactccagcctggtgacagagtgagactttctctcaaaacaaacaaacaaacaaacaaaaacaaaaaaaaatattgcttgctaatcttaaaactggacattttcttcttcatagaatgatattcaatattgttcccacaaatgcattaattttatagtgggagaaattataactgttcattaaataaatatttcttctttctactcatttactcatccattcaacgatatttgttgagcacctgcttgcctctcaaagccttccatacctatccagtcttctactcaacgaagccaacatagtggtttaggacccactatgtattaggccctgatctagttgccagggttgatctaactgagtttggggaggagataacatcttagttgagatcttactgatgtgagagggttagctagtttgggatattggtggcaggggtagacaatattcctggtagaaaacagcatgcttgaagtcctggaaaaggaagtgtggtgtatagataaaagagtgtgtataaaatttgaaagaagtgcattttagctacagtgaaagcaaagatacagtggtgagagatgtggttgaagaagtagactagtgcaatatcttgtagggccttcaagtcatgttaagtattttgcactttatcctagggtcagtgagaagccattgaagagttttgagccaatgattgacatgatcagatttgttaaaagattgccctggctgcagagtggaaagtggattggaagagggcaaacgtatatgcaagaagatcagataggctactgcaatcaccctggcaaagagctgatggtagcttggactagtgtgatggtagtggaaatagagaaaagttccagattcaggagaaatttcaaagatggaatcaatggacggtgggaaacagtggaggcaaacctgactcctaggtctctagcttgggcagctgatgggatggtagtgacacagaataagaagggaccattgcaagaagagtagatttacaaaggaggatgagtttagctttgtacatgttacattggaggttctcttggacctgtaaactagtgatgttcgatgtactagtttgaagctcaggagtgagagctggactagagataaccatttgggaatcattggtagattgttatttaaaactgtgggaattaatgatatgacctacaaagagagtatagaaagagcagagaagaagttgcaggacaaaactttaaaaatcaccaacacttaaaaatcagtcagaagaagagtgatggactaagtagagaggcaggaggaggcttcagaagagagtagtaccatgaaaaaacaaggaaaagtagtaagtcatatgctgtcaagccgtcaaacagactgaaaagtgtcctttgaattaccaaaacagatattactcatgaattcttatatttgaaagcactttcagtagaaggaggagtggggtgagattaagccagatttgattttgaagaataactgagagccaaggacctataaatggcactgtacatccaggctcagttatttgggaggcaaatccctcatctgtaaaatgggaatgtaaaagtaactgctttgtaggtttgttgtggattaccttggtcagtatgaagcactcagcacagcactggcacatactaaatgctcaataaatatgtgggtttttttaaatcagtaatagtacatatagtcagcaaccggtgcacctggctttttaaaaattataattttaaaatctttttttctagtaccaaatacttaaaggatattttttctttctttttttttttttttttttttttatttgagacagatctcttgcccaggctggagtgcagtgacgtgatctcggctcactgcaaccttcgcctcctgggttcaagcgattcttctgcctcagcctcctgagtagctgggactacaggcacgcgccaccacacctggctaatgttcgtatttttagtagagatggggtttcaccatattggccaggctggtctcaaactcctgacctcgtgatccgcctgcctcggcctcccaaagtactgggattacaggcataagccactgtgcccggcgattcttggcattttaaaaatgcataacattccttaggaattctaggctcctaatttgcataacgttcagtttaatataatgtatatttaaaataaaccatcttatataacagattgtgtttggcagaattgaagtcattttaacttattggatgatggggatttcaaggcttgttggtttagcttgctatagcaatactatgcatatgcttttattgtgtctaagtatcacttcattattattataagacataagtaagtatatacttacctttagtatagaactgctgaattttctaggagaatgacatgatgaattagaatgcttttggcaaaagcagtaaaatccaattagaagagacttaaacagcctgggcgaggtgactcaggcctgtaatcccagcactttgggaggccaaggtgggcggatcacctgaggtcgggagttcaagaccaacctggccaacatggtgaaaccatgtctctcctaaaaatacaaaaattagccgggcatggtggcatgcgcctgtaatcccagctactcaggaggctgagacaggaaaatcgcttgaacccgggaagtgaagtttgcagtgagccgagatcacgccactgcactccaacctgggtgacagagtaagactctgtctcaaaaacaaaaacaaaagcaaacaaacaaacaaaaaacagagagacttaaacaataaggagcaataaggagcattattatctcaaataataagaagccccaagaaaaggaggttctaggccgggttagttcagtgggccaatgacatcatcagagacccaggttccttctatctttccaccctaccatcttcagcagccacagttaattatgtaactagtaattagacccagggttcaaaatcaatggatagcaagctcttatatatatttaaagatgtcgagaaggatatctatcaacctatctttagtagatatctctggagcatgacattataggcagaattttatttttactttatgcatttctatactagttggatgtttttcacaaagcatgagcaatacaggtgttttcatttctagtagatattatattacaaaatagaaacattattcttgaaaaaatacaaatattattgaatgatatcataaactataagtttaatggttatgtcctatactggtctatccttaaaattggtgccacaggcatctaaagtagccaaattcatagacacagaaggtagaatggtggttgctaggggctgggaggaggagggaatggggagttgttgtttaaagggtacagttttgcaagggtacaattttaaagggtttcagttttgcacgatgaaaagagttttggagattggctgcacaacagtgggaatgtacctaacactgctgaactgtatacttcaaaatggttaagatggtaagtttcacgttagtgtattttaccacaattttaaaaattggtgctgcttttcatgtatttaaatatgggtaaaacaggctgggcacagtagctcacgcctgtaatcccagcactttcagaggccgaggcaggcggattacttgagttcaggagtttgagattagcctggtcaacatagtgaaaccccgtctctactaaaaatacgaaaaattagccaggtctggtggcacgcgcctgtaatcccagttacttgggaggctgaggcaggagaatctcttgaacccggggagtgaagcttgcagtgagctgagatcccgccactgcactccagcctgggcgacagagacagactccatatgaaaaaaatatatatatacacatatatatgtatatatatatattttatattatatgtgtgtgtgtgtgtatatatatatatatatgggtgtgtgtgtgtatacatacgtatataggtaaaaccgtgttttagaaacaaatcactgtgacagagggcattgaagagccatgggtttttgtgttgaatgaacacaaaaataaagatgcgtattttccaagcattgtaaaaaaaaaaaaaaaaaaaaaaactgttccctcacaattattttgtttaattaagtgcaaatattttcttcacttctctcaggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcattatttctattttaatactttgtttcatgtggaaaaattatctaaggtaattcctttgcaaacgccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctact

SEQ ID NO: 3746 - DNA, 9065 bp, human
aatagagaaacaatgtctgaatggtgagtactgtactttgaattactattctgataatttgtatacttaattatatcttttctttcagataggcaaactgcagttttgatttcttttgtaggaagctacaaagtgagatacagataagtcactcttgggaagaaggcttgaaactggtatgatattataacttcagttttgtagaaaatttcaaatttttactgacttacagtgtcggcatatctagttttgctgtaatttctagaaatctaagctctattttgaaacaaaaattgtatctgttgcataaataatttttgagtgctctttttaatttttttttttgagacaaggtctcactatgttgtccaggctggtcttgaactcctgagctcaatggatcgtcctgcctcaacctcccaaaatgctaggattacaggcttgagccattgcgcctagcccttgattgctcttcagaaatacttcatgatttactcataaaaatagctatcattatttgaaagtggggttcaaagtaaacagttttgtgacacaaaaccatagctattgtggaccagtttcttctctgtcctagtaggcataataaaagttcagttgcactagttaaagtgcttagataacaaaacaataaatgatttcactcccttctccataatttatgaactatatattaggagtcttaaaccacagacaatagactctctagaaaattattgcatttttatgcctgtgtgttagtccgttctcacattgctataaggaaatacccaagactgggtaatttacaaaggaaagaggtttaattgactcacagttctgcatggctggggaggcctcaggaaacttacgattatggcagaaggcacctcttcacagggcggcaggagatagaatgagtgccagcaggggaaattccagatgcttataaagccgtcaaatctcgtgagaactcactcactaccacgagaacagcattggggaatttgcccccatgattctattacctcccaccaggttccttccacaacacgtggggattatggggattacagttcaagatgagatttgagtggggacacagccacaccattatcagcctgtaacacattctcccactaacattttaatataaaacctttaatttaaacatacttagaatttagtttcatctcttgttaacatttttaaatgtctgtgtgcacactgtggttacctagttgtggtagctgaatgatatttagtgttcttttctatggacatcccagatagtgacaaaacaagtactgagctgaaaattgaataggagagattctaactaatgtcaatcttcagatttgggaattatttgatatggaaatggatcatcagcagaagcaatggcattttattttcctttgagccctgagtaccttacatgagcagttatccctgattttggagtaggtccaggagaatgagtaggtcatctctggagcctgtcactttttgtgttttggtgctaatacaattgatcgatactgctggagtcctttaactggcccaattctaattactttaggtattggcatggatgagtaagagaatcgtaagtgtgttaggaagaggaagggcacatgtaatacacacttggcttgttttagaaagaaaagggcagattttaaaatcctgaattatgaagtactgattttgtctatgtaaaatctagagacaatttccataaatgtagttattcctgctgtctcatttgcttctaagttctagccaaaacctttttggtcctttcctggatgtagtattatagttttcaataacaaagcacaggtcaaagccaaagagaagagcttaaatttaggatttgtgtttatagtgttgagtactcacattctaggactttctggcatgctgggaagcccctcaatcaccatatagccctcatccccaaaagggaaaagggtgcctttgcttattgaagtgaattttgggttccctgattgctttaggatggcgagagctcttcaccatggtgcagccagtgactcagtagtaaggactcacttccctgtgcaacaggtatctcaagtatttgattaataagcaattggtgctacaattgtacactgctttctgcttacacagaatgacaatggcttacagaaatcatcctctctaaagtgcattgatttaactccagtatcctcaatggcttcttccatcaagaagactgggaaggtaagaaaggagtacctaaaagtctatgtctcttgaaatagttaggaaatatttaggaacattaatggtcaccaaaacaaatattttgggggatatattttgtcacagtacatctgattctaactaacatttttcccttctttttcatttcttcaagtattacttacatgtaataaaattcaccaactttaaagcatagggttagattaattttggtaattgtgtacaatcctgtagccacaaccataatcaagatattgaacagttcccacactcaaaacaatttcctaatgatcttttgtaccccagtctccctccctaccatccctgcccctccctaggaaaccaatgatctgctttccgagaaaagtggcggttttaaaacctctgttccaatttgattttagcagtgtttctctccatcattacaaacttgtgtgagttgcactggttcgccttcaagtcctattcccagtcctatgcaacaatacatcatgtaagtttatgttatatgaaaataccaaattgcttataaaataagaattatagaaacctaaaagaaattatagctccaagttttgtgccaaccaaagaagtgacttctttttagggaaattaaaatgtcattgtttcggctgggcacggtggctcctgcctgtaatcccagcactttgggaggccgaggcgggtggatcacctgaggtaggaagttcaagaccagcctgagcaacatggagaaaccccgtctctactaaaaatacaaaaatagccgggcatggtggtgcatgtctgtaatcccagctactcaggaggctgaggcaggagaatcgtttgaacccaggaggtggaggttgtggtgagctgagatcgtgccattgccctccagcctgggcaacaagagcaaaactccatctcaaaaaaaaaaaaaagtcactgtttcagtttatcattttgtatattgaaaaagtcaggtgactaagaacataagaagaatttagtaattccttcaccctgctaatacataatctttctctaaccaagtttgttaataaggatcagagctatctctagaactttaaacaacttcatccgtgattctcaccttcattcaaggcaagtcccagccaggaatgtaggtttttgtagactctaggattcaaaatcctgaatccttgagaattagaagatagtttgctcctaaggcattccagtttttacccatatgtaaagaaaagcagtaaaatggccgagcatggtggctcacacctgtaatcccaacacttttggaggccaaggcaggcagatcacctaaggtcaggagttcgagaccagcctggccaacatggtgaaaccctgtgtctactaaaaaaatacaaaattagccgagtgtggtggtgcatgcctgtaatcccagctacttgggaggctgaggcaggagaatcacttgaacccaggaggcggaggctgcagtgagcttaaatcacgccactgcactccagcctcggtgacaagagccaaactgcatctcagaaaaaaagtaaaaataaaaacaaagaaaagcagtaaaatgatgtaatatcctacacagagtcccgtttttgtgtatgtccttagatctgttataatgaaatagtcattgttgattttgttaaaaaaaatttcttataatgatcatgatgattttattttagaagaagtcaaaatcctaccaacattattagaccaagtatccttggaccattaaaaagaaaaggtacttttatctaacagtagaagtaaatataactttaagttattttataaaatatctaaaatcaaatgttatacaaaaatgtatttttaaaggctttatttatttaaaatatatttaataagctattagaggcctttcattttatgcaactagaaatatgtataaggacattttgaaaactctaaaatgctatataaatgtgaattgagaaatttaattccaatttagttggctattaggattttcaatataattcaccaaggtagctatcttcattactttctaaaacaatgtagagaataaatgaatgaatgaacagagtgagtcagtcatcaagtattttgctgaatgtcaacccctgcctcactgccacacacacacattgctatcatatgaataagttgacacaaattagatccacttacaacactaaaaatatatatgaaggtgtatgttctttggtgtttagtttctttatgggagttatttttggttaaatatatggaaagtgacccacctactcagtaataaaagggcagtggaaagaataaaagggcagtggaaagatgtcttttttaaaaactcctgcaatcctggatcccacttctcaatggtacctcactaaattatgctcttcttccttttttttttttttttttcttgagacagagtcttgctctgtcacccaggctggagtgcagtggcacaatcttggctcactgcaacctcttcctcccgggttcaagcgattctcctgcctcagcctcaccagtagctgggattacaggtgcctgccaccatgcccagctaatttttttgtatttttagtagagacagagtttcaccatgttggccaggctgttctcgaactcctgacctcaggtgatccacccacctcggcctcccaaagtgctgagattgcaagcataagcctgtatatttagtacaatttttgactacaatggggaggggaaatgggtgaataggaaaggagattaaacttaaaaatgtgtattgtgaaaaatctattaaggtaagaaagaggagtaagaagaataagaggagagaaactgaaatatgctttaatgttctttgtatattttcgattaattaatggcagtcttcctaacaacataactaactcagcatgtactttttgtattctaagattaagggctagataaattctggaaaatactcttttccaaagtaagcacattgttttatgaagatgcttcggttactaagcttaggggtcttttacctgtgctgtgaaattcgggctagtgttgaaaaaatattcaaatatatcagcagtttaagagctgttagaagtcaagggtcaattgagtatttaaaataaagtacgcttaaattgaggagtgttttaccagattaaaatagttctccttttgagacatgtatacataaataggttatcacatgaaaagtatctcgagttttcttagaatttatgattgaaaaattatttttatagatcaattttaacataaaagatgtagtttctgcccagtgtcttcggagatgtgacctgtctcacacttggttttcagctgctctgaaagacgactgccttattcctttgaggtgtccctgagggaactccaaagcgaattctgtatataccacctagtccatattttcagtcataccccaccctccaaagcatgccctgtacaaatgtgctgaaaattcatttggccatttttggccagatacaataacagataaacagaaattgaaatttattcatatattttggaatatgcatattcatttgggaaacaacaaactatgtcctatttggaccccattaatacaaatgaaatgtgggagaaaggtaccataaaaataaaagagaggtcctgaggcagggggcggggggaactaaaaagaatgatgattatgtgaagtgagatcaagattagagtctccaaagcatatgatgtcatattttatggtgagaagcagcagtgacttccattaggaataagcaagagcatgggccgggcacagtggctcatgcctgtaatcccagcactttgggaggccgaggcgggcggatgacttgaggtcaggaattcaagaccagcctggccaacatgacaaaaccctgtctctactaaaaatacaaaaattagccaagggtggtggtgtgtgcctgtaatcccagctactcaggagactgaggcaggagaatcgcctgaatccaggaggcggaagttgcagtgagccgagatcacaccactgcactccagcctggacaacagagtaagactctgtctggaaaaaaaaaaaaaaaggaataagcgagagcaaataagccttcacatcggaatactgcagaaattgggcagctataaatatcgtttgacaagtaatgctggttttagcaaagaaagatctaattttcttttatgaggaatatgttttgatttgtcatgttttcaatgttaaaccaaaaaagagagctgagtagtttttctgtagtgacataaatgtaatctggcaaggcacgggacaccagacttcttttaaactttatgagccatgattacacttctgtggaaggtctatgcaatatcttaatggtgaccttagggttttatcattcaaatagaagttatgggcttgaatgtcagttttgctcaggtccagaaatgattatcatatgaatgtgaaacactgtgcagattttaacatttacttcaaggcaaagattacaaaaatgcagttgttgttttttttgagattagatgttctaccttaatctctaaagatacaattattttgttcattgtgtgctgtaaaagaacttacctatttagttcattgtgtacatttagcaaaataaagatagcaacaacctaaagttttaaaataaggaatgacattaaactcattaaacagccttactacatagctatatcaaatcatcttgcaggccgggcacagtggctcacgcctgtaatcccagcattttgggaggccaaggtgggtggatcacctgaggccaggaatttgagaccagcctggccaacatggtgaaaccccgtctctactaaaaatataaaaaatagctgggcatggtggtttgcacctgtaatcccagctactctggaggctgaagcacgagaattgctggaacctgggaggtggaggttgaagtgagcccagatcatgccactgcactccagcctgggtgacagagcgacttcttcacaaaataataataataataataataatatcatcttatagaatttagttaataatataagaaaattataatcattgaaaacaaaaagtaaatctaaaaacattatatacggtacaaacccaattttatttaaaaaacaattgtgtatacaacatattcaaaaattactaaagaatggttatgtctggataatgattacttaaaattgttttctttgtgcttttctgtattttataaattaattgcagtgaataagtattacttttgcaattaaaataataataaacatgttaaataaaacatctaccttgatctgctgtattgtcataggtgaaatggcatttcaatatcaaccaaaaaagattttccaaggcacaaccaacatgctttcttctgatacttcccaactgtcagaaaataatgtgtagtgagtattaacatgagattttaaacattcattgatcatttttgcttcgttgttaagtctactttggctattgtacgtattcagaagtatggtacattattaactgttcttagaagttttaaaactaatattccaagtggatactataaacctgagttattttattttcttttttttctttttctgaggcagggtctcactctgtcacccaggctgggaatgcagtggcacaatcttggctcactgcaacctccacctcccaggctcaagcagtcctcccacctcagcctcctgagtagctgggaccacagtagctgtgcaccaccgcgcctggctaatttttgtattttttgtagagatggggtttttccatgttgcccaggctggtctcaaactcctgagctcaagcaatccgcttgccttggcctcctaaagtgctgggattacaggcgtgagtcacgtcacctggcagagtgtttttcttatgagatgtgtgtgacactaatatatggtggatacatttttagaagtgagattttggcattagattaagagatattagagaaatacataaaaatgcatccttggaaaaagtcatcttctgcccatcttccttggatttttgtctaccttgttgggttgagagtattattgaaaagcatgcctaagaaagcatgtcttaatgataaaaataggaaatactggaatagatttctttctttttttttttttgttttgttttagacggagtctcgctctgtctcccaggctggagtgcagtggcaccatctcggcttactgcaacctctacctcctgggttcaaacaattctcctgcctcagcctcctgagtagctgggactacaggcgtgtgccaccacacctggctaatttttgtatttttagtatagatggggtttcaccttattggtcaggccggtcttgaactcctgacctcgtgatccacctgccttggccttgcaaagtgcttggattacaggcataagccaccacacctggccatggatttctatttattgttactggtggtttcattgtatgactcttaaaaaactttgcttgtgacaagtgccagttgttagtcatgtattttgcattcatgtgtagacaaagcagagtatacagagagatctcttgagttctgctatcaatgagtggcattttcttcttctagtctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagc

SEQ ID NO: 3747 - DNA, 15010 bp, human
gcccctctgcctggctgcccagtctggaaagtgaggagcgtctctgcccggccgccatcccatctaggaagtgaggagcgcctcttcccggccgccatcccatctaggaagtgaggagcgtctctgccccgctgccccgtctgggatgtgaggagcgcctctgcccggccgcgaccccgtctgggaggtgaggagcatctctgcccggccgccccgtctgagaagtgaggagaccctccgcctggcaaccgccccgtctgagaagtgaggagcccctccgcccagcagccgccccgtctgagaagtgaggagcccctccgcccggcagccacaccgtctgggaagtgaggagcgtctctgcccggcagccaccccgtccgggagggaggtgggggtcagcccccgccaggccagccgccccatccgggaggtgaggggtgcctctgcccagccgcccctactgggaagtgaggagcccctctgcccggccatccgccccatccaggagggaggtgggggggtcagtcccccgcccggccagccgccccgtccgggagggaggtgggggggtcagccccccgcccggccagccgcctcgtccgggaggtgaggggcgcctctgcccggccgcccctactgggaagtgaggagcccctctgcccggccagccgccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaattcttctgccttgggatcctgtagatctgtgaccttacccccaaccctgtgctctctgaaacatgtgctgtgtccactcagggttaaatggattaagggcggtgcaagatgtgctttgttaaacagatgcttgaaggcagcgtgctcgttaagagtcatcaccactccctattctcaagtacccagggacacaaacactgcggaaggccgcagggtcctctgcctaggaaaaccagagacctttgttcacttgtttatctgctgaccttccctccactattgtcctgagaccctgccaaatccccctctgcgagaaacacgcaagaatgatcaataaaaaaaaaaacaaaaaacaaaaacaaaacaaaaaaaacatcattttcactttcttccccccatacaaaatgtcacaatggcttcccattacctattgaataataataaaaatagctaatatgtgttaagcactgaactgtttgccaggcagtgtgatgagaactgtacagccacctcatcatcctcattcttatcgtcatcttcatatggatgaagaaactgacgctcaggtgacgtcacctgcctaagtttgcacaggtagtaggttatagagctgggatttgactcagttctgtttgtctccaaagccggggtcctgacaatgacgtgattctgcccaaattctttaaattcaaactgtttgattatttaagaacctgtaaaactggccctgtcttacctctcctgttttctctctcattactttgtagcacaaactcagtttcagccaaggtagtctcactatctccaaatctgttgtatttttttccctctcctaaacttttgttcatatgggttcttctgcttggaatacccttccctctactcactgcttgttcatattttatacatctttgaaggactaggtcaaatatttatttatgtatttatttatttattgagacagggtctcatattgttgccaggctggagtgcagtggcacaattgtggctcactgcagcttcaatctcccaggctcaaaagatcctcccacttcagcctcctgagtagctaggtctactgacatgtgtaccacatgtgcccggctaatttttttttttcttttagtagagatgaggtcttgttgttacccaggctgatctcgaactcgtgagctcaaggattcctcctgccttggcttcccaaagtgctgggattacaggcataagccactgtgcgtggccaaattttaattctttcgcacaactcacaccactcttctattatggactaccccaaacatgtattatttatactatagacgaaaatctttaaactcttttgatcacacatcacatcaggagaaaatgtttgagtacatgcctccaacataggtacactgcatttacttatacattttggacatataccactgtgctattatgtgaatcatagaatatatataaagtagaaatataaaaaaggatgagataaggatgaaacgatgtttttagaaaatttaaaaatttggctgggtgcagtggctcacgcctgtaatcccagcactttgggaagcagaggtgggtagatcatctgaggtcaagagtttgagaccagctggccaacatggtgaaaccccatctctactaaaaatgcaaaaattaactgggtgtggtggcatgcacctgtaattccagctactcgggagtctgaggcaggagaatcgcttgaacctgggaggcagaggttgtactgagccgagatcgtgtcactgctctccagcctgggcaacagagtgagattctgtcaccaaaaaaaaataaaaataaaaataaataaaaaaataaaatcccagttacttaggaagctgagacatgagaatcacttaaacctgggaggcagaggtttcagtgagctgagattgcaccactgcactccagcctgtgtgacagagtgagatcctgtctcaaaaaatatataaaagcaacaacaaaaaaactatcctaatgggggtaaagtggcatctcattgtggttttggtttgcatttccataatgacaaatgatgttgagcatcttttcatgtgctttttggtcatttgtatgtattctttggagaaacattcagtctctttactcatattttaattgggttggtttttgttgtcactgtgtggtaggagttctgtatatattttggatattcattccttttcagatatatgatttgcagatatcttctccaattatccagttgtcttttcactctcttgatagtgtcatttgatgcacaaaagtttttttaatttctctgggcgcggtggctcacacctgtaatcctagcactttgggaggccgaggtgggtggatcacgaggtcaggagatcgagaccatcctgtctaacatggtgaaaccccgtctctactaaaaatacaaaaaattagctgggcgtggtggtgggcacctgtagtcccagctactcaggaggctgaatcgggagaatggtgtgaacctgggaggtggagcttgcagtgagccgagatcgcgccactgcattccagcctaggcaacagagcgagactccgtctcaaaaaaaagtccgggcacagtggctcacgcctgtaatcccagcactttgggaggctgaggcaggtggatcacctgaggtcaggagtttgaaaccagcctggccaacacggtgaaaccccatctctgctaaacatacaaaaattagctgggtgtggtggcgggtgcctgtaatcccagctgctcaggaggctgaggcaggagaattgcttgaatccgggaggcagaggttgcagtgagctgagattgcgccattgcactccagcctgggcaacaggagcaaaactccgtctcaaaaaaaaaaaagcattaatttggccgggcgccatggctcacacctgtaatcccagcactttgggaggccaagacgggcggatcacaaggtcaggagttcaagaccagcctgaccaacacgtgaagccccatctctactaaaaatacaaaaattagccgggcctggtggcatgcgcctgtaatccaagctactcaggaggctgagacaggagaatcgcttgaacccaggaggcagaggttgcaggagccgagatcacaccattgcactctagcctggccaacagagtgacacgccatctcagaaaaaaaaaaaagttttttaattttgatgaagaccagtttatctgttttttttctcttgttgcctgtgcctttggtatcatatccaagaaatcattgtgaaatccagtgtcatgaagatttaaccttatgttatcttctaagagatttagagttttatcttttaagttaaagtctttaattcatttcgagtgaatttctgcatagggtaaaaaaaaaaaagggggttcaacttcattcttttgcatgtagagctccagttttctaaacatcatttgttgaaaagattgtcctttccccattgaatggtcctggcatcactgttgaaaaccatttgatcatgtattatgtaaaggcttatttctttttttttttttttttttttttgagacggagtctcgctctgtcgcccaggctaaagtgcagtggcgtgatctcggctcactgcaagctccgcctcccgggttcacgcaattctcctgcctcagcctcccgagtagctgggactacatgcccctgccaccacgcccaactaattttttgtacttttagtagagacggggtttcaccatgttagccaggatggtctcaatctcctgacctcgtgatccgcccacctcggccgcccaaagtgctgggattacaggcgtgagccaccgcgcccggcttgaaggcttatttctgtgcgctctattctgttccattgctatatgcatgttcttttttttttttttttttttttgagacagagtgttgctctctgtcattcaggctggagtacagtagtgcaatttcagctcactgcaacctttgcctccaggattcaagcaattcttgtgcctcagcctcctgagtagctgggattacaggtgtatgctaccacacttggctacattttgtatttttggtagagaagaggtttcaccatgttggccagactggtctcgaactcccaacctcaggtgattcgcctgcctcggcctcacaaagtgctggtatgcatctgttcttatgccagaactacactgttttgactatgtagttttgtaggaagttttgaaatcagaaagtatgaatcctccagctttgtgcatcttttcaaagactgctttggctatttggggtcctttaatattccatatgaattttcagatgggtttttctgtttctgtaaaaaatgtgattgggactttggtaaggggcgcattgcatctgttgatcactttgggtggaattgtcatctaaacattgtcccaatccatgaacatgaatgtctttctgtaggtgggttattaaaaaaaaaaaactacctatgtgaaaatgatacttgtatattaataaaaagtcaaataatatagcaatgtacaaaggaagaaagaacacattactccagatctcactactcattgataaccactgttaagtttctggtgaacatctttctgagcacctctcttacaattttacataaataggatccatttgtctcccatttaatatgtaatagttgttttctgatgtcaatgactagatttaaattatgtttgtctcatcatttacttaagcaaacttaccctgatagacatttaatttgttgtctgtgtactgtgagtaatttttattaatatcatagtattaatggccatccatagctattgtggactagtttcttctctgtcctagtagacctttaaaaagtttagggaaaactgtataattttgaatgcttaatgttgttgcttttgaataaagaaaagtacaaagtttttcatctaatcagttcctgcatatctgatgtactgtaatgcataaataatagatctttggtgtgataatttgtgaagcaataaagggcagagaaccagatacttgtttagagatttatttattctctagttcttctatagcctagtgaataaaaataatggtgcatccaaatgaaatcaaattttataaaaccataggaactgggtattcagtttattctcattttcctacctttacaggaagaagccatggatttaataaatagagaaacaatgtctgaatggtgagtactgtactttgaattactattctgataatttgtatacttaattatatcttttctttcagataggcaaactgcagttttgatttcttttgtaggaagctacaaagtgagatacagataagtcactcttgggaagaaggcttgaaactggtatgatattataacttcagttttgtagaaaatttcaaatttttactgacttacagtgtcggcatatctagttttgctgtaatttctagaaatctaagctctattttgaaacaaaaattgtatctgttgcataaataatttttgagtgctctttttaatttttttttttgagacaaggtctcactatgttgtccaggctggtcttgaactcctgagctcaatggatcgtcctgcctcaacctcccaaaatgctaggattacaggcttgagccattgcgcctagcccttgattgctcttcagaaatacttcatgatttactcataaaaatagctatcattatttgaaagtggggttcaaagtaaacagttttgtgacacaaaaccatagctattgtggaccagtttcttctctgtcctagtaggcataataaaagttcagttgcactagttaaagtgcttagataacaaaacaataaatgatttcactcccttctccataatttatgaactatatattaggagtcttaaaccacagacaatagactctctagaaaattattgcatttttatgcctgtgtgttagtccgttctcacattgctataaggaaatacccaagactgggtaatttacaaaggaaagaggtttaattgactcacagttctgcatggctggggaggcctcaggaaacttacgattatggcagaaggcacctcttcacagggcggcaggagatagaatgagtgccagcaggggaaattccagatgcttataaagccgtcaaatctcgtgagaactcactcactaccacgagaacagcattggggaatttgcccccatgattctattacctcccaccaggttccttccacaacacgtggggattatggggattacagttcaagatgagatttgagtggggacacagccacaccattatcagcctgtaacacattctcccactaacattttaatataaaacctttaatttaaacatacttagaatttagtttcatctcttgttaacatttttaaatgtctgtgtgcacactgtggttacctagttgtggtagctgaatgatatttagtgttcttttctatggacatcccagatagtgacaaaacaagtactgagctgaaaattgaataggagagattctaactaatgtcaatcttcagatttgggaattatttgatatggaaatggatcatcagcagaagcaatggcattttattttcctttgagccctgagtaccttacatgagcagttatccctgattttggagtaggtccaggagaatgagtaggtcatctctggagcctgtcactttttgtgttttggtgctaatacaattgatcgatactgctggagtcctttaactggcccaattctaattactttaggtattggcatggatgagtaagagaatcgtaagtgtgttaggaagaggaagggcacatgtaatacacacttggcttgttttagaaagaaaagggcagattttaaaatcctgaattatgaagtactgattttgtctatgtaaaatctagagacaatttccataaatgtagttattcctgctgtctcatttgcttctaagttctagccaaaacctttttggtcctttcctggatgtagtattatagttttcaataacaaagcacaggtcaaagccaaagagaagagcttaaatttaggatttgtgtttatagtgttgagtactcacattctaggactttctggcatgctgggaagcccctcaatcaccatatagccctcatccccaaaagggaaaagggtgcctttgcttattgaagtgaattttgggttccctgattgctttaggatggcgagagctcttcaccatggtgcagccagtgactcagtagtaaggactcacttccctgtgcaacaggtatctcaagtatttgattaataagcaattggtgctacaattgtacactgctttctgcttacacagaatgacaatggcttacagaaatcatcctctctaaagtgcattgatttaactccagtatcctcaatggcttcttccatcaagaagactgggaaggtaagaaaggagtacctaaaagtctatgtctcttgaaatagttaggaaatatttaggaacattaatggtcaccaaaacaaatattttgggggatatattttgtcacagtacatctgattctaactaacatttttcccttctttttcatttcttcaagtattacttacatgtaataaaattcaccaactttaaagcatagggttagattaattttggtaattgtgtacaatcctgtagccacaaccataatcaagatattgaacagttcccacactcaaaacaatttcctaatgatcttttgtaccccagtctccctccctaccatccctgcccctccctaggaaaccaatgatctgctttccgagaaaagtggcggttttaaaacctctgttccaatttgattttagcagtgtttctctccatcattacaaacttgtgtgagttgcactggttcgccttcaagtcctattcccagtcctatgcaacaatacatcatgtaagtttatgttatatgaaaataccaaattgcttataaaataagaattatagaaacctaaaagaaattatagctccaagttttgtgccaaccaaagaagtgacttctttttagggaaattaaaatgtcattgtttcggctgggcacggtggctcctgcctgtaatcccagcactttgggaggccgaggcgggtggatcacctgaggtaggaagttcaagaccagcctgagcaacatggagaaaccccgtctctactaaaaatacaaaaatagccgggcatggtggtgcatgtctgtaatcccagctactcaggaggctgaggcaggagaatcgtttgaacccaggaggtggaggttgtggtgagctgagatcgtgccattgccctccagcctgggcaacaagagcaaaactccatctcaaaaaaaaaaaaaagtcactgtttcagtttatcattttgtatattgaaaaagtcaggtgactaagaacataagaagaatttagtaattccttcaccctgctaatacataatctttctctaaccaagtttgttaataaggatcagagctatctctagaactttaaacaacttcatccgtgattctcaccttcattcaaggcaagtcccagccaggaatgtaggtttttgtagactctaggattcaaaatcctgaatccttgagaattagaagatagtttgctcctaaggcattccagtttttacccatatgtaaagaaaagcagtaaaatggccgagcatggtggctcacacctgtaatcccaacacttttggaggccaaggcaggcagatcacctaaggtcaggagttcgagaccagcctggccaacatggtgaaaccctgtgtctactaaaaaaatacaaaattagccgagtgtggtggtgcatgcctgtaatcccagctacttgggaggctgaggcaggagaatcacttgaacccaggaggcggaggctgcagtgagcttaaatcacgccactgcactccagcctcggtgacaagagccaaactgcatctcagaaaaaaagtaaaaataaaaacaaagaaaagcagtaaaatgatgtaatatcctacacagagtcccgtttttgtgtatgtccttagatctgttataatgaaatagtcattgttgattttgttaaaaaaaatttcttataatgatcatgatgattttattttagaagaagtcaaaatcctaccaacattattagaccaagtatccttggaccattaaaaagaaaaggtacttttatctaacagtagaagtaaatataactttaagttattttataaaatatctaaaatcaaatgttatacaaaaatgtatttttaaaggctttatttatttaaaatatatttaataagctattagaggcctttcattttatgcaactagaaatatgtataaggacattttgaaaactctaaaatgctatataaatgtgaattgagaaatttaattccaatttagttggctattaggattttcaatataattcaccaaggtagctatcttcattactttctaaaacaatgtagagaataaatgaatgaatgaacagagtgagtcagtcatcaagtattttgctgaatgtcaacccctgcctcactgccacacacacacattgctatcatatgaataagttgacacaaattagatccacttacaacactaaaaatatatatgaaggtgtatgttctttggtgtttagtttctttatgggagttatttttggttaaatatatggaaagtgacccacctactcagtaataaaagggcagtggaaagaataaaagggcagtggaaagatgtcttttttaaaaactcctgcaatcctggatcccacttctcaatggtacctcactaaattatgctcttcttccttttttttttttttttttcttgagacagagtcttgctctgtcacccaggctggagtgcagtggcacaatcttggctcactgcaacctcttcctcccgggttcaagcgattctcctgcctcagcctcaccagtagctgggattacaggtgcctgccaccatgcccagctaatttttttgtatttttagtagagacagagtttcaccatgttggccaggctgttctcgaactcctgacctcaggtgatccacccacctcggcctcccaaagtgctgagattgcaagcataagcctgtatatttagtacaatttttgactacaatggggaggggaaatgggtgaataggaaaggagattaaacttaaaaatgtgtattgtgaaaaatctattaaggtaagaaagaggagtaagaagaataagaggagagaaactgaaatatgctttaatgttctttgtatattttcgattaattaatggcagtcttcctaacaacataactaactcagcatgtactttttgtattctaagattaagggctagataaattctggaaaatactcttttccaaagtaagcacattgttttatgaagatgcttcggttactaagcttaggggtcttttacctgtgctgtgaaattcgggctagtgttgaaaaaatattcaaatatatcagcagtttaagagctgttagaagtcaagggtcaattgagtatttaaaataaagtacgcttaaattgaggagtgttttaccagattaaaatagttctccttttgagacatgtatacataaataggttatcacatgaaaagtatctcgagttttcttagaatttatgattgaaaaattatttttatagatcaattttaacataaaagatgtagtttctgcccagtgtcttcggagatgtgacctgtctcacacttggttttcagctgctctgaaagacgactgccttattcctttgaggtgtccctgagggaactccaaagcgaattctgtatataccacctagtccatattttcagtcataccccaccctccaaagcatgccctgtacaaatgtgctgaaaattcatttggccatttttggccagatacaataacagataaacagaaattgaaatttattcatatattttggaatatgcatattcatttgggaaacaacaaactatgtcctatttggaccccattaatacaaatgaaatgtgggagaaaggtaccataaaaataaaagagaggtcctgaggcagggggcggggggaactaaaaagaatgatgattatgtgaagtgagatcaagattagagtctccaaagcatatgatgtcatattttatggtgagaagcagcagtgacttccattaggaataagcaagagcatgggccgggcacagtggctcatgcctgtaatcccagcactttgggaggccgaggcgggcggatgacttgaggtcaggaattcaagaccagcctggccaacatgacaaaaccctgtctctactaaaaatacaaaaattagccaagggtggtggtgtgtgcctgtaatcccagctactcaggagactgaggcaggagaatcgcctgaatccaggaggcggaagttgcagtgagccgagatcacaccactgcactccagcctggacaacagagtaagactctgtctggaaaaaaaaaaaaaaaggaataagcgagagcaaataagccttcacatcggaatactgcagaaattgggcagctataaatatcgtttgacaagtaatgctggttttagcaaagaaagatctaattttcttttatgaggaatatgttttgatttgtcatgttttcaatgttaaaccaaaaaagagagctgagtagtttttctgtagtgacataaatgtaatctggcaaggcacgggacaccagacttcttttaaactttatgagccatgattacacttctgtggaaggtctatgcaatatcttaatggtgaccttagggttttatcattcaaatagaagttatgggcttgaatgtcagttttgctcaggtccagaaatgattatcatatgaatgtgaaacactgtgcagattttaacatttacttcaaggcaaagattacaaaaatgcagttgttgttttttttgagattagatgttctaccttaatctctaaagatacaattattttgttcattgtgtgctgtaaaagaacttacctatttagttcattgtgtacatttagcaaaataaagatagcaacaacctaaagttttaaaataaggaatgacattaaactcattaaacagccttactacatagctatatcaaatcatcttgcaggccgggcacagtggctcacgcctgtaatcccagcattttgggaggccaaggtgggtggatcacctgaggccaggaatttgagaccagcctggccaacatggtgaaaccccgtctctactaaaaatataaaaaatagctgggcatggtggtttgcacctgtaatcccagctactctggaggctgaagcacgagaattgctggaacctgggaggtggaggttgaagtgagcccagatcatgccactgcactccagcctgggtgacagagcgacttcttcacaaaataataataataataataataatatcatcttatagaatttagttaataatataagaaaattataatcattgaaaacaaaaagtaaatctaaaaacattatatacggtacaaacccaattttatttaaaaaacaattgtgtatacaacatattcaaaaattactaaagaatggttatgtctggataatgattacttaaaattgttttctttgtgcttttctgtattttataaattaattgcagtgaataagtattacttttgcaattaaaataataataaacatgttaaataaaacatctaccttgatctgctgtattgtcataggtgaaatggcatttcaatatcaaccaaaaaagattttccaaggcacaaccaacatgctttcttctgatacttcccaactgtcagaaaataatgtgtagtgagtattaacatgagattttaaacattcattgatcatttttgcttcgttgttaagtctactttggctattgtacgtattcagaagtatggtacattattaactgttcttagaagttttaaaactaatattccaagtggatactataaacctgagttattttattttcttttttttctttttctgaggcagggtctcactctgtcacccaggctgggaatgcagtggcacaatcttggctcactgcaacctccacctcccaggctcaagcagtcctcccacctcagcctcctgagtagctgggaccacagtagctgtgcaccaccgcgcctggctaatttttgtattttttgtagagatggggtttttccatgttgcccaggctggtctcaaactcctgagctcaagcaatccgcttgccttggcctcctaaagtgctgggattacaggcgtgagtcacgtcacctggcagagtgtttttcttatgagatgtgtgtgacactaatatatggtggatacatttttagaagtgagattttggcattagattaagagatattagagaaatacataaaaatgcatccttggaaaaagtcatcttctgcccatcttccttggatttttgtctaccttgttgggttgagagtattattgaaaagcatgcctaagaaagcatgtcttaatgataaaaataggaaatactggaatagatttctttctttttttttttttgttttgttttagacggagtctcgctctgtctcccaggctggagtgcagtggcaccatctcggcttactgcaacctctacctcctgggttcaaacaattctcctgcctcagcctcctgagtagctgggactacaggcgtgtgccaccacacctggctaatttttgtatttttagtatagatggggtttcaccttattggtcaggccggtcttgaactcctgacctcgtgatccacctgccttggccttgcaaagtgcttggattacaggcataagccaccacacctggccatggatttctatttattgttactggtggtttcattgtatgactcttaaaaaactttgcttgtgacaagtgccagttgttagtcatgtattttgcattcatgtgtagacaaagcagagtatacagagagatctcttgagttctgctatcaatgagtggcattttcttcttctagtctacttccagctacttttgatggaaacgacagcaatgctggatcttctggtaattcgtcagctgaaatcggcactgtcacaaactctcctgt

SEQ ID NO: 3748 - DNA, 45638 bp, human
ttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttgggtgagccgggttgagatactggaggaggcaagcggtggggaggaggtgttcgggaaagtgatttcctatagaattcccgtccctttatttgttgaggttctgcaggtaactcccttgttcctggtgtccggagatcccaccctcaaccttgggtgggggtagtgggacgggctgacctgagggggagcgcgcacccaccctgaggttgacaaacatctgaatctgaacatcctcccctgatagtccactcggacccgaaagtagcagccagttggtgtggagcacggcttttttctaacttcaacccatttcttacccactcctttgaagaaacttagtatcctcccccactcacctccagatcttctgccatgactgtaatatttgtcatttcagctgctttgtcacctctgaccttcacctccagccgcttgaatggaaatggttgtcaagcaaataagctttggacttttttacatttttttttttgtctttttttgagacggagtcttgctctgtcgcccaggctggagtgcattggcacgatctcagcttactgtaacctccgcctcctggcttcaagcaattctcatgcctcagcctccctagtagctaggattacaggcgcccaccaccacacctggtaattttttgtatttttattttttatttatttgtttatttatttttgagacggagtctcactctgtcgcccaggctggagtgcagtggcgtgatctcggctcactgcaagctccacctcccgggttcacgccattctcctgactcagcctcccaagtagctgggactacaggcgcccaccaacactcccggctaattttttgtatttttagtagagacagggtttcaccgtgttagtcaggatggtcttgatctcctgacctcgtgatccgcccgcctcggcctcccaaagtgctgggattacaggcgtaagccaccgtgcccggcctaattttttgtatttttagtagagacagggtttcaccatgttggccaggctggtctcgaactcctggcctcaggggatccgcctgcctcagcctcccaaagtgctggtattacagacgtgagccactgctcctggcctacacctattttttattggagcagaaagttttggtaccacagaagcttgatctcctaaattacacattctcactgggtgatacttcccccaaggggaagagaaaatagttcttgggggagtgtgaaaaatttttactctttttatgtataaagcgcagatatacatacagtatgtacacagatatatactatatatgtgttattaaaatttcacgaagggggagcaattaggggaaaaatgtctaaaaaggctttttagagggtcaataatgaaaaaaggatttagaaacactacactaaatgatggttaactgtatttctgaagatctgggattactaaatcttgtttccttttttttttttttttaagacggagtctcactgtgtcgcccaggctggagtgcagtggcatgatctcggctcactgcaacctctgcctcccgggttcaagcgattctcctgcctcagactcccgagtagctgggacttcaggcacccgccaccacgcccacctaattttttgtatttttagtagagacggggtttcaccgtgttagccaggatggtcttgatctcctgaccttgtgatccgcccaccttggcctcccaaagtgttgggattacaggcgtgagccactgcgcctggcctaaatcttacttcttaaactagacttttaaaatgagatgttggatttcacatttcagtattataaggttttctagataccgtaaaaatgtctgaaaaatgcattcactacatatgttactaactttgctcttcaccttttgttgcatcatactaattgatagttgtaattcacagtaccatagactatcaggaagggattcagagaccagctttaccctccttgtttaacatatgaggaaactgaggcccataaatctccaaaatgacgtttagtggcagagccagtactaggaagctctgtttcctgactcctaaactactgttctggccactactaaccaatacctaagctgattaactctaaatgaatgcagcttttgggtcatttgaggtaggagagaatatattgttcacaaaatgaaaagcaaactaagattgaccaaaaaaaaatacattacctttttaaaataggcaggtagaaaaacatagaagggggactctgcatgttgtgctgagaacaagaacattttattcactcaggattttgctctaattctgttgtgggaaaaaggaattatgggacccactctactagtagaagagagcagtagggagaatgttggatttattgaagacaatataaaaagaagaaataggttgcaaatagacgatggaagatgtgtactggaaggaacctgtggatcctctttaatgtattaaatacaccagagaaggagtggacccttccctaatccttaaagccctggaaacagagagatctcagttatcccttcataccttgctttgttctgcaaaggatttttttgttttgtttgtttgttttttgcttatattagagcatagctacagtgttacattccatagcttaagatcctgatgcatgaagtaaaatttgtacagaaagataagggtcactagcatatttctgtagtaggagtttaaagatacagaaaccacaaagtggacggagtccagggactctagtctgtcagaaagaagtaacataggaatgatgtgtgacatccctgagattaggggacttgcccagatgatctgagggcatattttgtgctgttgtagaaaatgtagggcatagtcagagaagttattctgaagcaagaaaaatttagagtaggattacactgagccttagttgaattcattttcacctcagttctcatttgcatatgtatactgctcacttttctccctttttttttccttccttggccctctaatacttgagtacttcctctttctaaactatacctggccagtaaagcattcttttcagaaaggtgaaagtcactagcatatttctttagtaggaattaaagatatagaaaccacaaagtggacagagttcagagactccagtccctcagaaagaagtaacataggaatgatgtgtgacatgcctgaggtcagggaacttgcccaaatgatctgaggggatgttttgtgctgttgtagaaaatatttagcttgctaaacattgttgcacctctttcaagtaattttcgaactttgcttgatgtttcttctatataaagaccctcttgcaccagcatttgcagaattaaattccttaggtttgtttctttcatatcaactctttaatacagtattactgttttaaagaagtatctgcactgttttatgtatatcttgaactaataaaaattccaacgtcaaaagttttgaacctcttggttctttatactctttatctctgtaattggctgactttattactggtgtcaataactatacttaaagctaggagttttttcttctctttctctgacccttattcaaagactcagagattaggttcttgtattcctgccagtgcctccctaccttaaaaacctctaccttgaccctgcatttaaactgttactgcctcaattcttttttttttttttcctgagatggagtcttgaggctggagtgcagtggttcaatctcggctcactgcaacctctgcctcctgggctcaagcgattctcctgcctcagcctccgagtagctgggactacaggcatgcaccaccacgccaggctaatttttgtatttttagtagagacgggtttcactatgttggccaggctaatttttgtatttttagtagagatgggtttcactatgttggccaggctagtcttgaacccttgaccttgtgatccacccaccttggcctcccaaagtgctgggattacaggcgtgagccaccactcctgaccctcaattctatttgaaaggcaaattactgccccagagccaaatgcagcccaccacctggatttgcaaataaaattttattggaatggaaccatccccatttgtttagttgttatctatggctactttcccactgcagtggcagaactgaggagttgcaacagatactgtatggcccacaaatcctaaaatatttactctctggcccttcgcagaaaaagtttgcccatcttctggtttattgaacttttacgaacgtggaagaatagcagccatgagaaatgattgctttgggaatataagtgacataaatctattatagtttagacagagctgtttattgatcatttgatgtggaacattgaacatccatccagttatactacttctgctttttccgagttaaaagtagcacttagttcagatatcagctagggttttataaattcatgttgaatgatgcataccagttgaagtatatattgcctgaattctttctttcagttatagtcttactaaaattggcaaacaaatttagggtagactatatcattgtcagccctaagtattaagccccctacacatgtacacaaaaaagaatggaaagaaatagcccattagtgtccctccaattttcttatgagtgactgccagaacatattcctattctcacaaagaaaatgactgggaaagtaagtagaattagatacatccatataccttccattcacaaaatattaagttactgcctgttatatgcaaattatgatgttgcaaagatgtatctcagggctcaataagctttaatagggaatataaatactagaaggacttaaatatatggtagagtaagataagtgcgtagggagcttaagataagtgcgtagggagctaaataaagtgctaggggaattcaaagaaggaagggagaaattacagcgggactggtgagggagaaggaaaagtttatgaagaagttggcatttgagatgggccttcatggattgataggatacaccctggaaaagagggggaacaatggttgggatagtattttaagtattatatgtagaacagacttgaaggcagaaaagcatagatgtgttccagagaactgaatggtccactttgcctgaacccctgactcccagatgttcatctgctgatcagtgctgatctcaggtgaagtttttaccaatccgtgcttttaaaagagttaagtacagcataattaaagatgtcattatgtagttgttaattatctttcctgggcaggactgtactgtactctgagattgttattctcttattttcttaataccaaagggtcattttacaaatgaaatgatggtattggtcaatggtgggatttaaaaaaaaatgacttggcaaaagaaaaaggtggcaactgtatgtttctgcctagattttgttttgaaattgtactagtccttgaaattgaagagtctggagccaaaccgtggatggctttgaatgtcatagtaaagaacgtaactgaatttgacaggcactgaagagagtcactgaaagttgtgagcaaactgttctttaggaagatgcccctggtagtctgttagcctagagaagggaaagaagagaggcgaggagcccaattagactatgcagtctgtggaaaaggaaaaagaccttgaattggtttttggcaaggagcctgacaagaatcaggtggttatcagagagcgagtatagaggtaaaatctaaaatactggcagttgattggatataggcagctaaaacaaaagtattacagatgatttctcacattggaggaacctggatgaagggtacatgtgaaccatctgtattctttttgcaacttcttgtgagtcttaaaccgtttcaaaataaaaagttataataaaaaggaaaagatgccgggcaccgctgggatctgtagtcctagctacttgagaggctgaggcaggagcatcgttgagcctaggagtttgagggcagcctaggcaatatacagcgggacgacatctctgaaaaaacaatgaaatgatgatttcttcaggattacaaggtcaaataggaccaagttcacttgagtgggcaaccatcaaagctgaggacactgacctgtcttcagtgggcatcagctgcacaacttcagtccattgttatcatgggaatgtggcccagtgttgcaaaatcttgcaacttttcaatagaagccagaacgttggaatctgggtgttttttttttttttaatgtgaaatctttcagtgtgcaaaacaaattcaaaaacatttttaacactgtaggccaaaccaaacacatctgtgaaaaatctgagttccatcaacccctgctattggttattcctcgtattcatgtgaaactttgggagttgagagggaattggtatttgcacgttgtatctctgaccataaatttaaatcatttacaggtttacactgaaaatgatgtatttccaagttcacaataaattatattcattctccgtagcatgattaggagtaaagtagtgtgcttgagaattccttaccttatatggagacttgtttaggcccagccaaccaaggctgtatgtgtgtgtgtgttttaatttctacctttgcacagcttgcctttacccttgctgtttaggtatttgaaatctttaaaagaattttgtggccgggcatggtggatcacgcctgtaatcccagcactttggtgggccaaggcgggtggatcacctgaggtcaggagttcaagaccagcctggccaacatggtgaaacctcgtctctactaaaaatacaaaaattagctgggcatggtggtgcgtgcctgtaatcccagctactaggggaggctgaggtaggaggattgcttgaacctgggaggcagaggttgcagtgagctgagatcgtgccactgcactccagcctgggcaacagaacagagcgagactccgtctcaaaaaaaaaaaaaaaaagaattttgtaatggattttatataacacatgtttttgtttttctttttagttttaattcacaggtgttgcaagctgacatgttaagaattaggacaaacagaacaacatttaggaatcgacgctctctggtaaggaaatgcttatagtggcctccctgtctaagacttgtgcttattggtctcaaccaatggtcttcaaacttgagcattcacagggagggcttattaaaacacagatggccagcgggagtctcacccccagggtttctgattaagtagatgggggtggagcatgagaatttgcatttctaacaagttcccactttgagaaacactgctctaaacattactgaaggaaaaataaacacattgactacagttatgattgctgcagctgcaacagaattaatttttaaatcccatatggatttaacatcgagattttatgtataagaccatctggtttcccttttttttttttaaagaaaattctaactttgagaggaaaatttgcagactctcctaaaagtaattttcaggcttttagacttttatctcacatttatcttgaattgtaaataagatttgcttttcatggtattatcatgcaatctctaaattataactcttttctactaattatcctgtaaacatagggaatatacttgtagatcagtaagccaaggtgaatacatgattcattatatgattttattgaggtgaaattcacataacattcaattaactgttttaaaatatacaattcaatggcatttagtgtattcacaatgttgttcaaccagtacctctctctagtttctaaagtgcatacatatccttgtcttgttcctcatcattgaatatgattttagctgtgagtttttggtaaatgtcctttatcatgttaaggaaatgtccttctactcctacttgctgagtatttttctttttcttttctttttttttttcttttttttgagacagagtctcactttgtcacccaggctggagtgcagtgacatgatctcggctcactgcaacctctacctcctgggttcaagctattcttctggtcagcctcccaagtagctgggactacaggcgtgcaccaccatgcccagctaatttttttgtatttttagtagagacaggatttcaccatgttggccaggctggtctcgaactcttgacctcaagtgatctgcccacctcggcatcccaaagtgctgggattacaggtgtgagccattgaatccagccttgctgagtatttttatcatgaaagtgtgttgaattatttcaagtgctttttctgcatctcttgggatgatcatgtgtttccccaccttgttcaattaatatggtatattacattgatttttttccatgttgaattacccttgcattcctgggataaatctttttgtatctgtattcataagagatattgacctgttgttttcttgtggtatcttttgctagctttggtatcagagtaatgctggcgtcatagaatgtattaggaggtactcctttgtcttctacttttgtaagagcttgagtaggattttatgttgattcttgttttttgtttgtttgtttttgtttttgtctttttgagatggagttttgctctttttgcccagctggagtgcagtggcacgatcttggctcactgcaatctctgcctcccgggttcaggcgattctcctgcctcagcctcctgagtagctgggattacaggcacccgccaccacgcccagctaattttttgtacttttagtagagacggggtttcatcatgttggccaggctagtctcaaactcctgacctcaggtgatccacccgccttggcctcccaaagtgcagggattacaggtgtgagccactgtgcctggcctggtgttgattctttaaatgtttagtagagttcagcattgaaaccatctggtcctggacatttctttgttgggaagtttttgattacagactctatctcttgttataggtttgttgagattttctatttcttgaatcagtttggtaatttatgtgttatgtgttatgtattatagatttctcttataatatgatttgtaatgtgatagaatctctagaatacattttagtgaaatgttatagcttgataccaatttaaaaatattgctcgtggccaggcgtggtggcttacacctgtaatcccaacactttgggaggccaaggcgggaggatcacctgaggtcaggagttcaagaccagcctggccaacatggtgaaaccccatctctaccaaaaatacaaaattagttggatgtggtggtgcatgcctgtaatcccagctactggggaggctgaggcaggagaatcgcttcaacccgggagttggaggttgtgagccaagatcgcgccactgcactccagcctggtgacagagtgagactttctctcaaaacaaacaaacaaacaaacaaaaacaaaaaaaaatattgcttgctaatcttaaaactggacattttcttcttcatagaatgatattcaatattgttcccacaaatgcattaattttatagtgggagaaattataactgttcattaaataaatatttcttctttctactcatttactcatccattcaacgatatttgttgagcacctgcttgcctctcaaagccttccatacctatccagtcttctactcaacgaagccaacatagtggtttaggacccactatgtattaggccctgatctagttgccagggttgatctaactgagtttggggaggagataacatcttagttgagatcttactgatgtgagagggttagctagtttgggatattggtggcaggggtagacaatattcctggtagaaaacagcatgcttgaagtcctggaaaaggaagtgtggtgtatagataaaagagtgtgtataaaatttgaaagaagtgcattttagctacagtgaaagcaaagatacagtggtgagagatgtggttgaagaagtagactagtgcaatatcttgtagggccttcaagtcatgttaagtattttgcactttatcctagggtcagtgagaagccattgaagagttttgagccaatgattgacatgatcagatttgttaaaagattgccctggctgcagagtggaaagtggattggaagagggcaaacgtatatgcaagaagatcagataggctactgcaatcaccctggcaaagagctgatggtagcttggactagtgtgatggtagtggaaatagagaaaagttccagattcaggagaaatttcaaagatggaatcaatggacggtgggaaacagtggaggcaaacctgactcctaggtctctagcttgggcagctgatgggatggtagtgacacagaataagaagggaccattgcaagaagagtagatttacaaaggaggatgagtttagctttgtacatgttacattggaggttctcttggacctgtaaactagtgatgttcgatgtactagtttgaagctcaggagtgagagctggactagagataaccatttgggaatcattggtagattgttatttaaaactgtgggaattaatgatatgacctacaaagagagtatagaaagagcagagaagaagttgcaggacaaaactttaaaaatcaccaacacttaaaaatcagtcagaagaagagtgatggactaagtagagaggcaggaggaggcttcagaagagagtagtaccatgaaaaaacaaggaaaagtagtaagtcatatgctgtcaagccgtcaaacagactgaaaagtgtcctttgaattaccaaaacagatattactcatgaattcttatatttgaaagcactttcagtagaaggaggagtggggtgagattaagccagatttgattttgaagaataactgagagccaaggacctataaatggcactgtacatccaggctcagttatttgggaggcaaatccctcatctgtaaaatgggaatgtaaaagtaactgctttgtaggtttgttgtggattaccttggtcagtatgaagcactcagcacagcactggcacatactaaatgctcaataaatatgtgggtttttttaaatcagtaatagtacatatagtcagcaaccggtgcacctggctttttaaaaattataattttaaaatctttttttctagtaccaaatacttaaaggatattttttctttctttttttttttttttttttttttatttgagacagatctcttgcccaggctggagtgcagtgacgtgatctcggctcactgcaaccttcgcctcctgggttcaagcgattcttctgcctcagcctcctgagtagctgggactacaggcacgcgccaccacacctggctaatgttcgtatttttagtagagatggggtttcaccatattggccaggctggtctcaaactcctgacctcgtgatccgcctgcctcggcctcccaaagtactgggattacaggcataagccactgtgcccggcgattcttggcattttaaaaatgcataacattccttaggaattctaggctcctaatttgcataacgttcagtttaatataatgtatatttaaaataaaccatcttatataacagattgtgtttggcagaattgaagtcattttaacttattggatgatggggatttcaaggcttgttggtttagcttgctatagcaatactatgcatatgcttttattgtgtctaagtatcacttcattattattataagacataagtaagtatatacttacctttagtatagaactgctgaattttctaggagaatgacatgatgaattagaatgcttttggcaaaagcagtaaaatccaattagaagagacttaaacagcctgggcgaggtgactcaggcctgtaatcccagcactttgggaggccaaggtgggcggatcacctgaggtcgggagttcaagaccaacctggccaacatggtgaaaccatgtctctcctaaaaatacaaaaattagccgggcatggtggcatgcgcctgtaatcccagctactcaggaggctgagacaggaaaatcgcttgaacccgggaagtgaagtttgcagtgagccgagatcacgccactgcactccaacctgggtgacagagtaagactctgtctcaaaaacaaaaacaaaagcaaacaaacaaacaaaaaacagagagacttaaacaataaggagcaataaggagcattattatctcaaataataagaagccccaagaaaaggaggttctaggccgggttagttcagtgggccaatgacatcatcagagacccaggttccttctatctttccaccctaccatcttcagcagccacagttaattatgtaactagtaattagacccagggttcaaaatcaatggatagcaagctcttatatatatttaaagatgtcgagaaggatatctatcaacctatctttagtagatatctctggagcatgacattataggcagaattttatttttactttatgcatttctatactagttggatgtttttcacaaagcatgagcaatacaggtgttttcatttctagtagatattatattacaaaatagaaacattattcttgaaaaaatacaaatattattgaatgatatcataaactataagtttaatggttatgtcctatactggtctatccttaaaattggtgccacaggcatctaaagtagccaaattcatagacacagaaggtagaatggtggttgctaggggctgggaggaggagggaatggggagttgttgtttaaagggtacagttttgcaagggtacaattttaaagggtttcagttttgcacgatgaaaagagttttggagattggctgcacaacagtgggaatgtacctaacactgctgaactgtatacttcaaaatggttaagatggtaagtttcacgttagtgtattttaccacaattttaaaaattggtgctgcttttcatgtatttaaatatgggtaaaacaggctgggcacagtagctcacgcctgtaatcccagcactttcagaggccgaggcaggcggattacttgagttcaggagtttgagattagcctggtcaacatagtgaaaccccgtctctactaaaaatacgaaaaattagccaggtctggtggcacgcgcctgtaatcccagttacttgggaggctgaggcaggagaatctcttgaacccggggagtgaagcttgcagtgagctgagatcccgccactgcactccagcctgggcgacagagacagactccatatgaaaaaaatatatatatacacatatatatgtatatatatatattttatattatatgtgtgtgtgtgtgtatatatatatatatatgggtgtgtgtgtgtatacatacgtatataggtaaaaccgtgttttagaaacaaatcactgtgacagagggcattgaagagccatgggtttttgtgttgaatgaacacaaaaataaagatgcgtattttccaagcattgtaaaaaaaaaaaaaaaaaaaaaaactgttccctcacaattattttgtttaattaagtgcaaatattttcttcacttctctcaggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcattatttctattttaatactttgtttcatgtggaaaaattatctaaggtaattcctttgcaaacgccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctactaaaaatacaaaaaaattagctgggcatgatggtacgtgcctgtagtcccaactactcaggaggctgagacaggagaattgcttgaacctgggagatggaggttgcactgagctgagattgcaccactgcactccagcctgggtgacagagcgagactccgtctcaaaaaaaaaaagaaaaaatatgtataacaaatcctggtgacacatgtttacctatgtaacaaaccttcacatgtacccccaaacctaaaataaaagttaaataaataaaaaattaaaaaatagaaagtaattgtcttatttatgacatgtcattataatacagccaaagtgtcataatttctatagaaagtatatgtatacatttaagttcaggttatatatctttttcattagattataaactttataaaccatagtgtttcatgttatatattgtgaattttctgggcatttgattgatgcagatgtgaaccttagtagcatgaattaaacgtattaaaattctgcctcttcaaaggtgtgtgtgtgtatctgtatatatgtgtatatatatgtatatttgtatacgtgtattctatgtacatatatacatatatacatacacgtatacatatatatgcatatacatgcaaaatgtatacatgtacacatatatatccatgtgtatatgagagtttttcaggaaaacctaaatttttcagattctgttcatgccactgcacaacttctcaattagtgttattaaagggaaacactgaggaagaatctccaacactgtataaatcacaatgttttctgcttgctttgaaagtttgattatttttatagtatgccttaagaatgggcacgtaaatattttttaaattagcaatatttggggttcaaagtaaaaaagaaaaaaaagtcacagtatctaatgttgagagggtatgaggaaataggtattctaatacactactgggaagtaaatttgtataagttttctggagggcagcttggtgatatgtatcaacaaccttgcaacccagaaactccagctctatgaattgatcctaaagaattaattaaggatgtgcacaaacattagcttaaaagatattattacaacattatttataagagctagcaaaaaatatggcaacagcctgaatgtctaacaatagggaataggtcaatcgaaagagccttcgttacgtgtatttgaattccagttctagcaatgactgcataaccccttggacaagttgcttaatcactgtagccctcagtttttctgaggcaaaatgaaggtgataataatgcctacctcatggggttgctgtgagaattgagtgagataaaacgtgtggcacataataaaagtgctgcttattattatggtacgtccttacagtataatattcagcacttaaaatggtgttgcagatgaattttaacatggaaagactcagaatgtattaaattatatatattgagtatatatgctttataatgagaaaaaatgtgagcctatttctgttaaaaacaaaaagatcagggccaggcccggtggctcatgcctgtaatcccagcactttgggaggccaaggcgggtggatcacttgaagccaggagttcgagaccagtctggccaacatggagaaaccctgtctctactaaaaatataaaaattagccgggcgtggtggcgcacgcctgtaatcccagctactcgggaggctgaggcaggagaaatgctttaacccaggaggtggaggttgcattgagccaaaattgggccactggccactgcactttagcctgggtgacagactgagattccttctcaaaaaaagaaaaaagaaaaaaaataaaagatcaggacaaacaggcagagcataggggaattttaggacagtgaaactattctgtaccatactataatgatggatgcatgtcatacaaaacccttagcatgtccaacaccaggagtgaacctaaatgtaaactatgaactttgggtggtaatgatgtgccaatgcaggttcattggttgtaaaaaatgcaccattctggtgagggatgttggtagtgggagaggctgcacttgtgtgagagccggaggggggtatgtgggaactctttataatttctgttcaatttcgctgtgaactgaagagtgctctaaaaaataaaatatattaaaaataaataaatgaaagttcaaataggaaaagactggaaactgctgggtaacaggggacagatagcctagttttataaatacttagcatataattcaaattgtttatgtatcattaaaggatgtattctagagtgtttgatgatggtagtaataatggtggtagtagtaatagttaccatttatttagcacaaactctgtgccaggtgctgtgctaaacacattacatgtattatcaccattatcacattaaatagatgcttaaaacagcaactctagcatgttgttcataacactattgcctatagcaacaaattatatatccaatgtatccctttaatataagttttatccagaaaagatttctgacttttgttagaagggtcagctagtagcattattgatttgaattacaaatttccttaagatatcaaccctggaacatgattagtacaggccagtctgagttatgcgccagtcaagagtccacaactgtcagattttttttattattattattttttgagtcagtcttgctctgtcatccaggctggaatgcagttgatcttggttcactgcaacctccgcctcccaggttcaagtgattctcctgtggcagcctccagagtagctgagattataggcgcctgctaccacgcccggatctttttttttttttttttttttgtctttagtagagatggggtttcaccatgttggccaggctggtcttgaactcctgacctcaagtgatctgcctgccttggcctgtcaaagtgctaggattacaggtgtgagccaccgcatccagagtgacatgtttatacccattctctggatagcaatagaaccaggctcagggctgatgatatgtatctgagtatatctattccaaagttaaatagatggtgctattaggtgtaacctgctcttctcctatgtataacagagtagatcattttcccacagttcaaactctttgagcatgacatttaaagctttctaatatcttcacgcttttggcctcagagtcctttctccctccacgaacttggtgtgccactcacacagggccagtatcctgtcttaaaacatgccaagcactttcacttttctgttgcttatgctggcaaactccttgttctgaaggtccaactgaaataccaccttatgcctttcttatttgtcttccacctcccagcccctacacacacccacttcatctttgctttttattcccaccccactttgctttcatttgacatgcacttccttgtctcttatataaaatctgcttccaagactggtttcttcagtggattgtaaggtctctgagtaataactgagggtaataacaacagcttattagctgtcttttttttttaagaaaaaaattctctcattcccctctgagcagaaaaatagctcattaaacatagcaagtattcaaaaaatagtgaaatacttaacagctagccatattttgacaatagcgaattattgtggtgaagtagttgttgctaattgtcaaataaaatttatatgtagtaaattttcagttacccacataccaattttctattgttatttttacaaccttggctgtttcttctactttctagcaaatgatttgaaaaaaaacaaactgattttaatactttaagcaacatataattagtgaggtgatatattccttaagcagcaatatgatacattttaaaacccaacaaaaattcagactatctgcttcatagaaacatttatttatccaacacatactttattttatgtatgtatttatttatttatttatttggagatggtgtcttgctctgttccccaggctggagtgcagtggcacgatctcagctcactgtaagctctgcctcccaggttcaagtgattcttctgcctcagcctcctgagtagctggggttacaggcacccgccaccatgcctggctaatttttgtatttttaggagagacagggtttcactatgttggccaggctggtctcaaactcctgacctcaagtgatccacccgcctccgcctccccctcccgaagtgctgggattacaggcatgagccaccacacatggcccaacacatactttttgaacactcatcttccctccactcactaactcactcctcttactgcctttcatggccacactccatctattggtttctactgggaaccttagcaacctctttttcaaccttctggtcatttctccaatctacctccttctcttcactctccctttttcatttagaccctcaccatctgtgacctggcctgtgaccctgcgtctagtccctcttccatccaccatcaatgtgttctgcatgatgttgctagggttacctttttaaagcagatatgatcttgtttaaacagctttgaggtttaagaactcagaggaatctatgctctgggtttcctattgtgctcaaaggctaaagtccaaaaactacaatctggttttagcctaatttccctaaatttgtttcctgttgtaccctcgcaggtactaagtttcagccaccctgaacctttctgttccctgaacattcctctctgcctgagtgtttcctctcactccttgaaatgtcctccctcctcttctctatctaatgagttgctactcctctatgaagacttcctcaagacccacacagagttctctgtcctttgaactctgtcctttgaacccaaatcgtaactctgttctgccatttggctgtgacctagtttctgctaactagacttagactttgacttgctcaaggacaggaaaatgtcttatttatctttcgatcttcagagtctagctcagtgctctctctctctctctctctctctctctctctctctctatatatatatatatatatatatgtatatttgtaaaggtgggtgtttgccatcttgcttaggctggtcttgaactcctggcctcaagtgatcctctcaaagtgccggaataataggcatgagcctcccgtgcctggcctccaggtcttttatttttcttaaaaatcccaagtagctgggatcagaggcacatgccaccacgcatggctaatttttgtatttttagtagagatggggtttcaccatgttggccaggctggtcttgaactcctggcctcaagtgatctgcctgccttggcctcccaaagtgctgggaatacaggcatgagctaccgcgcccggcctcattcaatattttgaatgtacaactcaatgtgctcttaagatagaatttgaaactaagatatggtaaacacattatctggcattttaagaaataaccacggtacagaaagagtttacagatgaattctgaaggtaattttcaagcctcattttcacacttagctttaaatccctccattctttcattcccctcttgtgtgggtcctcataagctttgagaaaagactgaaaaggaaaaagtagccccgaaaaagagaaaggacctagacaagaagtatcttagcaaccaagagtaaaatgtgctaaatgacttgaaagtgattaccttagagtcatttcatattatgaaagtttggtttcccagctagattccaggatatttgatgtagttattctgtttatgatttttgggcagtatgcttggcaagctagctactgattcaatgactgtttcagctttttgttctgggtaatacctctacctaagctttaatgatgggctaaaactggcaagaaaaatgaggcaattttaagatctagtgccttaggaaagaaaaggtagagacaaacaaaatcctctattgatgttctgctctgtatttattatgataacagttattttgttctgttttggaaagtgttgatttttgattagtataattttcagtcaagatccagttggatctttttttaactttgaacctaactgatactgttgctggcatgcataagacactaaataaatattttaggtaattcaacattgacttaatgttgagatgtaattaatcacaaacattaaagcaagcttgacttctatattttaaatttcagttgttgccacctcctccctttcatggttccatcagccgccttcatcaaatcaaacaggtaagaagactttccaaactgacagctgttcatttaaaaaagtaaattttatttttctttgtgaaaatacctatgtttcagtaattctaagtgaggtcacgtgtaatattaagtttttatttctaggaatgatttcttcaaaaaaaaaacaaaactaagaagcactttttttggcttattagctattttaattaattaataatttctagaaatactgcatactcttataccttgagtctagcttctttcttccagggatctgaaagtggaatgctacacataaaaattaattttcagcttcataataactgtagttattatttttttaaccctcagatgagtttttttgacagataaaatggccttcatgctattgttttgttcttagtgatctgagttcagggacacattgtacctcactggtttatattttgtgcccatgtgcacgcatgcacgtctctgtgtttgtgtgtttgtgtttgtgtatgtggttgggagggtgtatgtgggtgggtgggtgtgcactcatgtgcacatgcatgcttaatagcacaagcataatacagaattcaaccttttaattatccaaggattagccacagaactcaaaagatcaaatcaccactaccccacaggtggtatttttttctttgacccagctacaagcagacattttttcccccaagagaggcttaacttattattcacttagtactaacaggtactttacatttgtggtctcattttatcttacaacaactttataaggtcagaaactaaaaaggggagaaatttagcaatttacccaatctccagagttggtgaatgtcagagccaagatttggccccagattactggattattttccagctcccctttccctgtttcagtgcacaaagcccataataccatcttgtaatcctagttattagtcctccaactcttgcttcttttccctctctccctttcacccctgtggcatggcttccctaaggtcagcttatccactagcaagaaagtatggtaaaaatggtttttttcctttttttttttttttttttttttttgagacagagtttcgctctgttgcccagactggagtgcagtggctccatcttggttcactgcaacctccacctcccaggttcaagcgattctcctgcctaagcctcccaagtagctgggattacagacgcctgccaccacgcccggctaatttttgtatttttagtagagacggggtttcatcatgttgtccaggctggtcttgaactcctgacctcaggtgatctgcctacctcggcctcccaaattgcagggattacaggcgtgagccaccgtgccaggctgttttttttactttttagtgggtaaaacttgcttttactcctgtctttgtatgtagctattttagaaattcttaaggaatgaaacaagttcaaaggagtaaagtgacctcgtgtttatctgtgcaatatgtttctttgcttctcctaaattaaaccaaatatttgaaaatgggttatgtgttgctatttgctggtgaagcttgatataaatcctaatttacactggttaggaatataagtttaatgcagtttatttccatagtaacataatatgtattataaatatttaaaaatgaaatataagtagaaaatgaatgagatgggaaaagagaaaaacattaattttcaatctggatactgattgaatggaaaattaagacttattttcagcagtttaatggtctgatagatatcttaagttgcatatttcttttttttttttctttgtttttgagatggagtctcactctgtcacccaggcgggagtgcagtggtgctgtctcagctcactacaacctccacctcctgggttcaagggattctcctgcctcagcctcccaagtagctgagatcacaggtgcgtgccaccacacccggctaatttttttgtatttttagtagagatagggtttcaccatgttggtcaggctggtttcgaactcctgacctcaagtgatctgctcacctcagcctcccaaagtgctgggattacaggggtgagccactgtgcctggcataagttgcatatttctttacatgcattctttgactgacttctttgtccctattaaacttaaccttttaagtgcaaaacagaaatgtctggttctctccccattaccttctgaactttcactttaacaacattaataagggcattgatttttcaaaatggggggaataatattggctatctcatagaatcgttttgaggatgaaaagaattacaactgacccttcaacaacctgggtttttaaaaagtaattaatttaatttttacaggtgccatggggtacatgagatactttgatataggtatgcaacatgtaataatcacatcagggtaaatggagtatccatcccttcaagcatttatcctttgtgttacaaacaattcaattatccttttagttatttttaaatgtataattaaattattattgactatagtcaccctgttgtgctagcaaatactgagtcttatttgttctttctaactatatttttgtacccattaaccatcccacttcctcgccacccctcatttacccttcccagcctctggtaaccatccttctaatctctatctccatgagttcaagtgttttaatttttacctcccacaaataagcaagaacatgaggctgggcgcagtggctcacgcctgtattcccggcactttgggaggctgaggtgggcagatcacttgaggtcaggagttcgagaccagtctggccaacatggtgaaaccccgtctctaccaaaaatacaaaaattagccgtgcgtggtgggtgcctgtaatctcagctactcaggaggctgaggctaaagaatcacttgaacctgggaggcggaggttgcagtgagccgagatcgcgccactgcactccagcctgggtgacagagagagactccgtctcaaaaaaaagaaaaaagaagataagttagaacatgcgatgtttgtctttctgtgcctggcttatttcacttaacataatgacctccagtttcatccatgttgctacaaacgactggatccctttttttttttttttttttttttttttgagacagtcttgctctatcacccaggctggagtacagtggcgccatctcagctcactgcaacctctgcctcccaggttcaagtgattttcctgcctcagcctgctgagtagctaggtttataggcccacgccaccacgacaggctaatttttgtattttttgtagagacagggtttcgccatgttgcccaggctggtctcgaactcctgacctcaggtgatcctgcctgcctcagcctcccaaaattctgggattacaggcgtgagccaccgtgcccagcctggatctcattctttttatggctgaatagtactccactgtttatatgtatcacattttctttatccattcatctgttgatgaacacttaggctgcttccaaatcttaggtattgtaaacagtgctgcaataaacatgggaatgtagatatctcttctatatgctgatttcctttttggtgggtgatataccttggagtgagattgctggatcatatggtaactctatttttcattttttgaggaacctccaaacttgaacaacatggatttgaatggcgtgtgatgtgaaaccctcctatacgtatgggtgactttttgtatcctcgggttccagaaggcccactgtggacttgaggatgtgtggattttggtattgcagtgggggggtgctggaaccaattccccacatataccaagggatgactgtaagtaattatgcataatgccaagagtactgcattaaaaaaaatctttttaaatggaaaatttaaaacatggaatatagaatcttcatgtacctaacacccagctttaacaattatccacattttgtacatcctttttcatcgatctgcttctcttttaggggtgggagagagtgctttaaatttctgacatatctttttacccaagtttatgggtatgagaaggactttttttctccataatcacaatgccatcattatgcataacaaattaccttattccttaatgtcatctaaatccatgttatatttttcctaattcttaaaaatgcattttttaactgatccaaacacaatccaaatatgacatttagttgatatatatctcttagatctcttttatttaaaacagcatttttattttattttatttatgttccaggatacatgggcagaatgtgcaggtttgtcacataggtatacgtgttccatggtggtttgctgcacctattgatctgtcatctaggttccctcccctcaccacccaccccgcaacaggccctgatgtgtgttgttcccctccctgtgtccatgtgttctcattgttcaactcccacttaggagtgaggacatgcattgtttggttttccgttcctgtgttagtttgctgaggatgatggcttccagcttcattcatgtccctgcaaaggacatgatctcattcctttttatgactgcatagtattccatggtgtatatgtaccagattttctttatcctgtctatcattgatgggcattcaggttggttccatgtctttgctattgtaaatagtactgcagtaaacatgcgtgtgcatgtgtctttatggtaaaatgaattatattcctttgggtatatactcagtaatgggatttctgggtcaaatgatatttctggttctagatccttgaggaatcgccacaccgtcttccacagtggttgaactaatttacattcccaccaacaatgtaaaagcgttcctatttctccacagccttgccagcatctattgtttcttgagtttttagtcatcgccattctgactggcatgagatggtatgtcactgtggttttgatttgcatttctctaatgatcagtgatgttgagctttttttcgtatgtttgttggccacataaatgtcttcttttgagaagtgtctgttcatatcttttgcccactttttgatggggttgtttgttttttcttgtttcagttccttgtagattctggatattagacctttgtcagatgggtagattgcaaaacttatctcctatgctgtaggttgcctgttcacgctgatgataatttcttttgctgtgcagaagttctttagtttaattagatcctatttgtcaatttttgcttttgttagaattgcttttggcattttcatcatgaagtctttgcccatgcctatgtcctgaatggtattgcctaggttttcttctagggtttttatggttttgggttttacatttaaatctttaatccatcttgagttaatttttgtataaagtataaggaaggggtccagtttcagttttctgcatatggctagccagttttcccagcaccatttattgaataggaaatcctttccccattgcttatttttgtcaggtttgttgaagagcagatggttgtatatgtgtggtgttatttctgaggtctctgttctgttccattggtctatatctctgttttggtaccagcaccatgctgtaaaacagcattttctgcctgttttttgttccatgcctcttatttattgaagaaaccagggagtccatttgtcctgtaaaatgtcccacattctgattttgcttccatgtggtgttactatgttgttttatcctctatttcctgttaaatagtttttttaatttttatttatttatttatttagacggagtcttactctgtcgcccaggctggagtgcagtggcacgatctcggctcactgcaacgtctgcctccctggttcaagcgattctgtaacctcagcctcccgagtagctgggattacaggcgcccaccaccccacccagctaaatttttttttttttaagtagagagggggtttcatcatgttggccatggtagagagggggtttcaccatgttggtctcaaactcctgacctcaggtgatccgcccatcttggcctctcgaagtgctgggattacaggcatgagctaccgcgcctggcctcctgtaaaatagtatgatgaaatttgcttttaattttaaatgaacacacagctccaagtcaatgttaggttctgggccaatatttggtttatgttacacctttcctattaagcaggtaatggacaatttcttctcaactgttgttgttagctgttttctaagtattaaagagactgagacatcaagctagaagttaattttctaaacacagttattattcctacataggaattattttgtgtaattttcctttctaataaaaattttattttatttatttatttttcagacaggttcttgctgtgttgcccaggctggagtgtagtggcatgatcatagctcactgcagcctcaaccttctgggctaaagtgatcctcttgcctcagcctcccaactagctaggactacaggtgcacaccactatgcctggataatttttttattttatttaattaatttatttatttctgagacggagtctcgctctgttgcctaggctggagtgcagtggcatgatctcggctcactgcaaccttcgcctcccgagttcaagcaattctcctgtctcagcctcccgagtagctgggactacaggcacccaccaccacacctggctaacttttgtatttttagtagagacggggtttcaccatattggtccgactggtctagaactcctgacctcaggtgatccacccgcctcggcatcccaaagtgctgggattacaggcatgagccactacgcctggccatttttttaaatttttggagagatgacgtctccctgtgatgcccaggctggtcctgaaatcctggcctcaagtggtactcctgcctcaggctcccaaagtactggcattacaggcatgagccaccacgtgtggcccctaataaaaattgagcttgtattccaaaagatccgaatgcattcagtctgtagttccctgtttcccaaagctctaaacataaattagtgccatgcagaaacagtttgtatatttgctcaggctgccattgcaaagtatcacaaactgggcggcttaaacaacagaaatatattgtttcacatttcttagggctagaagtctgagataaaggtgtcagtagggttgattccttctgagaactgtgagggaggatctgctccaggcctctgcccttggcttgttgatggctatcttcatgttcacatagtgttctccgtgtacatgtgtttgtttctaagtttctccttttcatgaaggacagcggtcatattggattagggcccaccctaatgacctcatcctaatctgcttgcttctgaatatattctgtctctaaataaggtcacatcctgaggcactggggattaggacttcaacacaggaatttgaggggacacaattcaacccataacagtctgctcacagttttttgttatatagctttatatttaattcctgatttgttaaacaggatatgagtcattggcacccagtaacaacttaactttctctgtagtgtcttaagtaaaaatcaataagaagaaattgagctgggcgtggtggttcgtgcctgtaattccagtgacttgagaggccaaagcaggaggatcacttgaggccaggagttcaagaccagcctgggcaacataagaagactccgtctttaaaaaaattttttttttaatttgctggccgggcacggtggctcacgcctgtaatcccagcactttggaaggccgaggcgggtggatcacctgaggtcaggagttcgagaccagcctgaccaacgtgaagaaaccccatctctactaaaaatataaaaattagccagacctggtgaggcatgcctgtaatcccagctactcgggaggctgaggcaggagaatcgcttgaacccgggaaccagaggttgcagtgagctgagattgtaccactgcactcactccagctggtgtgacaaagtaagactccttctccaaaaaaaaaaaatttaaatttgattttagtttacagattgtttcattctttcaacaagcctttattgggtactgtgcaggcactcagtaactaaaatctttcagatgtagtctcctcggagagcaaaagttggtaacttacagttcccatttttaccatgtatcctgaaaaatggaaagctaactttaacatccaagtataacaattctccttaaactaggtttctagtatactgtactctgcttcttacagttataatgcatggctgttgaccttttatacttattttaataatcttattttattataaaccatctcaaatccattttggaaataggcaagacataaatgaaaaagagtcaacactcttctcctaacaaccttcaatagctgattttagctaatgctccaactttcagtgggaggaatattaagcagaattctatctcagtttcacaaaactacctgctctgtacttgttgaccgaatgaactacaaaatactttgagtttcacactagaggagactatctatataatattaaattgaagaactatactaacaattacattttgctgaatttactgttattccattgcttttaaaagactaattatcttcttaaattaccttttccaattccctcattttctgtacctcattgtgtggtatcaaaatagtcacagttttaagactcaaagctctcgatttgatacctcattgtatggtatcaaaatagtcacaggtttaagactcaaagctcttgatttttcttcagttcttccttatttttctactgtatccaattaggcttctaatcctactaattcttccttgacaatatcctctttgttgtcactgctgcttccttcttctgtcccatgggtctagattactgaaataatatcccagtagattttctgtttctcccagtttatccaacttccacaatgaagaccaagataaatgttttttttttttggaacagagtctcgctctgtcgcccaggctggagtgcagtggcgcaatctcggctcactgcaacctctgccttctgggttcacgccattctcctgcctcagcctcccgtgtagctgggactacaggcacctgccaccacgcccagctaattttagtagagacggggtttcaccgtgttagccaggatggtctcgatctcctgacctcgtgatccaaccacctcggcctcccaaagtgctgggattacaggcacaagccactgtgcctggccaaattttttttttttaaaaaacatcattttcctccctctccctctccccctccccctcccccctccccccctcccccctccccctccctctccccacggtctccctctccctctctttccacagtctccctctgatgccgagcggaagctggactgtactgctgccatctcggctcactgcaacctccctgcctgattctcctgcctcagcctgccgagtgcctgcgattgcaggcgcgcgcagccacacctgactggttttcgtatttttttggtggagacggggtttcgctgtgttggccgggctggtctccagctcctaaccgcaagtgatctgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcatctctgcctggccgcccatcgtctgggaggtgaggagcccctctgcctggctgcccagtctggaaagtgaggagcgtctctgcccggccgccatcccatctaggaagtgaggagcgcctcttcccggccgccatcccatctaggaagtgaggagcgtctctgccccgctgccccgtctgggatgtgaggagcgcctctgcccggccgcgaccccgtctgggaggtgaggagcatctctgcccggccgccccgtctgagaagtgaggagaccctccgcctggcaaccgccccgtctgagaagtgaggagcccctccgcccagcagccgccccgtctgagaagtgaggagcccctccgcccggcagccacaccgtctgggaagtgaggagcgtctctgcccggcagccaccccgtccgggagggaggtgggggtcagcccccgccaggccagccgccccatccgggaggtgaggggtgcctctgcccagccgcccctactgggaagtgaggagcccctctgcccggccatccgccccatccaggagggaggtgggggggtcagtcccccgcccggccagccgccccgtccgggagggaggtgggggggtcagccccccgcccggccagccgcctcgtccgggaggtgaggggcgcctctgcccggccgcccctactgggaagtgaggagcccctctgcccggccagccgccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaattcttctgccttgggatcctgtagatctgtgaccttacccccaaccctgtgctctctgaaacatgtgctgtgtccactcagggttaaatggattaagggcggtgcaagatgtgctttgttaaacagatgcttgaaggcagcgtgctcgttaagagtcatcaccactccctattctcaagtacccagggacacaaacactgcggaaggccgcagggtcctctgcctaggaaaaccagagacctttgttcacttgtttatctgctgaccttccctccactattgtcctgagaccctgccaaatccccctctgcgagaaacacgcaagaatgatcaataaaaaaaaaaacaaaaaacaaaaacaaaacaaaaaaaacatcattttcactttcttccccccatacaaaatgtcacaatggcttcccattacctattgaataataataaaaatagctaatatgtgttaagcactgaactgtttgccaggcagtgtgatgagaactgtacagccacctcatcatcctcattcttatcgtcatcttcatatggatgaagaaactgacgctcaggtgacgtcacctgcctaagtttgcacaggtagtaggttatagagctgggatttgactcagttctgtttgtctccaaagccggggtcctgacaatgacgtgattctgcccaaattctttaaattcaaactgtttgattatttaagaacctgtaaaactggccctgtcttacctctcctgttttctctctcattactttgtagcacaaactcagtttcagccaaggtagtctcactatctccaaatctgttgtatttttttccctctcctaaacttttgttcatatgggttcttctgcttggaatacccttccctctactcactgcttgttcatattttatacatctttgaaggactaggtcaaatatttatttatgtatttatttatttattgagacagggtctcatattgttgccaggctggagtgcagtggcacaattgtggctcactgcagcttcaatctcccaggctcaaaagatcctcccacttcagcctcctgagtagctaggtctactgacatgtgtaccacatgtgcccggctaatttttttttttcttttagtagagatgaggtcttgttgttacccaggctgatctcgaactcgtgagctcaaggattcctcctgccttggcttcccaaagtgctgggattacaggcataagccactgtgcgtggccaaattttaattctttcgcacaactcacaccactcttctattatggactaccccaaacatgtattatttatactatagacgaaaatctttaaactcttttgatcacacatcacatcaggagaaaatgtttgagtacatgcctccaacataggtacactgcatttacttatacattttggacatataccactgtgctattatgtgaatcatagaatatatataaagtagaaatataaaaaaggatgagataaggatgaaacgatgtttttagaaaatttaaaaatttggctgggtgcagtggctcacgcctgtaatcccagcactttgggaagcagaggtgggtagatcatctgaggtcaagagtttgagaccagctggccaacatggtgaaaccccatctctactaaaaatgcaaaaattaactgggtgtggtggcatgcacctgtaattccagctactcgggagtctgaggcaggagaatcgcttgaacctgggaggcagaggttgtactgagccgagatcgtgtcactgctctccagcctgggcaacagagtgagattctgtcaccaaaaaaaaataaaaataaaaataaataaaaaaataaaatcccagttacttaggaagctgagacatgagaatcacttaaacctgggaggcagaggtttcagtgagctgagattgcaccactgcactccagcctgtgtgacagagtgagatcctgtctcaaaaaatatataaaagcaacaacaaaaaaactatcctaatgggggtaaagtggcatctcattgtggttttggtttgcatttccataatgacaaatgatgttgagcatcttttcatgtgctttttggtcatttgtatgtattctttggagaaacattcagtctctttactcatattttaattgggttggtttttgttgtcactgtgtggtaggagttctgtatatattttggatattcattccttttcagatatatgatttgcagatatcttctccaattatccagttgtcttttcactctcttgatagtgtcatttgatgcacaaaagtttttttaatttctctgggcgcggtggctcacacctgtaatcctagcactttgggaggccgaggtgggtggatcacgaggtcaggagatcgagaccatcctgtctaacatggtgaaaccccgtctctactaaaaatacaaaaaattagctgggcgtggtggtgggcacctgtagtcccagctactcaggaggctgaatcgggagaatggtgtgaacctgggaggtggagcttgcagtgagccgagatcgcgccactgcattccagcctaggcaacagagcgagactccgtctcaaaaaaaagtccgggcacagtggctcacgcctgtaatcccagcactttgggaggctgaggcaggtggatcacctgaggtcaggagtttgaaaccagcctggccaacacggtgaaaccccatctctgctaaacatacaaaaattagctgggtgtggtggcgggtgcctgtaatcccagctgctcaggaggctgaggcaggagaattgcttgaatccgggaggcagaggttgcagtgagctgagattgcgccattgcactccagcctgggcaacaggagcaaaactccgtctcaaaaaaaaaaaagcattaatttggccgggcgccatggctcacacctgtaatcccagcactttgggaggccaagacgggcggatcacaaggtcaggagttcaagaccagcctgaccaacacgtgaagccccatctctactaaaaatacaaaaattagccgggcctggtggcatgcgcctgtaatccaagctactcaggaggctgagacaggagaatcgcttgaacccaggaggcagaggttgcaggagccgagatcacaccattgcactctagcctggccaacagagtgacacgccatctcagaaaaaaaaaaaagttttttaattttgatgaagaccagtttatctgttttttttctcttgttgcctgtgcctttggtatcatatccaagaaatcattgtgaaatccagtgtcatgaagatttaaccttatgttatcttctaagagatttagagttttatcttttaagttaaagtctttaattcatttcgagtgaatttctgcatagggtaaaaaaaaaaaagggggttcaacttcattcttttgcatgtagagctccagttttctaaacatcatttgttgaaaagattgtcctttccccattgaatggtcctggcatcactgttgaaaaccatttgatcatgtattatgtaaaggcttatttctttttttttttttttttttttttgagacggagtctcgctctgtcgcccaggctaaagtgcagtggcgtgatctcggctcactgcaagctccgcctcccgggttcacgcaattctcctgcctcagcctcccgagtagctgggactacatgcccctgccaccacgcccaactaattttttgtacttttagtagagacggggtttcaccatgttagccaggatggtctcaatctcctgacctcgtgatccgcccacctcggccgcccaaagtgctgggattacaggcgtgagccaccgcgcccggcttgaaggcttatttctgtgcgctctattctgttccattgctatatgcatgttcttttttttttttttttttttttgagacagagtgttgctctctgtcattcaggctggagtacagtagtgcaatttcagctcactgcaacctttgcctccaggattcaagcaattcttgtgcctcagcctcctgagtagctgggattacaggtgtatgctaccacacttggctacattttgtatttttggtagagaagaggtttcaccatgttggccagactggtctcgaactcccaacctcaggtgattcgcctgcctcggcctcacaaagtgctggtatgcatctgttcttatgccagaactacactgttttgactatgtagttttgtaggaagttttgaaatcagaaagtatgaatcctccagctttgtgcatcttttcaaagactgctttggctatttggggtcctttaatattccatatgaattttcagatgggtttttctgtttctgtaaaaaatgtgattgggactttggtaaggggcgcattgcatctgttgatcactttgggtggaattgtcatctaaacattgtcccaatccatgaacatgaatgtctttctgtaggtgggttattaaaaaaaaaaaactacctatgtgaaaatgatacttgtatattaataaaaagtcaaataatatagcaatgtacaaaggaagaaagaacacattactccagatctcactactcattgataaccactgttaagtttctggtgaacatctttctgagcacctctcttacaattttacataaataggatccatttgtctcccatttaatatgtaatagttgttttctgatgtcaatgactagatttaaattatgtttgtctcatcatttacttaagcaaacttaccctgatagacatttaatttgttgtctgtgtactgtgagtaatttttattaatatcatagtattaatggccatccatagctattgtggactagtttcttctctgtcctagtagacctttaaaaagtttagggaaaactgtataattttgaatgcttaatgttgttgcttttgaataaagaaaagtacaaagtttttcatctaatcagttcctgcatatctgatgtactgtaatgcataaataatagatctttggtgtgataatttgtgaagcaataaagggcagagaaccagatacttgtttagagatttatttattctctagttcttctatagcctagtgaataaaaataatggtgcatccaaatgaaatcaaattttataaaaccataggaactgggtattcagtttattctcattttcctacctttacaggaagaagccatggatttaataaatagagaaacaatgtctgaatggtgagtactgtactttgaattactattctgataatttgtatacttaattatatcttttctttcagataggcaaactgcagttttgatttcttttgtaggaagctacaaagtgagatacagataagtcactcttgggaagaaggcttgaaactggtatgatattataacttcagttttgtagaaaatttcaaatttttactgacttacagtgtcggcatatctagttttgctgtaatttctagaaatctaagctctattttgaaacaaaaattgtatctgttgcataaataatttttgagtgctctttttaatttttttttttgagacaaggtctcactatgttgtccaggctggtcttgaactcctgagctcaatggatcgtcctgcctcaacctcccaaaatgctaggattacaggcttgagccattgcgcctagcccttgattgctcttcagaaatacttcatgatttactcataaaaatagctatcattatttgaaagtggggttcaaagtaaacagttttgtgacacaaaaccatagctattgtggaccagtttcttctctgtcctagtaggcataataaaagttcagttgcactagttaaagtgcttagataacaaaacaataaatgatttcactcccttctccataatttatgaactatatattaggagtcttaaaccacagacaatagactctctagaaaattattgcatttttatgcctgtgtgttagtccgttctcacattgctataaggaaatacccaagactgggtaatttacaaaggaaagaggtttaattgactcacagttctgcatggctggggaggcctcaggaaacttacgattatggcagaaggcacctcttcacagggcggcaggagatagaatgagtgccagcaggggaaattccagatgcttataaagccgtcaaatctcgtgagaactcactcactaccacgagaacagcattggggaatttgcccccatgattctattacctcccaccaggttccttccacaacacgtggggattatggggattacagttcaagatgagatttgagtggggacacagccacaccattatcagcctgtaacacattctcccactaacattttaatataaaacctttaatttaaacatacttagaatttagtttcatctcttgttaacatttttaaatgtctgtgtgcacactgtggttacctagttgtggtagctgaatgatatttagtgttcttttctatggacatcccagatagtgacaaaacaagtactgagctgaaaattgaataggagagattctaactaatgtcaatcttcagatttgggaattatttgatatggaaatggatcatcagcagaagcaatggcattttattttcctttgagccctgagtaccttacatgagcagttatccctgattttggagtaggtccaggagaatgagtaggtcatctctggagcctgtcactttttgtgttttggtgctaatacaattgatcgatactgctggagtcctttaactggcccaattctaattactttaggtattggcatggatgagtaagagaatcgtaagtgtgttaggaagaggaagggcacatgtaatacacacttggcttgttttagaaagaaaagggcagattttaaaatcctgaattatgaagtactgattttgtctatgtaaaatctagagacaatttccataaatgtagttattcctgctgtctcatttgcttctaagttctagccaaaacctttttggtcctttcctggatgtagtattatagttttcaataacaaagcacaggtcaaagccaaagagaagagcttaaatttaggatttgtgtttatagtgttgagtactcacattctaggactttctggcatgctgggaagcccctcaatcaccatatagccctcatccccaaaagggaaaagggtgcctttgcttattgaagtgaattttgggttccctgattgctttaggatggcgagagctcttcaccatggtgcagccagtgactcagtagtaaggactcacttccctgtgcaacaggtatctcaagtatttgattaataagcaattggtgctacaattgtacactgctttctgcttacacagaatgacaatggcttacagaaatcatcctctctaaagtgcattgatttaactccagtatcctcaatggcttcttccatcaagaagactgggaaggtaagaaaggagtacctaaaagtctatgtctcttgaaatagttaggaaatatttaggaacattaatggtcaccaaaacaaatattttgggggatatattttgtcacagtacatctgattctaactaacatttttcccttctttttcatttcttcaagtattacttacatgtaataaaattcaccaactttaaagcatagggttagattaattttggtaattgtgtacaatcctgtagccacaaccataatcaagatattgaacagttcccacactcaaaacaatttcctaatgatcttttgtaccccagtctccctccctaccatccctgcccctccctaggaaaccaatgatctgctttccgagaaaagtggcggttttaaaacctctgttccaatttgattttagcagtgtttctctccatcattacaaacttgtgtgagttgcactggttcgccttcaagtcctattcccagtcctatgcaacaatacatcatgtaagtttatgttatatgaaaataccaaattgcttataaaataagaattatagaaacctaaaagaaattatagctccaagttttgtgccaaccaaagaagtgacttctttttagggaaattaaaatgtcattgtttcggctgggcacggtggctcctgcctgtaatcccagcactttgggaggccgaggcgggtggatcacctgaggtaggaagttcaagaccagcctgagcaacatggagaaaccccgtctctactaaaaatacaaaaatagccgggcatggtggtgcatgtctgtaatcccagctactcaggaggctgaggcaggagaatcgtttgaacccaggaggtggaggttgtggtgagctgagatcgtgccattgccctccagcctgggcaacaagagcaaaactccatctcaaaaaaaaaaaaaagtcactgtttcagtttatcattttgtatattgaaaaagtcaggtgactaagaacataagaagaatttagtaattccttcaccctgctaatacataatctttctctaaccaagtttgttaataaggatcagagctatctctagaactttaaacaacttcatccgtgattctcaccttcattcaaggcaagtcccagccaggaatgtaggtttttgtagactctaggattcaaaatcctgaatccttgagaattagaagatagtttgctcctaaggcattccagtttttacccatatgtaaagaaaagcagtaaaatggccgagcatggtggctcacacctgtaatcccaacacttttggaggccaaggcaggcagatcacctaaggtcaggagttcgagaccagcctggccaacatggtgaaaccctgtgtctactaaaaaaatacaaaattagccgagtgtggtggtgcatgcctgtaatcccagctacttgggaggctgaggcaggagaatcacttgaacccaggaggcggaggctgcagtgagcttaaatcacgccactgcactccagcctcggtgacaagagccaaactgcatctcagaaaaaaagtaaaaataaaaacaaagaaaagcagtaaaatgatgtaatatcctacacagagtcccgtttttgtgtatgtccttagatctgttataatgaaatagtcattgttgattttgttaaaaaaaatttcttataatgatcatgatgattttattttagaagaagtcaaaatcctaccaacattattagaccaagtatccttggaccattaaaaagaaaaggtacttttatctaacagtagaagtaaatataactttaagttattttataaaatatctaaaatcaaatgttatacaaaaatgtatttttaaaggctttatttatttaaaatatatttaataagctattagaggcctttcattttatgcaactagaaatatgtataaggacattttgaaaactctaaaatgctatataaatgtgaattgagaaatttaattccaatttagttggctattaggattttcaatataattcaccaaggtagctatcttcattactttctaaaacaatgtagagaataaatgaatgaatgaacagagtgagtcagtcatcaagtattttgctgaatgtcaacccctgcctcactgccacacacacacattgctatcatatgaataagttgacacaaattagatccacttacaacactaaaaatatatatgaaggtgtatgttctttggtgtttagtttctttatgggagttatttttggttaaatatatggaaagtgacccacctactcagtaataaaagggcagtggaaagaataaaagggcagtggaaagatgtcttttttaaaaactcctgcaatcctggatcccacttctcaatggtacctcactaaattatgctcttcttccttttttttttttttttttcttgagacagagtcttgctctgtcacccaggctggagtgcagtggcacaatcttggctcactgcaacctcttcctcccgggttcaagcgattctcctgcctcagcctcaccagtagctgggattacaggtgcctgccaccatgcccagctaatttttttgtatttttagtagagacagagtttcaccatgttggccaggctgttctcgaactcctgacctcaggtgatccacccacctcggcctcccaaagtgctgagattgcaagcataagcctgtatatttagtacaatttttgactacaatggggaggggaaatgggtgaataggaaaggagattaaacttaaaaatgtgtattgtgaaaaatctattaaggtaagaaagaggagtaagaagaataagaggagagaaactgaaatatgctttaatgttctttgtatattttcgattaattaatggcagtcttcctaacaacataactaactcagcatgtactttttgtattctaagattaagggctagataaattctggaaaatactcttttccaaagtaagcacattgttttatgaagatgcttcggttactaagcttaggggtcttttacctgtgctgtgaaattcgggctagtgttgaaaaaatattcaaatatatcagcagtttaagagctgttagaagtcaagggtcaattgagtatttaaaataaagtacgcttaaattgaggagtgttttaccagattaaaatagttctccttttgagacatgtatacataaataggttatcacatgaaaagtatctcgagttttcttagaatttatgattgaaaaattatttttatagatcaattttaacataaaagatgtagtttctgcccagtgtcttcggagatgtgacctgtctcacacttggttttcagctgctctgaaagacgactgccttattcctttgaggtgtccctgagggaactccaaagcgaattctgtatataccacctagtccatattttcagtcataccccaccctccaaagcatgccctgtacaaatgtgctgaaaattcatttggccatttttggccagatacaataacagataaacagaaattgaaatttattcatatattttggaatatgcatattcatttgggaaacaacaaactatgtcctatttggaccccattaatacaaatgaaatgtgggagaaaggtaccataaaaataaaagagaggtcctgaggcagggggcggggggaactaaaaagaatgatgattatgtgaagtgagatcaagattagagtctccaaagcatatgatgtcatattttatggtgagaagcagcagtgacttccattaggaataagcaagagcatgggccgggcacagtggctcatgcctgtaatcccagcactttgggaggccgaggcgggcggatgacttgaggtcaggaattcaagaccagcctggccaacatgacaaaaccctgtctctactaaaaatacaaaaattagccaagggtggtggtgtgtgcctgtaatcccagctactcaggagactgaggcaggagaatcgcctgaatccaggaggcggaagttgcagtgagccgagatcacaccactgcactccagcctggacaacagagtaagactctgtctggaaaaaaaaaaaaaaaggaataagcgagagcaaataagccttcacatcggaatactgcagaaattgggcagctataaatatcgtttgacaagtaatgctggttttagcaaagaaagatctaattttcttttatgaggaatatgttttgatttgtcatgttttcaatgttaaaccaaaaaagagagctgagtagtttttctgtagtgacataaatgtaatctggcaaggcacgggacaccagacttcttttaaactttatgagccatgattacacttctgtggaaggtctatgcaatatcttaatggtgaccttagggttttatcattcaaatagaagttatgggcttgaatgtcagttttgctcaggtccagaaatgattatcatatgaatgtgaaacactgtgcagattttaacatttacttcaaggcaaagattacaaaaatgcagttgttgttttttttgagattagatgttctaccttaatctctaaagatacaattattttgttcattgtgtgctgtaaaagaacttacctatttagttcattgtgtacatttagcaaaataaagatagcaacaacctaaagttttaaaataaggaatgacattaaactcattaaacagccttactacatagctatatcaaatcatcttgcaggccgggcacagtggctcacgcctgtaatcccagcattttgggaggccaaggtgggtggatcacctgaggccaggaatttgagaccagcctggccaacatggtgaaaccccgtctctactaaaaatataaaaaatagctgggcatggtggtttgcacctgtaatcccagctactctggaggctgaagcacgagaattgctggaacctgggaggtggaggttgaagtgagcccagatcatgccactgcactccagcctgggtgacagagcgacttcttcacaaaataataataataataataataatatcatcttatagaatttagttaataatataagaaaattataatcattgaaaacaaaaagtaaatctaaaaacattatatacggtacaaacccaattttatttaaaaaacaattgtgtatacaacatattcaaaaattactaaagaatggttatgtctggataatgattacttaaaattgttttctttgtgcttttctgtattttataaattaattgcagtgaataagtattacttttgcaattaaaataataataaacatgttaaataaaacatctaccttgatctgctgtattgtcataggtgaaatggcatttcaatatcaaccaaaaaagattttccaaggcacaaccaacatgctttcttctgatacttcccaactgtcagaaaataat

SEQ ID NO: 3749 - DNA, 47417 bp, human
gcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttgggtgagccgggttgagatactggaggaggcaagcggtggggaggaggtgttcgggaaagtgatttcctatagaattcccgtccctttatttgttgaggttctgcaggtaactcccttgttcctggtgtccggagatcccaccctcaaccttgggtgggggtagtgggacgggctgacctgagggggagcgcgcacccaccctgaggttgacaaacatctgaatctgaacatcctcccctgatagtccactcggacccgaaagtagcagccagttggtgtggagcacggcttttttctaacttcaacccatttcttacccactcctttgaagaaacttagtatcctcccccactcacctccagatcttctgccatgactgtaatatttgtcatttcagctgctttgtcacctctgaccttcacctccagccgcttgaatggaaatggttgtcaagcaaataagctttggacttttttacatttttttttttgtctttttttgagacggagtcttgctctgtcgcccaggctggagtgcattggcacgatctcagcttactgtaacctccgcctcctggcttcaagcaattctcatgcctcagcctccctagtagctaggattacaggcgcccaccaccacacctggtaattttttgtatttttattttttatttatttgtttatttatttttgagacggagtctcactctgtcgcccaggctggagtgcagtggcgtgatctcggctcactgcaagctccacctcccgggttcacgccattctcctgactcagcctcccaagtagctgggactacaggcgcccaccaacactcccggctaattttttgtatttttagtagagacagggtttcaccgtgttagtcaggatggtcttgatctcctgacctcgtgatccgcccgcctcggcctcccaaagtgctgggattacaggcgtaagccaccgtgcccggcctaattttttgtatttttagtagagacagggtttcaccatgttggccaggctggtctcgaactcctggcctcaggggatccgcctgcctcagcctcccaaagtgctggtattacagacgtgagccactgctcctggcctacacctattttttattggagcagaaagttttggtaccacagaagcttgatctcctaaattacacattctcactgggtgatacttcccccaaggggaagagaaaatagttcttgggggagtgtgaaaaatttttactctttttatgtataaagcgcagatatacatacagtatgtacacagatatatactatatatgtgttattaaaatttcacgaagggggagcaattaggggaaaaatgtctaaaaaggctttttagagggtcaataatgaaaaaaggatttagaaacactacactaaatgatggttaactgtatttctgaagatctgggattactaaatcttgtttccttttttttttttttttaagacggagtctcactgtgtcgcccaggctggagtgcagtggcatgatctcggctcactgcaacctctgcctcccgggttcaagcgattctcctgcctcagactcccgagtagctgggacttcaggcacccgccaccacgcccacctaattttttgtatttttagtagagacggggtttcaccgtgttagccaggatggtcttgatctcctgaccttgtgatccgcccaccttggcctcccaaagtgttgggattacaggcgtgagccactgcgcctggcctaaatcttacttcttaaactagacttttaaaatgagatgttggatttcacatttcagtattataaggttttctagataccgtaaaaatgtctgaaaaatgcattcactacatatgttactaactttgctcttcaccttttgttgcatcatactaattgatagttgtaattcacagtaccatagactatcaggaagggattcagagaccagctttaccctccttgtttaacatatgaggaaactgaggcccataaatctccaaaatgacgtttagtggcagagccagtactaggaagctctgtttcctgactcctaaactactgttctggccactactaaccaatacctaagctgattaactctaaatgaatgcagcttttgggtcatttgaggtaggagagaatatattgttcacaaaatgaaaagcaaactaagattgaccaaaaaaaaatacattacctttttaaaataggcaggtagaaaaacatagaagggggactctgcatgttgtgctgagaacaagaacattttattcactcaggattttgctctaattctgttgtgggaaaaaggaattatgggacccactctactagtagaagagagcagtagggagaatgttggatttattgaagacaatataaaaagaagaaataggttgcaaatagacgatggaagatgtgtactggaaggaacctgtggatcctctttaatgtattaaatacaccagagaaggagtggacccttccctaatccttaaagccctggaaacagagagatctcagttatcccttcataccttgctttgttctgcaaaggatttttttgttttgtttgtttgttttttgcttatattagagcatagctacagtgttacattccatagcttaagatcctgatgcatgaagtaaaatttgtacagaaagataagggtcactagcatatttctgtagtaggagtttaaagatacagaaaccacaaagtggacggagtccagggactctagtctgtcagaaagaagtaacataggaatgatgtgtgacatccctgagattaggggacttgcccagatgatctgagggcatattttgtgctgttgtagaaaatgtagggcatagtcagagaagttattctgaagcaagaaaaatttagagtaggattacactgagccttagttgaattcattttcacctcagttctcatttgcatatgtatactgctcacttttctccctttttttttccttccttggccctctaatacttgagtacttcctctttctaaactatacctggccagtaaagcattcttttcagaaaggtgaaagtcactagcatatttctttagtaggaattaaagatatagaaaccacaaagtggacagagttcagagactccagtccctcagaaagaagtaacataggaatgatgtgtgacatgcctgaggtcagggaacttgcccaaatgatctgaggggatgttttgtgctgttgtagaaaatatttagcttgctaaacattgttgcacctctttcaagtaattttcgaactttgcttgatgtttcttctatataaagaccctcttgcaccagcatttgcagaattaaattccttaggtttgtttctttcatatcaactctttaatacagtattactgttttaaagaagtatctgcactgttttatgtatatcttgaactaataaaaattccaacgtcaaaagttttgaacctcttggttctttatactctttatctctgtaattggctgactttattactggtgtcaataactatacttaaagctaggagttttttcttctctttctctgacccttattcaaagactcagagattaggttcttgtattcctgccagtgcctccctaccttaaaaacctctaccttgaccctgcatttaaactgttactgcctcaattcttttttttttttttcctgagatggagtcttgaggctggagtgcagtggttcaatctcggctcactgcaacctctgcctcctgggctcaagcgattctcctgcctcagcctccgagtagctgggactacaggcatgcaccaccacgccaggctaatttttgtatttttagtagagacgggtttcactatgttggccaggctaatttttgtatttttagtagagatgggtttcactatgttggccaggctagtcttgaacccttgaccttgtgatccacccaccttggcctcccaaagtgctgggattacaggcgtgagccaccactcctgaccctcaattctatttgaaaggcaaattactgccccagagccaaatgcagcccaccacctggatttgcaaataaaattttattggaatggaaccatccccatttgtttagttgttatctatggctactttcccactgcagtggcagaactgaggagttgcaacagatactgtatggcccacaaatcctaaaatatttactctctggcccttcgcagaaaaagtttgcccatcttctggtttattgaacttttacgaacgtggaagaatagcagccatgagaaatgattgctttgggaatataagtgacataaatctattatagtttagacagagctgtttattgatcatttgatgtggaacattgaacatccatccagttatactacttctgctttttccgagttaaaagtagcacttagttcagatatcagctagggttttataaattcatgttgaatgatgcataccagttgaagtatatattgcctgaattctttctttcagttatagtcttactaaaattggcaaacaaatttagggtagactatatcattgtcagccctaagtattaagccccctacacatgtacacaaaaaagaatggaaagaaatagcccattagtgtccctccaattttcttatgagtgactgccagaacatattcctattctcacaaagaaaatgactgggaaagtaagtagaattagatacatccatataccttccattcacaaaatattaagttactgcctgttatatgcaaattatgatgttgcaaagatgtatctcagggctcaataagctttaatagggaatataaatactagaaggacttaaatatatggtagagtaagataagtgcgtagggagcttaagataagtgcgtagggagctaaataaagtgctaggggaattcaaagaaggaagggagaaattacagcgggactggtgagggagaaggaaaagtttatgaagaagttggcatttgagatgggccttcatggattgataggatacaccctggaaaagagggggaacaatggttgggatagtattttaagtattatatgtagaacagacttgaaggcagaaaagcatagatgtgttccagagaactgaatggtccactttgcctgaacccctgactcccagatgttcatctgctgatcagtgctgatctcaggtgaagtttttaccaatccgtgcttttaaaagagttaagtacagcataattaaagatgtcattatgtagttgttaattatctttcctgggcaggactgtactgtactctgagattgttattctcttattttcttaataccaaagggtcattttacaaatgaaatgatggtattggtcaatggtgggatttaaaaaaaaatgacttggcaaaagaaaaaggtggcaactgtatgtttctgcctagattttgttttgaaattgtactagtccttgaaattgaagagtctggagccaaaccgtggatggctttgaatgtcatagtaaagaacgtaactgaatttgacaggcactgaagagagtcactgaaagttgtgagcaaactgttctttaggaagatgcccctggtagtctgttagcctagagaagggaaagaagagaggcgaggagcccaattagactatgcagtctgtggaaaaggaaaaagaccttgaattggtttttggcaaggagcctgacaagaatcaggtggttatcagagagcgagtatagaggtaaaatctaaaatactggcagttgattggatataggcagctaaaacaaaagtattacagatgatttctcacattggaggaacctggatgaagggtacatgtgaaccatctgtattctttttgcaacttcttgtgagtcttaaaccgtttcaaaataaaaagttataataaaaaggaaaagatgccgggcaccgctgggatctgtagtcctagctacttgagaggctgaggcaggagcatcgttgagcctaggagtttgagggcagcctaggcaatatacagcgggacgacatctctgaaaaaacaatgaaatgatgatttcttcaggattacaaggtcaaataggaccaagttcacttgagtgggcaaccatcaaagctgaggacactgacctgtcttcagtgggcatcagctgcacaacttcagtccattgttatcatgggaatgtggcccagtgttgcaaaatcttgcaacttttcaatagaagccagaacgttggaatctgggtgttttttttttttttaatgtgaaatctttcagtgtgcaaaacaaattcaaaaacatttttaacactgtaggccaaaccaaacacatctgtgaaaaatctgagttccatcaacccctgctattggttattcctcgtattcatgtgaaactttgggagttgagagggaattggtatttgcacgttgtatctctgaccataaatttaaatcatttacaggtttacactgaaaatgatgtatttccaagttcacaataaattatattcattctccgtagcatgattaggagtaaagtagtgtgcttgagaattccttaccttatatggagacttgtttaggcccagccaaccaaggctgtatgtgtgtgtgtgttttaatttctacctttgcacagcttgcctttacccttgctgtttaggtatttgaaatctttaaaagaattttgtggccgggcatggtggatcacgcctgtaatcccagcactttggtgggccaaggcgggtggatcacctgaggtcaggagttcaagaccagcctggccaacatggtgaaacctcgtctctactaaaaatacaaaaattagctgggcatggtggtgcgtgcctgtaatcccagctactaggggaggctgaggtaggaggattgcttgaacctgggaggcagaggttgcagtgagctgagatcgtgccactgcactccagcctgggcaacagaacagagcgagactccgtctcaaaaaaaaaaaaaaaaagaattttgtaatggattttatataacacatgtttttgtttttctttttagttttaattcacaggtgttgcaagctgacatgttaagaattaggacaaacagaacaacatttaggaatcgacgctctctggtaaggaaatgcttatagtggcctccctgtctaagacttgtgcttattggtctcaaccaatggtcttcaaacttgagcattcacagggagggcttattaaaacacagatggccagcgggagtctcacccccagggtttctgattaagtagatgggggtggagcatgagaatttgcatttctaacaagttcccactttgagaaacactgctctaaacattactgaaggaaaaataaacacattgactacagttatgattgctgcagctgcaacagaattaatttttaaatcccatatggatttaacatcgagattttatgtataagaccatctggtttcccttttttttttttaaagaaaattctaactttgagaggaaaatttgcagactctcctaaaagtaattttcaggcttttagacttttatctcacatttatcttgaattgtaaataagatttgcttttcatggtattatcatgcaatctctaaattataactcttttctactaattatcctgtaaacatagggaatatacttgtagatcagtaagccaaggtgaatacatgattcattatatgattttattgaggtgaaattcacataacattcaattaactgttttaaaatatacaattcaatggcatttagtgtattcacaatgttgttcaaccagtacctctctctagtttctaaagtgcatacatatccttgtcttgttcctcatcattgaatatgattttagctgtgagtttttggtaaatgtcctttatcatgttaaggaaatgtccttctactcctacttgctgagtatttttctttttcttttctttttttttttcttttttttgagacagagtctcactttgtcacccaggctggagtgcagtgacatgatctcggctcactgcaacctctacctcctgggttcaagctattcttctggtcagcctcccaagtagctgggactacaggcgtgcaccaccatgcccagctaatttttttgtatttttagtagagacaggatttcaccatgttggccaggctggtctcgaactcttgacctcaagtgatctgcccacctcggcatcccaaagtgctgggattacaggtgtgagccattgaatccagccttgctgagtatttttatcatgaaagtgtgttgaattatttcaagtgctttttctgcatctcttgggatgatcatgtgtttccccaccttgttcaattaatatggtatattacattgatttttttccatgttgaattacccttgcattcctgggataaatctttttgtatctgtattcataagagatattgacctgttgttttcttgtggtatcttttgctagctttggtatcagagtaatgctggcgtcatagaatgtattaggaggtactcctttgtcttctacttttgtaagagcttgagtaggattttatgttgattcttgttttttgtttgtttgtttttgtttttgtctttttgagatggagttttgctctttttgcccagctggagtgcagtggcacgatcttggctcactgcaatctctgcctcccgggttcaggcgattctcctgcctcagcctcctgagtagctgggattacaggcacccgccaccacgcccagctaattttttgtacttttagtagagacggggtttcatcatgttggccaggctagtctcaaactcctgacctcaggtgatccacccgccttggcctcccaaagtgcagggattacaggtgtgagccactgtgcctggcctggtgttgattctttaaatgtttagtagagttcagcattgaaaccatctggtcctggacatttctttgttgggaagtttttgattacagactctatctcttgttataggtttgttgagattttctatttcttgaatcagtttggtaatttatgtgttatgtgttatgtattatagatttctcttataatatgatttgtaatgtgatagaatctctagaatacattttagtgaaatgttatagcttgataccaatttaaaaatattgctcgtggccaggcgtggtggcttacacctgtaatcccaacactttgggaggccaaggcgggaggatcacctgaggtcaggagttcaagaccagcctggccaacatggtgaaaccccatctctaccaaaaatacaaaattagttggatgtggtggtgcatgcctgtaatcccagctactggggaggctgaggcaggagaatcgcttcaacccgggagttggaggttgtgagccaagatcgcgccactgcactccagcctggtgacagagtgagactttctctcaaaacaaacaaacaaacaaacaaaaacaaaaaaaaatattgcttgctaatcttaaaactggacattttcttcttcatagaatgatattcaatattgttcccacaaatgcattaattttatagtgggagaaattataactgttcattaaataaatatttcttctttctactcatttactcatccattcaacgatatttgttgagcacctgcttgcctctcaaagccttccatacctatccagtcttctactcaacgaagccaacatagtggtttaggacccactatgtattaggccctgatctagttgccagggttgatctaactgagtttggggaggagataacatcttagttgagatcttactgatgtgagagggttagctagtttgggatattggtggcaggggtagacaatattcctggtagaaaacagcatgcttgaagtcctggaaaaggaagtgtggtgtatagataaaagagtgtgtataaaatttgaaagaagtgcattttagctacagtgaaagcaaagatacagtggtgagagatgtggttgaagaagtagactagtgcaatatcttgtagggccttcaagtcatgttaagtattttgcactttatcctagggtcagtgagaagccattgaagagttttgagccaatgattgacatgatcagatttgttaaaagattgccctggctgcagagtggaaagtggattggaagagggcaaacgtatatgcaagaagatcagataggctactgcaatcaccctggcaaagagctgatggtagcttggactagtgtgatggtagtggaaatagagaaaagttccagattcaggagaaatttcaaagatggaatcaatggacggtgggaaacagtggaggcaaacctgactcctaggtctctagcttgggcagctgatgggatggtagtgacacagaataagaagggaccattgcaagaagagtagatttacaaaggaggatgagtttagctttgtacatgttacattggaggttctcttggacctgtaaactagtgatgttcgatgtactagtttgaagctcaggagtgagagctggactagagataaccatttgggaatcattggtagattgttatttaaaactgtgggaattaatgatatgacctacaaagagagtatagaaagagcagagaagaagttgcaggacaaaactttaaaaatcaccaacacttaaaaatcagtcagaagaagagtgatggactaagtagagaggcaggaggaggcttcagaagagagtagtaccatgaaaaaacaaggaaaagtagtaagtcatatgctgtcaagccgtcaaacagactgaaaagtgtcctttgaattaccaaaacagatattactcatgaattcttatatttgaaagcactttcagtagaaggaggagtggggtgagattaagccagatttgattttgaagaataactgagagccaaggacctataaatggcactgtacatccaggctcagttatttgggaggcaaatccctcatctgtaaaatgggaatgtaaaagtaactgctttgtaggtttgttgtggattaccttggtcagtatgaagcactcagcacagcactggcacatactaaatgctcaataaatatgtgggtttttttaaatcagtaatagtacatatagtcagcaaccggtgcacctggctttttaaaaattataattttaaaatctttttttctagtaccaaatacttaaaggatattttttctttctttttttttttttttttttttttatttgagacagatctcttgcccaggctggagtgcagtgacgtgatctcggctcactgcaaccttcgcctcctgggttcaagcgattcttctgcctcagcctcctgagtagctgggactacaggcacgcgccaccacacctggctaatgttcgtatttttagtagagatggggtttcaccatattggccaggctggtctcaaactcctgacctcgtgatccgcctgcctcggcctcccaaagtactgggattacaggcataagccactgtgcccggcgattcttggcattttaaaaatgcataacattccttaggaattctaggctcctaatttgcataacgttcagtttaatataatgtatatttaaaataaaccatcttatataacagattgtgtttggcagaattgaagtcattttaacttattggatgatggggatttcaaggcttgttggtttagcttgctatagcaatactatgcatatgcttttattgtgtctaagtatcacttcattattattataagacataagtaagtatatacttacctttagtatagaactgctgaattttctaggagaatgacatgatgaattagaatgcttttggcaaaagcagtaaaatccaattagaagagacttaaacagcctgggcgaggtgactcaggcctgtaatcccagcactttgggaggccaaggtgggcggatcacctgaggtcgggagttcaagaccaacctggccaacatggtgaaaccatgtctctcctaaaaatacaaaaattagccgggcatggtggcatgcgcctgtaatcccagctactcaggaggctgagacaggaaaatcgcttgaacccgggaagtgaagtttgcagtgagccgagatcacgccactgcactccaacctgggtgacagagtaagactctgtctcaaaaacaaaaacaaaagcaaacaaacaaacaaaaaacagagagacttaaacaataaggagcaataaggagcattattatctcaaataataagaagccccaagaaaaggaggttctaggccgggttagttcagtgggccaatgacatcatcagagacccaggttccttctatctttccaccctaccatcttcagcagccacagttaattatgtaactagtaattagacccagggttcaaaatcaatggatagcaagctcttatatatatttaaagatgtcgagaaggatatctatcaacctatctttagtagatatctctggagcatgacattataggcagaattttatttttactttatgcatttctatactagttggatgtttttcacaaagcatgagcaatacaggtgttttcatttctagtagatattatattacaaaatagaaacattattcttgaaaaaatacaaatattattgaatgatatcataaactataagtttaatggttatgtcctatactggtctatccttaaaattggtgccacaggcatctaaagtagccaaattcatagacacagaaggtagaatggtggttgctaggggctgggaggaggagggaatggggagttgttgtttaaagggtacagttttgcaagggtacaattttaaagggtttcagttttgcacgatgaaaagagttttggagattggctgcacaacagtgggaatgtacctaacactgctgaactgtatacttcaaaatggttaagatggtaagtttcacgttagtgtattttaccacaattttaaaaattggtgctgcttttcatgtatttaaatatgggtaaaacaggctgggcacagtagctcacgcctgtaatcccagcactttcagaggccgaggcaggcggattacttgagttcaggagtttgagattagcctggtcaacatagtgaaaccccgtctctactaaaaatacgaaaaattagccaggtctggtggcacgcgcctgtaatcccagttacttgggaggctgaggcaggagaatctcttgaacccggggagtgaagcttgcagtgagctgagatcccgccactgcactccagcctgggcgacagagacagactccatatgaaaaaaatatatatatacacatatatatgtatatatatatattttatattatatgtgtgtgtgtgtgtatatatatatatatatgggtgtgtgtgtgtatacatacgtatataggtaaaaccgtgttttagaaacaaatcactgtgacagagggcattgaagagccatgggtttttgtgttgaatgaacacaaaaataaagatgcgtattttccaagcattgtaaaaaaaaaaaaaaaaaaaaaaactgttccctcacaattattttgtttaattaagtgcaaatattttcttcacttctctcaggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcattatttctattttaatactttgtttcatgtggaaaaattatctaaggtaattcctttgcaaacgccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctactaaaaatacaaaaaaattagctgggcatgatggtacgtgcctgtagtcccaactactcaggaggctgagacaggagaattgcttgaacctgggagatggaggttgcactgagctgagattgcaccactgcactccagcctgggtgacagagcgagactccgtctcaaaaaaaaaaagaaaaaatatgtataacaaatcctggtgacacatgtttacctatgtaacaaaccttcacatgtacccccaaacctaaaataaaagttaaataaataaaaaattaaaaaatagaaagtaattgtcttatttatgacatgtcattataatacagccaaagtgtcataatttctatagaaagtatatgtatacatttaagttcaggttatatatctttttcattagattataaactttataaaccatagtgtttcatgttatatattgtgaattttctgggcatttgattgatgcagatgtgaaccttagtagcatgaattaaacgtattaaaattctgcctcttcaaaggtgtgtgtgtgtatctgtatatatgtgtatatatatgtatatttgtatacgtgtattctatgtacatatatacatatatacatacacgtatacatatatatgcatatacatgcaaaatgtatacatgtacacatatatatccatgtgtatatgagagtttttcaggaaaacctaaatttttcagattctgttcatgccactgcacaacttctcaattagtgttattaaagggaaacactgaggaagaatctccaacactgtataaatcacaatgttttctgcttgctttgaaagtttgattatttttatagtatgccttaagaatgggcacgtaaatattttttaaattagcaatatttggggttcaaagtaaaaaagaaaaaaaagtcacagtatctaatgttgagagggtatgaggaaataggtattctaatacactactgggaagtaaatttgtataagttttctggagggcagcttggtgatatgtatcaacaaccttgcaacccagaaactccagctctatgaattgatcctaaagaattaattaaggatgtgcacaaacattagcttaaaagatattattacaacattatttataagagctagcaaaaaatatggcaacagcctgaatgtctaacaatagggaataggtcaatcgaaagagccttcgttacgtgtatttgaattccagttctagcaatgactgcataaccccttggacaagttgcttaatcactgtagccctcagtttttctgaggcaaaatgaaggtgataataatgcctacctcatggggttgctgtgagaattgagtgagataaaacgtgtggcacataataaaagtgctgcttattattatggtacgtccttacagtataatattcagcacttaaaatggtgttgcagatgaattttaacatggaaagactcagaatgtattaaattatatatattgagtatatatgctttataatgagaaaaaatgtgagcctatttctgttaaaaacaaaaagatcagggccaggcccggtggctcatgcctgtaatcccagcactttgggaggccaaggcgggtggatcacttgaagccaggagttcgagaccagtctggccaacatggagaaaccctgtctctactaaaaatataaaaattagccgggcgtggtggcgcacgcctgtaatcccagctactcgggaggctgaggcaggagaaatgctttaacccaggaggtggaggttgcattgagccaaaattgggccactggccactgcactttagcctgggtgacagactgagattccttctcaaaaaaagaaaaaagaaaaaaaataaaagatcaggacaaacaggcagagcataggggaattttaggacagtgaaactattctgtaccatactataatgatggatgcatgtcatacaaaacccttagcatgtccaacaccaggagtgaacctaaatgtaaactatgaactttgggtggtaatgatgtgccaatgcaggttcattggttgtaaaaaatgcaccattctggtgagggatgttggtagtgggagaggctgcacttgtgtgagagccggaggggggtatgtgggaactctttataatttctgttcaatttcgctgtgaactgaagagtgctctaaaaaataaaatatattaaaaataaataaatgaaagttcaaataggaaaagactggaaactgctgggtaacaggggacagatagcctagttttataaatacttagcatataattcaaattgtttatgtatcattaaaggatgtattctagagtgtttgatgatggtagtaataatggtggtagtagtaatagttaccatttatttagcacaaactctgtgccaggtgctgtgctaaacacattacatgtattatcaccattatcacattaaatagatgcttaaaacagcaactctagcatgttgttcataacactattgcctatagcaacaaattatatatccaatgtatccctttaatataagttttatccagaaaagatttctgacttttgttagaagggtcagctagtagcattattgatttgaattacaaatttccttaagatatcaaccctggaacatgattagtacaggccagtctgagttatgcgccagtcaagagtccacaactgtcagattttttttattattattattttttgagtcagtcttgctctgtcatccaggctggaatgcagttgatcttggttcactgcaacctccgcctcccaggttcaagtgattctcctgtggcagcctccagagtagctgagattataggcgcctgctaccacgcccggatctttttttttttttttttttttgtctttagtagagatggggtttcaccatgttggccaggctggtcttgaactcctgacctcaagtgatctgcctgccttggcctgtcaaagtgctaggattacaggtgtgagccaccgcatccagagtgacatgtttatacccattctctggatagcaatagaaccaggctcagggctgatgatatgtatctgagtatatctattccaaagttaaatagatggtgctattaggtgtaacctgctcttctcctatgtataacagagtagatcattttcccacagttcaaactctttgagcatgacatttaaagctttctaatatcttcacgcttttggcctcagagtcctttctccctccacgaacttggtgtgccactcacacagggccagtatcctgtcttaaaacatgccaagcactttcacttttctgttgcttatgctggcaaactccttgttctgaaggtccaactgaaataccaccttatgcctttcttatttgtcttccacctcccagcccctacacacacccacttcatctttgctttttattcccaccccactttgctttcatttgacatgcacttccttgtctcttatataaaatctgcttccaagactggtttcttcagtggattgtaaggtctctgagtaataactgagggtaataacaacagcttattagctgtcttttttttttaagaaaaaaattctctcattcccctctgagcagaaaaatagctcattaaacatagcaagtattcaaaaaatagtgaaatacttaacagctagccatattttgacaatagcgaattattgtggtgaagtagttgttgctaattgtcaaataaaatttatatgtagtaaattttcagttacccacataccaattttctattgttatttttacaaccttggctgtttcttctactttctagcaaatgatttgaaaaaaaacaaactgattttaatactttaagcaacatataattagtgaggtgatatattccttaagcagcaatatgatacattttaaaacccaacaaaaattcagactatctgcttcatagaaacatttatttatccaacacatactttattttatgtatgtatttatttatttatttatttggagatggtgtcttgctctgttccccaggctggagtgcagtggcacgatctcagctcactgtaagctctgcctcccaggttcaagtgattcttctgcctcagcctcctgagtagctggggttacaggcacccgccaccatgcctggctaatttttgtatttttaggagagacagggtttcactatgttggccaggctggtctcaaactcctgacctcaagtgatccacccgcctccgcctccccctcccgaagtgctgggattacaggcatgagccaccacacatggcccaacacatactttttgaacactcatcttccctccactcactaactcactcctcttactgcctttcatggccacactccatctattggtttctactgggaaccttagcaacctctttttcaaccttctggtcatttctccaatctacctccttctcttcactctccctttttcatttagaccctcaccatctgtgacctggcctgtgaccctgcgtctagtccctcttccatccaccatcaatgtgttctgcatgatgttgctagggttacctttttaaagcagatatgatcttgtttaaacagctttgaggtttaagaactcagaggaatctatgctctgggtttcctattgtgctcaaaggctaaagtccaaaaactacaatctggttttagcctaatttccctaaatttgtttcctgttgtaccctcgcaggtactaagtttcagccaccctgaacctttctgttccctgaacattcctctctgcctgagtgtttcctctcactccttgaaatgtcctccctcctcttctctatctaatgagttgctactcctctatgaagacttcctcaagacccacacagagttctctgtcctttgaactctgtcctttgaacccaaatcgtaactctgttctgccatttggctgtgacctagtttctgctaactagacttagactttgacttgctcaaggacaggaaaatgtcttatttatctttcgatcttcagagtctagctcagtgctctctctctctctctctctctctctctctctctctctatatatatatatatatatatatgtatatttgtaaaggtgggtgtttgccatcttgcttaggctggtcttgaactcctggcctcaagtgatcctctcaaagtgccggaataataggcatgagcctcccgtgcctggcctccaggtcttttatttttcttaaaaatcccaagtagctgggatcagaggcacatgccaccacgcatggctaatttttgtatttttagtagagatggggtttcaccatgttggccaggctggtcttgaactcctggcctcaagtgatctgcctgccttggcctcccaaagtgctgggaatacaggcatgagctaccgcgcccggcctcattcaatattttgaatgtacaactcaatgtgctcttaagatagaatttgaaactaagatatggtaaacacattatctggcattttaagaaataaccacggtacagaaagagtttacagatgaattctgaaggtaattttcaagcctcattttcacacttagctttaaatccctccattctttcattcccctcttgtgtgggtcctcataagctttgagaaaagactgaaaaggaaaaagtagccccgaaaaagagaaaggacctagacaagaagtatcttagcaaccaagagtaaaatgtgctaaatgacttgaaagtgattaccttagagtcatttcatattatgaaagtttggtttcccagctagattccaggatatttgatgtagttattctgtttatgatttttgggcagtatgcttggcaagctagctactgattcaatgactgtttcagctttttgttctgggtaatacctctacctaagctttaatgatgggctaaaactggcaagaaaaatgaggcaattttaagatctagtgccttaggaaagaaaaggtagagacaaacaaaatcctctattgatgttctgctctgtatttattatgataacagttattttgttctgttttggaaagtgttgatttttgattagtataattttcagtcaagatccagttggatctttttttaactttgaacctaactgatactgttgctggcatgcataagacactaaataaatattttaggtaattcaacattgacttaatgttgagatgtaattaatcacaaacattaaagcaagcttgacttctatattttaaatttcagttgttgccacctcctccctttcatggttccatcagccgccttcatcaaatcaaacaggtaagaagactttccaaactgacagctgttcatttaaaaaagtaaattttatttttctttgtgaaaatacctatgtttcagtaattctaagtgaggtcacgtgtaatattaagtttttatttctaggaatgatttcttcaaaaaaaaaacaaaactaagaagcactttttttggcttattagctattttaattaattaataatttctagaaatactgcatactcttataccttgagtctagcttctttcttccagggatctgaaagtggaatgctacacataaaaattaattttcagcttcataataactgtagttattatttttttaaccctcagatgagtttttttgacagataaaatggccttcatgctattgttttgttcttagtgatctgagttcagggacacattgtacctcactggtttatattttgtgcccatgtgcacgcatgcacgtctctgtgtttgtgtgtttgtgtttgtgtatgtggttgggagggtgtatgtgggtgggtgggtgtgcactcatgtgcacatgcatgcttaatagcacaagcataatacagaattcaaccttttaattatccaaggattagccacagaactcaaaagatcaaatcaccactaccccacaggtggtatttttttctttgacccagctacaagcagacattttttcccccaagagaggcttaacttattattcacttagtactaacaggtactttacatttgtggtctcattttatcttacaacaactttataaggtcagaaactaaaaaggggagaaatttagcaatttacccaatctccagagttggtgaatgtcagagccaagatttggccccagattactggattattttccagctcccctttccctgtttcagtgcacaaagcccataataccatcttgtaatcctagttattagtcctccaactcttgcttcttttccctctctccctttcacccctgtggcatggcttccctaaggtcagcttatccactagcaagaaagtatggtaaaaatggtttttttcctttttttttttttttttttttttttgagacagagtttcgctctgttgcccagactggagtgcagtggctccatcttggttcactgcaacctccacctcccaggttcaagcgattctcctgcctaagcctcccaagtagctgggattacagacgcctgccaccacgcccggctaatttttgtatttttagtagagacggggtttcatcatgttgtccaggctggtcttgaactcctgacctcaggtgatctgcctacctcggcctcccaaattgcagggattacaggcgtgagccaccgtgccaggctgttttttttactttttagtgggtaaaacttgcttttactcctgtctttgtatgtagctattttagaaattcttaaggaatgaaacaagttcaaaggagtaaagtgacctcgtgtttatctgtgcaatatgtttctttgcttctcctaaattaaaccaaatatttgaaaatgggttatgtgttgctatttgctggtgaagcttgatataaatcctaatttacactggttaggaatataagtttaatgcagtttatttccatagtaacataatatgtattataaatatttaaaaatgaaatataagtagaaaatgaatgagatgggaaaagagaaaaacattaattttcaatctggatactgattgaatggaaaattaagacttattttcagcagtttaatggtctgatagatatcttaagttgcatatttcttttttttttttctttgtttttgagatggagtctcactctgtcacccaggcgggagtgcagtggtgctgtctcagctcactacaacctccacctcctgggttcaagggattctcctgcctcagcctcccaagtagctgagatcacaggtgcgtgccaccacacccggctaatttttttgtatttttagtagagatagggtttcaccatgttggtcaggctggtttcgaactcctgacctcaagtgatctgctcacctcagcctcccaaagtgctgggattacaggggtgagccactgtgcctggcataagttgcatatttctttacatgcattctttgactgacttctttgtccctattaaacttaaccttttaagtgcaaaacagaaatgtctggttctctccccattaccttctgaactttcactttaacaacattaataagggcattgatttttcaaaatggggggaataatattggctatctcatagaatcgttttgaggatgaaaagaattacaactgacccttcaacaacctgggtttttaaaaagtaattaatttaatttttacaggtgccatggggtacatgagatactttgatataggtatgcaacatgtaataatcacatcagggtaaatggagtatccatcccttcaagcatttatcctttgtgttacaaacaattcaattatccttttagttatttttaaatgtataattaaattattattgactatagtcaccctgttgtgctagcaaatactgagtcttatttgttctttctaactatatttttgtacccattaaccatcccacttcctcgccacccctcatttacccttcccagcctctggtaaccatccttctaatctctatctccatgagttcaagtgttttaatttttacctcccacaaataagcaagaacatgaggctgggcgcagtggctcacgcctgtattcccggcactttgggaggctgaggtgggcagatcacttgaggtcaggagttcgagaccagtctggccaacatggtgaaaccccgtctctaccaaaaatacaaaaattagccgtgcgtggtgggtgcctgtaatctcagctactcaggaggctgaggctaaagaatcacttgaacctgggaggcggaggttgcagtgagccgagatcgcgccactgcactccagcctgggtgacagagagagactccgtctcaaaaaaaagaaaaaagaagataagttagaacatgcgatgtttgtctttctgtgcctggcttatttcacttaacataatgacctccagtttcatccatgttgctacaaacgactggatccctttttttttttttttttttttttttttgagacagtcttgctctatcacccaggctggagtacagtggcgccatctcagctcactgcaacctctgcctcccaggttcaagtgattttcctgcctcagcctgctgagtagctaggtttataggcccacgccaccacgacaggctaatttttgtattttttgtagagacagggtttcgccatgttgcccaggctggtctcgaactcctgacctcaggtgatcctgcctgcctcagcctcccaaaattctgggattacaggcgtgagccaccgtgcccagcctggatctcattctttttatggctgaatagtactccactgtttatatgtatcacattttctttatccattcatctgttgatgaacacttaggctgcttccaaatcttaggtattgtaaacagtgctgcaataaacatgggaatgtagatatctcttctatatgctgatttcctttttggtgggtgatataccttggagtgagattgctggatcatatggtaactctatttttcattttttgaggaacctccaaacttgaacaacatggatttgaatggcgtgtgatgtgaaaccctcctatacgtatgggtgactttttgtatcctcgggttccagaaggcccactgtggacttgaggatgtgtggattttggtattgcagtgggggggtgctggaaccaattccccacatataccaagggatgactgtaagtaattatgcataatgccaagagtactgcattaaaaaaaatctttttaaatggaaaatttaaaacatggaatatagaatcttcatgtacctaacacccagctttaacaattatccacattttgtacatcctttttcatcgatctgcttctcttttaggggtgggagagagtgctttaaatttctgacatatctttttacccaagtttatgggtatgagaaggactttttttctccataatcacaatgccatcattatgcataacaaattaccttattccttaatgtcatctaaatccatgttatatttttcctaattcttaaaaatgcattttttaactgatccaaacacaatccaaatatgacatttagttgatatatatctcttagatctcttttatttaaaacagcatttttattttattttatttatgttccaggatacatgggcagaatgtgcaggtttgtcacataggtatacgtgttccatggtggtttgctgcacctattgatctgtcatctaggttccctcccctcaccacccaccccgcaacaggccctgatgtgtgttgttcccctccctgtgtccatgtgttctcattgttcaactcccacttaggagtgaggacatgcattgtttggttttccgttcctgtgttagtttgctgaggatgatggcttccagcttcattcatgtccctgcaaaggacatgatctcattcctttttatgactgcatagtattccatggtgtatatgtaccagattttctttatcctgtctatcattgatgggcattcaggttggttccatgtctttgctattgtaaatagtactgcagtaaacatgcgtgtgcatgtgtctttatggtaaaatgaattatattcctttgggtatatactcagtaatgggatttctgggtcaaatgatatttctggttctagatccttgaggaatcgccacaccgtcttccacagtggttgaactaatttacattcccaccaacaatgtaaaagcgttcctatttctccacagccttgccagcatctattgtttcttgagtttttagtcatcgccattctgactggcatgagatggtatgtcactgtggttttgatttgcatttctctaatgatcagtgatgttgagctttttttcgtatgtttgttggccacataaatgtcttcttttgagaagtgtctgttcatatcttttgcccactttttgatggggttgtttgttttttcttgtttcagttccttgtagattctggatattagacctttgtcagatgggtagattgcaaaacttatctcctatgctgtaggttgcctgttcacgctgatgataatttcttttgctgtgcagaagttctttagtttaattagatcctatttgtcaatttttgcttttgttagaattgcttttggcattttcatcatgaagtctttgcccatgcctatgtcctgaatggtattgcctaggttttcttctagggtttttatggttttgggttttacatttaaatctttaatccatcttgagttaatttttgtataaagtataaggaaggggtccagtttcagttttctgcatatggctagccagttttcccagcaccatttattgaataggaaatcctttccccattgcttatttttgtcaggtttgttgaagagcagatggttgtatatgtgtggtgttatttctgaggtctctgttctgttccattggtctatatctctgttttggtaccagcaccatgctgtaaaacagcattttctgcctgttttttgttccatgcctcttatttattgaagaaaccagggagtccatttgtcctgtaaaatgtcccacattctgattttgcttccatgtggtgttactatgttgttttatcctctatttcctgttaaatagtttttttaatttttatttatttatttatttagacggagtcttactctgtcgcccaggctggagtgcagtggcacgatctcggctcactgcaacgtctgcctccctggttcaagcgattctgtaacctcagcctcccgagtagctgggattacaggcgcccaccaccccacccagctaaatttttttttttttaagtagagagggggtttcatcatgttggccatggtagagagggggtttcaccatgttggtctcaaactcctgacctcaggtgatccgcccatcttggcctctcgaagtgctgggattacaggcatgagctaccgcgcctggcctcctgtaaaatagtatgatgaaatttgcttttaattttaaatgaacacacagctccaagtcaatgttaggttctgggccaatatttggtttatgttacacctttcctattaagcaggtaatggacaatttcttctcaactgttgttgttagctgttttctaagtattaaagagactgagacatcaagctagaagttaattttctaaacacagttattattcctacataggaattattttgtgtaattttcctttctaataaaaattttattttatttatttatttttcagacaggttcttgctgtgttgcccaggctggagtgtagtggcatgatcatagctcactgcagcctcaaccttctgggctaaagtgatcctcttgcctcagcctcccaactagctaggactacaggtgcacaccactatgcctggataatttttttattttatttaattaatttatttatttctgagacggagtctcgctctgttgcctaggctggagtgcagtggcatgatctcggctcactgcaaccttcgcctcccgagttcaagcaattctcctgtctcagcctcccgagtagctgggactacaggcacccaccaccacacctggctaacttttgtatttttagtagagacggggtttcaccatattggtccgactggtctagaactcctgacctcaggtgatccacccgcctcggcatcccaaagtgctgggattacaggcatgagccactacgcctggccatttttttaaatttttggagagatgacgtctccctgtgatgcccaggctggtcctgaaatcctggcctcaagtggtactcctgcctcaggctcccaaagtactggcattacaggcatgagccaccacgtgtggcccctaataaaaattgagcttgtattccaaaagatccgaatgcattcagtctgtagttccctgtttcccaaagctctaaacataaattagtgccatgcagaaacagtttgtatatttgctcaggctgccattgcaaagtatcacaaactgggcggcttaaacaacagaaatatattgtttcacatttcttagggctagaagtctgagataaaggtgtcagtagggttgattccttctgagaactgtgagggaggatctgctccaggcctctgcccttggcttgttgatggctatcttcatgttcacatagtgttctccgtgtacatgtgtttgtttctaagtttctccttttcatgaaggacagcggtcatattggattagggcccaccctaatgacctcatcctaatctgcttgcttctgaatatattctgtctctaaataaggtcacatcctgaggcactggggattaggacttcaacacaggaatttgaggggacacaattcaacccataacagtctgctcacagttttttgttatatagctttatatttaattcctgatttgttaaacaggatatgagtcattggcacccagtaacaacttaactttctctgtagtgtcttaagtaaaaatcaataagaagaaattgagctgggcgtggtggttcgtgcctgtaattccagtgacttgagaggccaaagcaggaggatcacttgaggccaggagttcaagaccagcctgggcaacataagaagactccgtctttaaaaaaattttttttttaatttgctggccgggcacggtggctcacgcctgtaatcccagcactttggaaggccgaggcgggtggatcacctgaggtcaggagttcgagaccagcctgaccaacgtgaagaaaccccatctctactaaaaatataaaaattagccagacctggtgaggcatgcctgtaatcccagctactcgggaggctgaggcaggagaatcgcttgaacccgggaaccagaggttgcagtgagctgagattgtaccactgcactcactccagctggtgtgacaaagtaagactccttctccaaaaaaaaaaaatttaaatttgattttagtttacagattgtttcattctttcaacaagcctttattgggtactgtgcaggcactcagtaactaaaatctttcagatgtagtctcctcggagagcaaaagttggtaacttacagttcccatttttaccatgtatcctgaaaaatggaaagctaactttaacatccaagtataacaattctccttaaactaggtttctagtatactgtactctgcttcttacagttataatgcatggctgttgaccttttatacttattttaataatcttattttattataaaccatctcaaatccattttggaaataggcaagacataaatgaaaaagagtcaacactcttctcctaacaaccttcaatagctgattttagctaatgctccaactttcagtgggaggaatattaagcagaattctatctcagtttcacaaaactacctgctctgtacttgttgaccgaatgaactacaaaatactttgagtttcacactagaggagactatctatataatattaaattgaagaactatactaacaattacattttgctgaatttactgttattccattgcttttaaaagactaattatcttcttaaattaccttttccaattccctcattttctgtacctcattgtgtggtatcaaaatagtcacagttttaagactcaaagctctcgatttgatacctcattgtatggtatcaaaatagtcacaggtttaagactcaaagctcttgatttttcttcagttcttccttatttttctactgtatccaattaggcttctaatcctactaattcttccttgacaatatcctctttgttgtcactgctgcttccttcttctgtcccatgggtctagattactgaaataatatcccagtagattttctgtttctcccagtttatccaacttccacaatgaagaccaagataaatgttttttttttttggaacagagtctcgctctgtcgcccaggctggagtgcagtggcgcaatctcggctcactgcaacctctgccttctgggttcacgccattctcctgcctcagcctcccgtgtagctgggactacaggcacctgccaccacgcccagctaattttagtagagacggggtttcaccgtgttagccaggatggtctcgatctcctgacctcgtgatccaaccacctcggcctcccaaagtgctgggattacaggcacaagccactgtgcctggccaaattttttttttttaaaaaacatcattttcctccctctccctctccccctccccctcccccctccccccctcccccctccccctccctctccccacggtctccctctccctctctttccacagtctccctctgatgccgagcggaagctggactgtactgctgccatctcggctcactgcaacctccctgcctgattctcctgcctcagcctgccgagtgcctgcgattgcaggcgcgcgcagccacacctgactggttttcgtatttttttggtggagacggggtttcgctgtgttggccgggctggtctccagctcctaaccgcaagtgatctgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcatctctgcctggccgcccatcgtctgggaggtgaggagcccctctgcctggctgcccagtctggaaagtgaggagcgtctctgcccggccgccatcccatctaggaagtgaggagcgcctcttcccggccgccatcccatctaggaagtgaggagcgtctctgccccgctgccccgtctgggatgtgaggagcgcctctgcccggccgcgaccccgtctgggaggtgaggagcatctctgcccggccgccccgtctgagaagtgaggagaccctccgcctggcaaccgccccgtctgagaagtgaggagcccctccgcccagcagccgccccgtctgagaagtgaggagcccctccgcccggcagccacaccgtctgggaagtgaggagcgtctctgcccggcagccaccccgtccgggagggaggtgggggtcagcccccgccaggccagccgccccatccgggaggtgaggggtgcctctgcccagccgcccctactgggaagtgaggagcccctctgcccggccatccgccccatccaggagggaggtgggggggtcagtcccccgcccggccagccgccccgtccgggagggaggtgggggggtcagccccccgcccggccagccgcctcgtccgggaggtgaggggcgcctctgcccggccgcccctactgggaagtgaggagcccctctgcccggccagccgccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaattcttctgccttgggatcctgtagatctgtgaccttacccccaaccctgtgctctctgaaacatgtgctgtgtccactcagggttaaatggattaagggcggtgcaagatgtgctttgttaaacagatgcttgaaggcagcgtgctcgttaagagtcatcaccactccctattctcaagtacccagggacacaaacactgcggaaggccgcagggtcctctgcctaggaaaaccagagacctttgttcacttgtttatctgctgaccttccctccactattgtcctgagaccctgccaaatccccctctgcgagaaacacgcaagaatgatcaataaaaaaaaaaacaaaaaacaaaaacaaaacaaaaaaaacatcattttcactttcttccccccatacaaaatgtcacaatggcttcccattacctattgaataataataaaaatagctaatatgtgttaagcactgaactgtttgccaggcagtgtgatgagaactgtacagccacctcatcatcctcattcttatcgtcatcttcatatggatgaagaaactgacgctcaggtgacgtcacctgcctaagtttgcacaggtagtaggttatagagctgggatttgactcagttctgtttgtctccaaagccggggtcctgacaatgacgtgattctgcccaaattctttaaattcaaactgtttgattatttaagaacctgtaaaactggccctgtcttacctctcctgttttctctctcattactttgtagcacaaactcagtttcagccaaggtagtctcactatctccaaatctgttgtatttttttccctctcctaaacttttgttcatatgggttcttctgcttggaatacccttccctctactcactgcttgttcatattttatacatctttgaaggactaggtcaaatatttatttatgtatttatttatttattgagacagggtctcatattgttgccaggctggagtgcagtggcacaattgtggctcactgcagcttcaatctcccaggctcaaaagatcctcccacttcagcctcctgagtagctaggtctactgacatgtgtaccacatgtgcccggctaatttttttttttcttttagtagagatgaggtcttgttgttacccaggctgatctcgaactcgtgagctcaaggattcctcctgccttggcttcccaaagtgctgggattacaggcataagccactgtgcgtggccaaattttaattctttcgcacaactcacaccactcttctattatggactaccccaaacatgtattatttatactatagacgaaaatctttaaactcttttgatcacacatcacatcaggagaaaatgtttgagtacatgcctccaacataggtacactgcatttacttatacattttggacatataccactgtgctattatgtgaatcatagaatatatataaagtagaaatataaaaaaggatgagataaggatgaaacgatgtttttagaaaatttaaaaatttggctgggtgcagtggctcacgcctgtaatcccagcactttgggaagcagaggtgggtagatcatctgaggtcaagagtttgagaccagctggccaacatggtgaaaccccatctctactaaaaatgcaaaaattaactgggtgtggtggcatgcacctgtaattccagctactcgggagtctgaggcaggagaatcgcttgaacctgggaggcagaggttgtactgagccgagatcgtgtcactgctctccagcctgggcaacagagtgagattctgtcaccaaaaaaaaataaaaataaaaataaataaaaaaataaaatcccagttacttaggaagctgagacatgagaatcacttaaacctgggaggcagaggtttcagtgagctgagattgcaccactgcactccagcctgtgtgacagagtgagatcctgtctcaaaaaatatataaaagcaacaacaaaaaaactatcctaatgggggtaaagtggcatctcattgtggttttggtttgcatttccataatgacaaatgatgttgagcatcttttcatgtgctttttggtcatttgtatgtattctttggagaaacattcagtctctttactcatattttaattgggttggtttttgttgtcactgtgtggtaggagttctgtatatattttggatattcattccttttcagatatatgatttgcagatatcttctccaattatccagttgtcttttcactctcttgatagtgtcatttgatgcacaaaagtttttttaatttctctgggcgcggtggctcacacctgtaatcctagcactttgggaggccgaggtgggtggatcacgaggtcaggagatcgagaccatcctgtctaacatggtgaaaccccgtctctactaaaaatacaaaaaattagctgggcgtggtggtgggcacctgtagtcccagctactcaggaggctgaatcgggagaatggtgtgaacctgggaggtggagcttgcagtgagccgagatcgcgccactgcattccagcctaggcaacagagcgagactccgtctcaaaaaaaagtccgggcacagtggctcacgcctgtaatcccagcactttgggaggctgaggcaggtggatcacctgaggtcaggagtttgaaaccagcctggccaacacggtgaaaccccatctctgctaaacatacaaaaattagctgggtgtggtggcgggtgcctgtaatcccagctgctcaggaggctgaggcaggagaattgcttgaatccgggaggcagaggttgcagtgagctgagattgcgccattgcactccagcctgggcaacaggagcaaaactccgtctcaaaaaaaaaaaagcattaatttggccgggcgccatggctcacacctgtaatcccagcactttgggaggccaagacgggcggatcacaaggtcaggagttcaagaccagcctgaccaacacgtgaagccccatctctactaaaaatacaaaaattagccgggcctggtggcatgcgcctgtaatccaagctactcaggaggctgagacaggagaatcgcttgaacccaggaggcagaggttgcaggagccgagatcacaccattgcactctagcctggccaacagagtgacacgccatctcagaaaaaaaaaaaagttttttaattttgatgaagaccagtttatctgttttttttctcttgttgcctgtgcctttggtatcatatccaagaaatcattgtgaaatccagtgtcatgaagatttaaccttatgttatcttctaagagatttagagttttatcttttaagttaaagtctttaattcatttcgagtgaatttctgcatagggtaaaaaaaaaaaagggggttcaacttcattcttttgcatgtagagctccagttttctaaacatcatttgttgaaaagattgtcctttccccattgaatggtcctggcatcactgttgaaaaccatttgatcatgtattatgtaaaggcttatttctttttttttttttttttttttttgagacggagtctcgctctgtcgcccaggctaaagtgcagtggcgtgatctcggctcactgcaagctccgcctcccgggttcacgcaattctcctgcctcagcctcccgagtagctgggactacatgcccctgccaccacgcccaactaattttttgtacttttagtagagacggggtttcaccatgttagccaggatggtctcaatctcctgacctcgtgatccgcccacctcggccgcccaaagtgctgggattacaggcgtgagccaccgcgcccggcttgaaggcttatttctgtgcgctctattctgttccattgctatatgcatgttcttttttttttttttttttttttgagacagagtgttgctctctgtcattcaggctggagtacagtagtgcaatttcagctcactgcaacctttgcctccaggattcaagcaattcttgtgcctcagcctcctgagtagctgggattacaggtgtatgctaccacacttggctacattttgtatttttggtagagaagaggtttcaccatgttggccagactggtctcgaactcccaacctcaggtgattcgcctgcctcggcctcacaaagtgctggtatgcatctgttcttatgccagaactacactgttttgactatgtagttttgtaggaagttttgaaatcagaaagtatgaatcctccagctttgtgcatcttttcaaagactgctttggctatttggggtcctttaatattccatatgaattttcagatgggtttttctgtttctgtaaaaaatgtgattgggactttggtaaggggcgcattgcatctgttgatcactttgggtggaattgtcatctaaacattgtcccaatccatgaacatgaatgtctttctgtaggtgggttattaaaaaaaaaaaactacctatgtgaaaatgatacttgtatattaataaaaagtcaaataatatagcaatgtacaaaggaagaaagaacacattactccagatctcactactcattgataaccactgttaagtttctggtgaacatctttctgagcacctctcttacaattttacataaataggatccatttgtctcccatttaatatgtaatagttgttttctgatgtcaatgactagatttaaattatgtttgtctcatcatttacttaagcaaacttaccctgatagacatttaatttgttgtctgtgtactgtgagtaatttttattaatatcatagtattaatggccatccatagctattgtggactagtttcttctctgtcctagtagacctttaaaaagtttagggaaaactgtataattttgaatgcttaatgttgttgcttttgaataaagaaaagtacaaagtttttcatctaatcagttcctgcatatctgatgtactgtaatgcataaataatagatctttggtgtgataatttgtgaagcaataaagggcagagaaccagatacttgtttagagatttatttattctctagttcttctatagcctagtgaataaaaataatggtgcatccaaatgaaatcaaattttataaaaccataggaactgggtattcagtttattctcattttcctacctttacaggaagaagccatggatttaataaatagagaaacaatgtctgaatggtgagtactgtactttgaattactattctgataatttgtatacttaattatatcttttctttcagataggcaaactgcagttttgatttcttttgtaggaagctacaaagtgagatacagataagtcactcttgggaagaaggcttgaaactggtatgatattataacttcagttttgtagaaaatttcaaatttttactgacttacagtgtcggcatatctagttttgctgtaatttctagaaatctaagctctattttgaaacaaaaattgtatctgttgcataaataatttttgagtgctctttttaatttttttttttgagacaaggtctcactatgttgtccaggctggtcttgaactcctgagctcaatggatcgtcctgcctcaacctcccaaaatgctaggattacaggcttgagccattgcgcctagcccttgattgctcttcagaaatacttcatgatttactcataaaaatagctatcattatttgaaagtggggttcaaagtaaacagttttgtgacacaaaaccatagctattgtggaccagtttcttctctgtcctagtaggcataataaaagttcagttgcactagttaaagtgcttagataacaaaacaataaatgatttcactcccttctccataatttatgaactatatattaggagtcttaaaccacagacaatagactctctagaaaattattgcatttttatgcctgtgtgttagtccgttctcacattgctataaggaaatacccaagactgggtaatttacaaaggaaagaggtttaattgactcacagttctgcatggctggggaggcctcaggaaacttacgattatggcagaaggcacctcttcacagggcggcaggagatagaatgagtgccagcaggggaaattccagatgcttataaagccgtcaaatctcgtgagaactcactcactaccacgagaacagcattggggaatttgcccccatgattctattacctcccaccaggttccttccacaacacgtggggattatggggattacagttcaagatgagatttgagtggggacacagccacaccattatcagcctgtaacacattctcccactaacattttaatataaaacctttaatttaaacatacttagaatttagtttcatctcttgttaacatttttaaatgtctgtgtgcacactgtggttacctagttgtggtagctgaatgatatttagtgttcttttctatggacatcccagatagtgacaaaacaagtactgagctgaaaattgaataggagagattctaactaatgtcaatcttcagatttgggaattatttgatatggaaatggatcatcagcagaagcaatggcattttattttcctttgagccctgagtaccttacatgagcagttatccctgattttggagtaggtccaggagaatgagtaggtcatctctggagcctgtcactttttgtgttttggtgctaatacaattgatcgatactgctggagtcctttaactggcccaattctaattactttaggtattggcatggatgagtaagagaatcgtaagtgtgttaggaagaggaagggcacatgtaatacacacttggcttgttttagaaagaaaagggcagattttaaaatcctgaattatgaagtactgattttgtctatgtaaaatctagagacaatttccataaatgtagttattcctgctgtctcatttgcttctaagttctagccaaaacctttttggtcctttcctggatgtagtattatagttttcaataacaaagcacaggtcaaagccaaagagaagagcttaaatttaggatttgtgtttatagtgttgagtactcacattctaggactttctggcatgctgggaagcccctcaatcaccatatagccctcatccccaaaagggaaaagggtgcctttgcttattgaagtgaattttgggttccctgattgctttaggatggcgagagctcttcaccatggtgcagccagtgactcagtagtaaggactcacttccctgtgcaacaggtatctcaagtatttgattaataagcaattggtgctacaattgtacactgctttctgcttacacagaatgacaatggcttacagaaatcatcctctctaaagtgcattgatttaactccagtatcctcaatggcttcttccatcaagaagactgggaaggtaagaaaggagtacctaaaagtctatgtctcttgaaatagttaggaaatatttaggaacattaatggtcaccaaaacaaatattttgggggatatattttgtcacagtacatctgattctaactaacatttttcccttctttttcatttcttcaagtattacttacatgtaataaaattcaccaactttaaagcatagggttagattaattttggtaattgtgtacaatcctgtagccacaaccataatcaagatattgaacagttcccacactcaaaacaatttcctaatgatcttttgtaccccagtctccctccctaccatccctgcccctccctaggaaaccaatgatctgctttccgagaaaagtggcggttttaaaacctctgttccaatttgattttagcagtgtttctctccatcattacaaacttgtgtgagttgcactggttcgccttcaagtcctattcccagtcctatgcaacaatacatcatgtaagtttatgttatatgaaaataccaaattgcttataaaataagaattatagaaacctaaaagaaattatagctccaagttttgtgccaaccaaagaagtgacttctttttagggaaattaaaatgtcattgtttcggctgggcacggtggctcctgcctgtaatcccagcactttgggaggccgaggcgggtggatcacctgaggtaggaagttcaagaccagcctgagcaacatggagaaaccccgtctctactaaaaatacaaaaatagccgggcatggtggtgcatgtctgtaatcccagctactcaggaggctgaggcaggagaatcgtttgaacccaggaggtggaggttgtggtgagctgagatcgtgccattgccctccagcctgggcaacaagagcaaaactccatctcaaaaaaaaaaaaaagtcactgtttcagtttatcattttgtatattgaaaaagtcaggtgactaagaacataagaagaatttagtaattccttcaccctgctaatacataatctttctctaaccaagtttgttaataaggatcagagctatctctagaactttaaacaacttcatccgtgattctcaccttcattcaaggcaagtcccagccaggaatgtaggtttttgtagactctaggattcaaaatcctgaatccttgagaattagaagatagtttgctcctaaggcattccagtttttacccatatgtaaagaaaagcagtaaaatggccgagcatggtggctcacacctgtaatcccaacacttttggaggccaaggcaggcagatcacctaaggtcaggagttcgagaccagcctggccaacatggtgaaaccctgtgtctactaaaaaaatacaaaattagccgagtgtggtggtgcatgcctgtaatcccagctacttgggaggctgaggcaggagaatcacttgaacccaggaggcggaggctgcagtgagcttaaatcacgccactgcactccagcctcggtgacaagagccaaactgcatctcagaaaaaaagtaaaaataaaaacaaagaaaagcagtaaaatgatgtaatatcctacacagagtcccgtttttgtgtatgtccttagatctgttataatgaaatagtcattgttgattttgttaaaaaaaatttcttataatgatcatgatgattttattttagaagaagtcaaaatcctaccaacattattagaccaagtatccttggaccattaaaaagaaaaggtacttttatctaacagtagaagtaaatataactttaagttattttataaaatatctaaaatcaaatgttatacaaaaatgtatttttaaaggctttatttatttaaaatatatttaataagctattagaggcctttcattttatgcaactagaaatatgtataaggacattttgaaaactctaaaatgctatataaatgtgaattgagaaatttaattccaatttagttggctattaggattttcaatataattcaccaaggtagctatcttcattactttctaaaacaatgtagagaataaatgaatgaatgaacagagtgagtcagtcatcaagtattttgctgaatgtcaacccctgcctcactgccacacacacacattgctatcatatgaataagttgacacaaattagatccacttacaacactaaaaatatatatgaaggtgtatgttctttggtgtttagtttctttatgggagttatttttggttaaatatatggaaagtgacccacctactcagtaataaaagggcagtggaaagaataaaagggcagtggaaagatgtcttttttaaaaactcctgcaatcctggatcccacttctcaatggtacctcactaaattatgctcttcttccttttttttttttttttttcttgagacagagtcttgctctgtcacccaggctggagtgcagtggcacaatcttggctcactgcaacctcttcctcccgggttcaagcgattctcctgcctcagcctcaccagtagctgggattacaggtgcctgccaccatgcccagctaatttttttgtatttttagtagagacagagtttcaccatgttggccaggctgttctcgaactcctgacctcaggtgatccacccacctcggcctcccaaagtgctgagattgcaagcataagcctgtatatttagtacaatttttgactacaatggggaggggaaatgggtgaataggaaaggagattaaacttaaaaatgtgtattgtgaaaaatctattaaggtaagaaagaggagtaagaagaataagaggagagaaactgaaatatgctttaatgttctttgtatattttcgattaattaatggcagtcttcctaacaacataactaactcagcatgtactttttgtattctaagattaagggctagataaattctggaaaatactcttttccaaagtaagcacattgttttatgaagatgcttcggttactaagcttaggggtcttttacctgtgctgtgaaattcgggctagtgttgaaaaaatattcaaatatatcagcagtttaagagctgttagaagtcaagggtcaattgagtatttaaaataaagtacgcttaaattgaggagtgttttaccagattaaaatagttctccttttgagacatgtatacataaataggttatcacatgaaaagtatctcgagttttcttagaatttatgattgaaaaattatttttatagatcaattttaacataaaagatgtagtttctgcccagtgtcttcggagatgtgacctgtctcacacttggttttcagctgctctgaaagacgactgccttattcctttgaggtgtccctgagggaactccaaagcgaattctgtatataccacctagtccatattttcagtcataccccaccctccaaagcatgccctgtacaaatgtgctgaaaattcatttggccatttttggccagatacaataacagataaacagaaattgaaatttattcatatattttggaatatgcatattcatttgggaaacaacaaactatgtcctatttggaccccattaatacaaatgaaatgtgggagaaaggtaccataaaaataaaagagaggtcctgaggcagggggcggggggaactaaaaagaatgatgattatgtgaagtgagatcaagattagagtctccaaagcatatgatgtcatattttatggtgagaagcagcagtgacttccattaggaataagcaagagcatgggccgggcacagtggctcatgcctgtaatcccagcactttgggaggccgaggcgggcggatgacttgaggtcaggaattcaagaccagcctggccaacatgacaaaaccctgtctctactaaaaatacaaaaattagccaagggtggtggtgtgtgcctgtaatcccagctactcaggagactgaggcaggagaatcgcctgaatccaggaggcggaagttgcagtgagccgagatcacaccactgcactccagcctggacaacagagtaagactctgtctggaaaaaaaaaaaaaaaggaataagcgagagcaaataagccttcacatcggaatactgcagaaattgggcagctataaatatcgtttgacaagtaatgctggttttagcaaagaaagatctaattttcttttatgaggaatatgttttgatttgtcatgttttcaatgttaaaccaaaaaagagagctgagtagtttttctgtagtgacataaatgtaatctggcaaggcacgggacaccagacttcttttaaactttatgagccatgattacacttctgtggaaggtctatgcaatatcttaatggtgaccttagggttttatcattcaaatagaagttatgggcttgaatgtcagttttgctcaggtccagaaatgattatcatatgaatgtgaaacactgtgcagattttaacatttacttcaaggcaaagattacaaaaatgcagttgttgttttttttgagattagatgttctaccttaatctctaaagatacaattattttgttcattgtgtgctgtaaaagaacttacctatttagttcattgtgtacatttagcaaaataaagatagcaacaacctaaagttttaaaataaggaatgacattaaactcattaaacagccttactacatagctatatcaaatcatcttgcaggccgggcacagtggctcacgcctgtaatcccagcattttgggaggccaaggtgggtggatcacctgaggccaggaatttgagaccagcctggccaacatggtgaaaccccgtctctactaaaaatataaaaaatagctgggcatggtggtttgcacctgtaatcccagctactctggaggctgaagcacgagaattgctggaacctgggaggtggaggttgaagtgagcccagatcatgccactgcactccagcctgggtgacagagcgacttcttcacaaaataataataataataataataatatcatcttatagaatttagttaataatataagaaaattataatcattgaaaacaaaaagtaaatctaaaaacattatatacggtacaaacccaattttatttaaaaaacaattgtgtatacaacatattcaaaaattactaaagaatggttatgtctggataatgattacttaaaattgttttctttgtgcttttctgtattttataaattaattgcagtgaataagtattacttttgcaattaaaataataataaacatgttaaataaaacatctaccttgatctgctgtattgtcataggtgaaatggcatttcaatatcaaccaaaaaagattttccaaggcacaaccaacatgctttcttctgatacttcccaactgtcagaaaataatgtgtagtgagtattaacatgagattttaaacattcattgatcatttttgcttcgttgttaagtctactttggctattgtacgtattcagaagtatggtacattattaactgttcttagaagttttaaaactaatattccaagtggatactataaacctgagttattttattttcttttttttctttttctgaggcagggtctcactctgtcacccaggctgggaatgcagtggcacaatcttggctcactgcaacctccacctcccaggctcaagcagtcctcccacctcagcctcctgagtagctgggaccacagtagctgtgcaccaccgcgcctggctaatttttgtattttttgtagagatggggtttttccatgttgcccaggctggtctcaaactcctgagctcaagcaatccgcttgccttggcctcctaaagtgctgggattacaggcgtgagtcacgtcacctggcagagtgtttttcttatgagatgtgtgtgacactaatatatggtggatacatttttagaagtgagattttggcattagattaagagatattagagaaatacataaaaatgcatccttggaaaaagtcatcttctgcccatcttccttggatttttgtctaccttgttgggttgagagtattattgaaaagcatgcctaagaaagcatgtcttaatgataaaaataggaaatactggaatagatttctttctttttttttttttgttttgttttagacggagtctcgctctgtctcccaggctggagtgcagtggcaccatctcggcttactgcaacctctacctcctgggttcaaacaattctcctgcctcagcctcctgagtagctgggactacaggcgtgtgccaccacacctggctaatttttgtatttttagtatagatggggtttcaccttattggtcaggccggtcttgaactcctgacctcgtgatccacctgccttggccttgcaaagtgcttggattacaggcataagccaccacacctggccatggatttctatttattgttactggtggtttcattgtatgactcttaaaaaactttgcttgtgacaagtgccagttgttagtcatgtattttgcattcatgtgtagacaaagcagagtatacagagagatctcttgagttctgctatcaatgagtggcattttcttcttctagtctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaagtaaaatgatgtttgacaattatgt

SEQ ID NO: 3750 - DNA, 47397 bp, human
cgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttgggtgagccgggttgagatactggaggaggcaagcggtggggaggaggtgttcgggaaagtgatttcctatagaattcccgtccctttatttgttgaggttctgcaggtaactcccttgttcctggtgtccggagatcccaccctcaaccttgggtgggggtagtgggacgggctgacctgagggggagcgcgcacccaccctgaggttgacaaacatctgaatctgaacatcctcccctgatagtccactcggacccgaaagtagcagccagttggtgtggagcacggcttttttctaacttcaacccatttcttacccactcctttgaagaaacttagtatcctcccccactcacctccagatcttctgccatgactgtaatatttgtcatttcagctgctttgtcacctctgaccttcacctccagccgcttgaatggaaatggttgtcaagcaaataagctttggacttttttacatttttttttttgtctttttttgagacggagtcttgctctgtcgcccaggctggagtgcattggcacgatctcagcttactgtaacctccgcctcctggcttcaagcaattctcatgcctcagcctccctagtagctaggattacaggcgcccaccaccacacctggtaattttttgtatttttattttttatttatttgtttatttatttttgagacggagtctcactctgtcgcccaggctggagtgcagtggcgtgatctcggctcactgcaagctccacctcccgggttcacgccattctcctgactcagcctcccaagtagctgggactacaggcgcccaccaacactcccggctaattttttgtatttttagtagagacagggtttcaccgtgttagtcaggatggtcttgatctcctgacctcgtgatccgcccgcctcggcctcccaaagtgctgggattacaggcgtaagccaccgtgcccggcctaattttttgtatttttagtagagacagggtttcaccatgttggccaggctggtctcgaactcctggcctcaggggatccgcctgcctcagcctcccaaagtgctggtattacagacgtgagccactgctcctggcctacacctattttttattggagcagaaagttttggtaccacagaagcttgatctcctaaattacacattctcactgggtgatacttcccccaaggggaagagaaaatagttcttgggggagtgtgaaaaatttttactctttttatgtataaagcgcagatatacatacagtatgtacacagatatatactatatatgtgttattaaaatttcacgaagggggagcaattaggggaaaaatgtctaaaaaggctttttagagggtcaataatgaaaaaaggatttagaaacactacactaaatgatggttaactgtatttctgaagatctgggattactaaatcttgtttccttttttttttttttttaagacggagtctcactgtgtcgcccaggctggagtgcagtggcatgatctcggctcactgcaacctctgcctcccgggttcaagcgattctcctgcctcagactcccgagtagctgggacttcaggcacccgccaccacgcccacctaattttttgtatttttagtagagacggggtttcaccgtgttagccaggatggtcttgatctcctgaccttgtgatccgcccaccttggcctcccaaagtgttgggattacaggcgtgagccactgcgcctggcctaaatcttacttcttaaactagacttttaaaatgagatgttggatttcacatttcagtattataaggttttctagataccgtaaaaatgtctgaaaaatgcattcactacatatgttactaactttgctcttcaccttttgttgcatcatactaattgatagttgtaattcacagtaccatagactatcaggaagggattcagagaccagctttaccctccttgtttaacatatgaggaaactgaggcccataaatctccaaaatgacgtttagtggcagagccagtactaggaagctctgtttcctgactcctaaactactgttctggccactactaaccaatacctaagctgattaactctaaatgaatgcagcttttgggtcatttgaggtaggagagaatatattgttcacaaaatgaaaagcaaactaagattgaccaaaaaaaaatacattacctttttaaaataggcaggtagaaaaacatagaagggggactctgcatgttgtgctgagaacaagaacattttattcactcaggattttgctctaattctgttgtgggaaaaaggaattatgggacccactctactagtagaagagagcagtagggagaatgttggatttattgaagacaatataaaaagaagaaataggttgcaaatagacgatggaagatgtgtactggaaggaacctgtggatcctctttaatgtattaaatacaccagagaaggagtggacccttccctaatccttaaagccctggaaacagagagatctcagttatcccttcataccttgctttgttctgcaaaggatttttttgttttgtttgtttgttttttgcttatattagagcatagctacagtgttacattccatagcttaagatcctgatgcatgaagtaaaatttgtacagaaagataagggtcactagcatatttctgtagtaggagtttaaagatacagaaaccacaaagtggacggagtccagggactctagtctgtcagaaagaagtaacataggaatgatgtgtgacatccctgagattaggggacttgcccagatgatctgagggcatattttgtgctgttgtagaaaatgtagggcatagtcagagaagttattctgaagcaagaaaaatttagagtaggattacactgagccttagttgaattcattttcacctcagttctcatttgcatatgtatactgctcacttttctccctttttttttccttccttggccctctaatacttgagtacttcctctttctaaactatacctggccagtaaagcattcttttcagaaaggtgaaagtcactagcatatttctttagtaggaattaaagatatagaaaccacaaagtggacagagttcagagactccagtccctcagaaagaagtaacataggaatgatgtgtgacatgcctgaggtcagggaacttgcccaaatgatctgaggggatgttttgtgctgttgtagaaaatatttagcttgctaaacattgttgcacctctttcaagtaattttcgaactttgcttgatgtttcttctatataaagaccctcttgcaccagcatttgcagaattaaattccttaggtttgtttctttcatatcaactctttaatacagtattactgttttaaagaagtatctgcactgttttatgtatatcttgaactaataaaaattccaacgtcaaaagttttgaacctcttggttctttatactctttatctctgtaattggctgactttattactggtgtcaataactatacttaaagctaggagttttttcttctctttctctgacccttattcaaagactcagagattaggttcttgtattcctgccagtgcctccctaccttaaaaacctctaccttgaccctgcatttaaactgttactgcctcaattcttttttttttttttcctgagatggagtcttgaggctggagtgcagtggttcaatctcggctcactgcaacctctgcctcctgggctcaagcgattctcctgcctcagcctccgagtagctgggactacaggcatgcaccaccacgccaggctaatttttgtatttttagtagagacgggtttcactatgttggccaggctaatttttgtatttttagtagagatgggtttcactatgttggccaggctagtcttgaacccttgaccttgtgatccacccaccttggcctcccaaagtgctgggattacaggcgtgagccaccactcctgaccctcaattctatttgaaaggcaaattactgccccagagccaaatgcagcccaccacctggatttgcaaataaaattttattggaatggaaccatccccatttgtttagttgttatctatggctactttcccactgcagtggcagaactgaggagttgcaacagatactgtatggcccacaaatcctaaaatatttactctctggcccttcgcagaaaaagtttgcccatcttctggtttattgaacttttacgaacgtggaagaatagcagccatgagaaatgattgctttgggaatataagtgacataaatctattatagtttagacagagctgtttattgatcatttgatgtggaacattgaacatccatccagttatactacttctgctttttccgagttaaaagtagcacttagttcagatatcagctagggttttataaattcatgttgaatgatgcataccagttgaagtatatattgcctgaattctttctttcagttatagtcttactaaaattggcaaacaaatttagggtagactatatcattgtcagccctaagtattaagccccctacacatgtacacaaaaaagaatggaaagaaatagcccattagtgtccctccaattttcttatgagtgactgccagaacatattcctattctcacaaagaaaatgactgggaaagtaagtagaattagatacatccatataccttccattcacaaaatattaagttactgcctgttatatgcaaattatgatgttgcaaagatgtatctcagggctcaataagctttaatagggaatataaatactagaaggacttaaatatatggtagagtaagataagtgcgtagggagcttaagataagtgcgtagggagctaaataaagtgctaggggaattcaaagaaggaagggagaaattacagcgggactggtgagggagaaggaaaagtttatgaagaagttggcatttgagatgggccttcatggattgataggatacaccctggaaaagagggggaacaatggttgggatagtattttaagtattatatgtagaacagacttgaaggcagaaaagcatagatgtgttccagagaactgaatggtccactttgcctgaacccctgactcccagatgttcatctgctgatcagtgctgatctcaggtgaagtttttaccaatccgtgcttttaaaagagttaagtacagcataattaaagatgtcattatgtagttgttaattatctttcctgggcaggactgtactgtactctgagattgttattctcttattttcttaataccaaagggtcattttacaaatgaaatgatggtattggtcaatggtgggatttaaaaaaaaatgacttggcaaaagaaaaaggtggcaactgtatgtttctgcctagattttgttttgaaattgtactagtccttgaaattgaagagtctggagccaaaccgtggatggctttgaatgtcatagtaaagaacgtaactgaatttgacaggcactgaagagagtcactgaaagttgtgagcaaactgttctttaggaagatgcccctggtagtctgttagcctagagaagggaaagaagagaggcgaggagcccaattagactatgcagtctgtggaaaaggaaaaagaccttgaattggtttttggcaaggagcctgacaagaatcaggtggttatcagagagcgagtatagaggtaaaatctaaaatactggcagttgattggatataggcagctaaaacaaaagtattacagatgatttctcacattggaggaacctggatgaagggtacatgtgaaccatctgtattctttttgcaacttcttgtgagtcttaaaccgtttcaaaataaaaagttataataaaaaggaaaagatgccgggcaccgctgggatctgtagtcctagctacttgagaggctgaggcaggagcatcgttgagcctaggagtttgagggcagcctaggcaatatacagcgggacgacatctctgaaaaaacaatgaaatgatgatttcttcaggattacaaggtcaaataggaccaagttcacttgagtgggcaaccatcaaagctgaggacactgacctgtcttcagtgggcatcagctgcacaacttcagtccattgttatcatgggaatgtggcccagtgttgcaaaatcttgcaacttttcaatagaagccagaacgttggaatctgggtgttttttttttttttaatgtgaaatctttcagtgtgcaaaacaaattcaaaaacatttttaacactgtaggccaaaccaaacacatctgtgaaaaatctgagttccatcaacccctgctattggttattcctcgtattcatgtgaaactttgggagttgagagggaattggtatttgcacgttgtatctctgaccataaatttaaatcatttacaggtttacactgaaaatgatgtatttccaagttcacaataaattatattcattctccgtagcatgattaggagtaaagtagtgtgcttgagaattccttaccttatatggagacttgtttaggcccagccaaccaaggctgtatgtgtgtgtgtgttttaatttctacctttgcacagcttgcctttacccttgctgtttaggtatttgaaatctttaaaagaattttgtggccgggcatggtggatcacgcctgtaatcccagcactttggtgggccaaggcgggtggatcacctgaggtcaggagttcaagaccagcctggccaacatggtgaaacctcgtctctactaaaaatacaaaaattagctgggcatggtggtgcgtgcctgtaatcccagctactaggggaggctgaggtaggaggattgcttgaacctgggaggcagaggttgcagtgagctgagatcgtgccactgcactccagcctgggcaacagaacagagcgagactccgtctcaaaaaaaaaaaaaaaaagaattttgtaatggattttatataacacatgtttttgtttttctttttagttttaattcacaggtgttgcaagctgacatgttaagaattaggacaaacagaacaacatttaggaatcgacgctctctggtaaggaaatgcttatagtggcctccctgtctaagacttgtgcttattggtctcaaccaatggtcttcaaacttgagcattcacagggagggcttattaaaacacagatggccagcgggagtctcacccccagggtttctgattaagtagatgggggtggagcatgagaatttgcatttctaacaagttcccactttgagaaacactgctctaaacattactgaaggaaaaataaacacattgactacagttatgattgctgcagctgcaacagaattaatttttaaatcccatatggatttaacatcgagattttatgtataagaccatctggtttcccttttttttttttaaagaaaattctaactttgagaggaaaatttgcagactctcctaaaagtaattttcaggcttttagacttttatctcacatttatcttgaattgtaaataagatttgcttttcatggtattatcatgcaatctctaaattataactcttttctactaattatcctgtaaacatagggaatatacttgtagatcagtaagccaaggtgaatacatgattcattatatgattttattgaggtgaaattcacataacattcaattaactgttttaaaatatacaattcaatggcatttagtgtattcacaatgttgttcaaccagtacctctctctagtttctaaagtgcatacatatccttgtcttgttcctcatcattgaatatgattttagctgtgagtttttggtaaatgtcctttatcatgttaaggaaatgtccttctactcctacttgctgagtatttttctttttcttttctttttttttttcttttttttgagacagagtctcactttgtcacccaggctggagtgcagtgacatgatctcggctcactgcaacctctacctcctgggttcaagctattcttctggtcagcctcccaagtagctgggactacaggcgtgcaccaccatgcccagctaatttttttgtatttttagtagagacaggatttcaccatgttggccaggctggtctcgaactcttgacctcaagtgatctgcccacctcggcatcccaaagtgctgggattacaggtgtgagccattgaatccagccttgctgagtatttttatcatgaaagtgtgttgaattatttcaagtgctttttctgcatctcttgggatgatcatgtgtttccccaccttgttcaattaatatggtatattacattgatttttttccatgttgaattacccttgcattcctgggataaatctttttgtatctgtattcataagagatattgacctgttgttttcttgtggtatcttttgctagctttggtatcagagtaatgctggcgtcatagaatgtattaggaggtactcctttgtcttctacttttgtaagagcttgagtaggattttatgttgattcttgttttttgtttgtttgtttttgtttttgtctttttgagatggagttttgctctttttgcccagctggagtgcagtggcacgatcttggctcactgcaatctctgcctcccgggttcaggcgattctcctgcctcagcctcctgagtagctgggattacaggcacccgccaccacgcccagctaattttttgtacttttagtagagacggggtttcatcatgttggccaggctagtctcaaactcctgacctcaggtgatccacccgccttggcctcccaaagtgcagggattacaggtgtgagccactgtgcctggcctggtgttgattctttaaatgtttagtagagttcagcattgaaaccatctggtcctggacatttctttgttgggaagtttttgattacagactctatctcttgttataggtttgttgagattttctatttcttgaatcagtttggtaatttatgtgttatgtgttatgtattatagatttctcttataatatgatttgtaatgtgatagaatctctagaatacattttagtgaaatgttatagcttgataccaatttaaaaatattgctcgtggccaggcgtggtggcttacacctgtaatcccaacactttgggaggccaaggcgggaggatcacctgaggtcaggagttcaagaccagcctggccaacatggtgaaaccccatctctaccaaaaatacaaaattagttggatgtggtggtgcatgcctgtaatcccagctactggggaggctgaggcaggagaatcgcttcaacccgggagttggaggttgtgagccaagatcgcgccactgcactccagcctggtgacagagtgagactttctctcaaaacaaacaaacaaacaaacaaaaacaaaaaaaaatattgcttgctaatcttaaaactggacattttcttcttcatagaatgatattcaatattgttcccacaaatgcattaattttatagtgggagaaattataactgttcattaaataaatatttcttctttctactcatttactcatccattcaacgatatttgttgagcacctgcttgcctctcaaagccttccatacctatccagtcttctactcaacgaagccaacatagtggtttaggacccactatgtattaggccctgatctagttgccagggttgatctaactgagtttggggaggagataacatcttagttgagatcttactgatgtgagagggttagctagtttgggatattggtggcaggggtagacaatattcctggtagaaaacagcatgcttgaagtcctggaaaaggaagtgtggtgtatagataaaagagtgtgtataaaatttgaaagaagtgcattttagctacagtgaaagcaaagatacagtggtgagagatgtggttgaagaagtagactagtgcaatatcttgtagggccttcaagtcatgttaagtattttgcactttatcctagggtcagtgagaagccattgaagagttttgagccaatgattgacatgatcagatttgttaaaagattgccctggctgcagagtggaaagtggattggaagagggcaaacgtatatgcaagaagatcagataggctactgcaatcaccctggcaaagagctgatggtagcttggactagtgtgatggtagtggaaatagagaaaagttccagattcaggagaaatttcaaagatggaatcaatggacggtgggaaacagtggaggcaaacctgactcctaggtctctagcttgggcagctgatgggatggtagtgacacagaataagaagggaccattgcaagaagagtagatttacaaaggaggatgagtttagctttgtacatgttacattggaggttctcttggacctgtaaactagtgatgttcgatgtactagtttgaagctcaggagtgagagctggactagagataaccatttgggaatcattggtagattgttatttaaaactgtgggaattaatgatatgacctacaaagagagtatagaaagagcagagaagaagttgcaggacaaaactttaaaaatcaccaacacttaaaaatcagtcagaagaagagtgatggactaagtagagaggcaggaggaggcttcagaagagagtagtaccatgaaaaaacaaggaaaagtagtaagtcatatgctgtcaagccgtcaaacagactgaaaagtgtcctttgaattaccaaaacagatattactcatgaattcttatatttgaaagcactttcagtagaaggaggagtggggtgagattaagccagatttgattttgaagaataactgagagccaaggacctataaatggcactgtacatccaggctcagttatttgggaggcaaatccctcatctgtaaaatgggaatgtaaaagtaactgctttgtaggtttgttgtggattaccttggtcagtatgaagcactcagcacagcactggcacatactaaatgctcaataaatatgtgggtttttttaaatcagtaatagtacatatagtcagcaaccggtgcacctggctttttaaaaattataattttaaaatctttttttctagtaccaaatacttaaaggatattttttctttctttttttttttttttttttttttatttgagacagatctcttgcccaggctggagtgcagtgacgtgatctcggctcactgcaaccttcgcctcctgggttcaagcgattcttctgcctcagcctcctgagtagctgggactacaggcacgcgccaccacacctggctaatgttcgtatttttagtagagatggggtttcaccatattggccaggctggtctcaaactcctgacctcgtgatccgcctgcctcggcctcccaaagtactgggattacaggcataagccactgtgcccggcgattcttggcattttaaaaatgcataacattccttaggaattctaggctcctaatttgcataacgttcagtttaatataatgtatatttaaaataaaccatcttatataacagattgtgtttggcagaattgaagtcattttaacttattggatgatggggatttcaaggcttgttggtttagcttgctatagcaatactatgcatatgcttttattgtgtctaagtatcacttcattattattataagacataagtaagtatatacttacctttagtatagaactgctgaattttctaggagaatgacatgatgaattagaatgcttttggcaaaagcagtaaaatccaattagaagagacttaaacagcctgggcgaggtgactcaggcctgtaatcccagcactttgggaggccaaggtgggcggatcacctgaggtcgggagttcaagaccaacctggccaacatggtgaaaccatgtctctcctaaaaatacaaaaattagccgggcatggtggcatgcgcctgtaatcccagctactcaggaggctgagacaggaaaatcgcttgaacccgggaagtgaagtttgcagtgagccgagatcacgccactgcactccaacctgggtgacagagtaagactctgtctcaaaaacaaaaacaaaagcaaacaaacaaacaaaaaacagagagacttaaacaataaggagcaataaggagcattattatctcaaataataagaagccccaagaaaaggaggttctaggccgggttagttcagtgggccaatgacatcatcagagacccaggttccttctatctttccaccctaccatcttcagcagccacagttaattatgtaactagtaattagacccagggttcaaaatcaatggatagcaagctcttatatatatttaaagatgtcgagaaggatatctatcaacctatctttagtagatatctctggagcatgacattataggcagaattttatttttactttatgcatttctatactagttggatgtttttcacaaagcatgagcaatacaggtgttttcatttctagtagatattatattacaaaatagaaacattattcttgaaaaaatacaaatattattgaatgatatcataaactataagtttaatggttatgtcctatactggtctatccttaaaattggtgccacaggcatctaaagtagccaaattcatagacacagaaggtagaatggtggttgctaggggctgggaggaggagggaatggggagttgttgtttaaagggtacagttttgcaagggtacaattttaaagggtttcagttttgcacgatgaaaagagttttggagattggctgcacaacagtgggaatgtacctaacactgctgaactgtatacttcaaaatggttaagatggtaagtttcacgttagtgtattttaccacaattttaaaaattggtgctgcttttcatgtatttaaatatgggtaaaacaggctgggcacagtagctcacgcctgtaatcccagcactttcagaggccgaggcaggcggattacttgagttcaggagtttgagattagcctggtcaacatagtgaaaccccgtctctactaaaaatacgaaaaattagccaggtctggtggcacgcgcctgtaatcccagttacttgggaggctgaggcaggagaatctcttgaacccggggagtgaagcttgcagtgagctgagatcccgccactgcactccagcctgggcgacagagacagactccatatgaaaaaaatatatatatacacatatatatgtatatatatatattttatattatatgtgtgtgtgtgtgtatatatatatatatatgggtgtgtgtgtgtatacatacgtatataggtaaaaccgtgttttagaaacaaatcactgtgacagagggcattgaagagccatgggtttttgtgttgaatgaacacaaaaataaagatgcgtattttccaagcattgtaaaaaaaaaaaaaaaaaaaaaaactgttccctcacaattattttgtttaattaagtgcaaatattttcttcacttctctcaggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcattatttctattttaatactttgtttcatgtggaaaaattatctaaggtaattcctttgcaaacgccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctactaaaaatacaaaaaaattagctgggcatgatggtacgtgcctgtagtcccaactactcaggaggctgagacaggagaattgcttgaacctgggagatggaggttgcactgagctgagattgcaccactgcactccagcctgggtgacagagcgagactccgtctcaaaaaaaaaaagaaaaaatatgtataacaaatcctggtgacacatgtttacctatgtaacaaaccttcacatgtacccccaaacctaaaataaaagttaaataaataaaaaattaaaaaatagaaagtaattgtcttatttatgacatgtcattataatacagccaaagtgtcataatttctatagaaagtatatgtatacatttaagttcaggttatatatctttttcattagattataaactttataaaccatagtgtttcatgttatatattgtgaattttctgggcatttgattgatgcagatgtgaaccttagtagcatgaattaaacgtattaaaattctgcctcttcaaaggtgtgtgtgtgtatctgtatatatgtgtatatatatgtatatttgtatacgtgtattctatgtacatatatacatatatacatacacgtatacatatatatgcatatacatgcaaaatgtatacatgtacacatatatatccatgtgtatatgagagtttttcaggaaaacctaaatttttcagattctgttcatgccactgcacaacttctcaattagtgttattaaagggaaacactgaggaagaatctccaacactgtataaatcacaatgttttctgcttgctttgaaagtttgattatttttatagtatgccttaagaatgggcacgtaaatattttttaaattagcaatatttggggttcaaagtaaaaaagaaaaaaaagtcacagtatctaatgttgagagggtatgaggaaataggtattctaatacactactgggaagtaaatttgtataagttttctggagggcagcttggtgatatgtatcaacaaccttgcaacccagaaactccagctctatgaattgatcctaaagaattaattaaggatgtgcacaaacattagcttaaaagatattattacaacattatttataagagctagcaaaaaatatggcaacagcctgaatgtctaacaatagggaataggtcaatcgaaagagccttcgttacgtgtatttgaattccagttctagcaatgactgcataaccccttggacaagttgcttaatcactgtagccctcagtttttctgaggcaaaatgaaggtgataataatgcctacctcatggggttgctgtgagaattgagtgagataaaacgtgtggcacataataaaagtgctgcttattattatggtacgtccttacagtataatattcagcacttaaaatggtgttgcagatgaattttaacatggaaagactcagaatgtattaaattatatatattgagtatatatgctttataatgagaaaaaatgtgagcctatttctgttaaaaacaaaaagatcagggccaggcccggtggctcatgcctgtaatcccagcactttgggaggccaaggcgggtggatcacttgaagccaggagttcgagaccagtctggccaacatggagaaaccctgtctctactaaaaatataaaaattagccgggcgtggtggcgcacgcctgtaatcccagctactcgggaggctgaggcaggagaaatgctttaacccaggaggtggaggttgcattgagccaaaattgggccactggccactgcactttagcctgggtgacagactgagattccttctcaaaaaaagaaaaaagaaaaaaaataaaagatcaggacaaacaggcagagcataggggaattttaggacagtgaaactattctgtaccatactataatgatggatgcatgtcatacaaaacccttagcatgtccaacaccaggagtgaacctaaatgtaaactatgaactttgggtggtaatgatgtgccaatgcaggttcattggttgtaaaaaatgcaccattctggtgagggatgttggtagtgggagaggctgcacttgtgtgagagccggaggggggtatgtgggaactctttataatttctgttcaatttcgctgtgaactgaagagtgctctaaaaaataaaatatattaaaaataaataaatgaaagttcaaataggaaaagactggaaactgctgggtaacaggggacagatagcctagttttataaatacttagcatataattcaaattgtttatgtatcattaaaggatgtattctagagtgtttgatgatggtagtaataatggtggtagtagtaatagttaccatttatttagcacaaactctgtgccaggtgctgtgctaaacacattacatgtattatcaccattatcacattaaatagatgcttaaaacagcaactctagcatgttgttcataacactattgcctatagcaacaaattatatatccaatgtatccctttaatataagttttatccagaaaagatttctgacttttgttagaagggtcagctagtagcattattgatttgaattacaaatttccttaagatatcaaccctggaacatgattagtacaggccagtctgagttatgcgccagtcaagagtccacaactgtcagattttttttattattattattttttgagtcagtcttgctctgtcatccaggctggaatgcagttgatcttggttcactgcaacctccgcctcccaggttcaagtgattctcctgtggcagcctccagagtagctgagattataggcgcctgctaccacgcccggatctttttttttttttttttttttgtctttagtagagatggggtttcaccatgttggccaggctggtcttgaactcctgacctcaagtgatctgcctgccttggcctgtcaaagtgctaggattacaggtgtgagccaccgcatccagagtgacatgtttatacccattctctggatagcaatagaaccaggctcagggctgatgatatgtatctgagtatatctattccaaagttaaatagatggtgctattaggtgtaacctgctcttctcctatgtataacagagtagatcattttcccacagttcaaactctttgagcatgacatttaaagctttctaatatcttcacgcttttggcctcagagtcctttctccctccacgaacttggtgtgccactcacacagggccagtatcctgtcttaaaacatgccaagcactttcacttttctgttgcttatgctggcaaactccttgttctgaaggtccaactgaaataccaccttatgcctttcttatttgtcttccacctcccagcccctacacacacccacttcatctttgctttttattcccaccccactttgctttcatttgacatgcacttccttgtctcttatataaaatctgcttccaagactggtttcttcagtggattgtaaggtctctgagtaataactgagggtaataacaacagcttattagctgtcttttttttttaagaaaaaaattctctcattcccctctgagcagaaaaatagctcattaaacatagcaagtattcaaaaaatagtgaaatacttaacagctagccatattttgacaatagcgaattattgtggtgaagtagttgttgctaattgtcaaataaaatttatatgtagtaaattttcagttacccacataccaattttctattgttatttttacaaccttggctgtttcttctactttctagcaaatgatttgaaaaaaaacaaactgattttaatactttaagcaacatataattagtgaggtgatatattccttaagcagcaatatgatacattttaaaacccaacaaaaattcagactatctgcttcatagaaacatttatttatccaacacatactttattttatgtatgtatttatttatttatttatttggagatggtgtcttgctctgttccccaggctggagtgcagtggcacgatctcagctcactgtaagctctgcctcccaggttcaagtgattcttctgcctcagcctcctgagtagctggggttacaggcacccgccaccatgcctggctaatttttgtatttttaggagagacagggtttcactatgttggccaggctggtctcaaactcctgacctcaagtgatccacccgcctccgcctccccctcccgaagtgctgggattacaggcatgagccaccacacatggcccaacacatactttttgaacactcatcttccctccactcactaactcactcctcttactgcctttcatggccacactccatctattggtttctactgggaaccttagcaacctctttttcaaccttctggtcatttctccaatctacctccttctcttcactctccctttttcatttagaccctcaccatctgtgacctggcctgtgaccctgcgtctagtccctcttccatccaccatcaatgtgttctgcatgatgttgctagggttacctttttaaagcagatatgatcttgtttaaacagctttgaggtttaagaactcagaggaatctatgctctgggtttcctattgtgctcaaaggctaaagtccaaaaactacaatctggttttagcctaatttccctaaatttgtttcctgttgtaccctcgcaggtactaagtttcagccaccctgaacctttctgttccctgaacattcctctctgcctgagtgtttcctctcactccttgaaatgtcctccctcctcttctctatctaatgagttgctactcctctatgaagacttcctcaagacccacacagagttctctgtcctttgaactctgtcctttgaacccaaatcgtaactctgttctgccatttggctgtgacctagtttctgctaactagacttagactttgacttgctcaaggacaggaaaatgtcttatttatctttcgatcttcagagtctagctcagtgctctctctctctctctctctctctctctctctctctctatatatatatatatatatatatgtatatttgtaaaggtgggtgtttgccatcttgcttaggctggtcttgaactcctggcctcaagtgatcctctcaaagtgccggaataataggcatgagcctcccgtgcctggcctccaggtcttttatttttcttaaaaatcccaagtagctgggatcagaggcacatgccaccacgcatggctaatttttgtatttttagtagagatggggtttcaccatgttggccaggctggtcttgaactcctggcctcaagtgatctgcctgccttggcctcccaaagtgctgggaatacaggcatgagctaccgcgcccggcctcattcaatattttgaatgtacaactcaatgtgctcttaagatagaatttgaaactaagatatggtaaacacattatctggcattttaagaaataaccacggtacagaaagagtttacagatgaattctgaaggtaattttcaagcctcattttcacacttagctttaaatccctccattctttcattcccctcttgtgtgggtcctcataagctttgagaaaagactgaaaaggaaaaagtagccccgaaaaagagaaaggacctagacaagaagtatcttagcaaccaagagtaaaatgtgctaaatgacttgaaagtgattaccttagagtcatttcatattatgaaagtttggtttcccagctagattccaggatatttgatgtagttattctgtttatgatttttgggcagtatgcttggcaagctagctactgattcaatgactgtttcagctttttgttctgggtaatacctctacctaagctttaatgatgggctaaaactggcaagaaaaatgaggcaattttaagatctagtgccttaggaaagaaaaggtagagacaaacaaaatcctctattgatgttctgctctgtatttattatgataacagttattttgttctgttttggaaagtgttgatttttgattagtataattttcagtcaagatccagttggatctttttttaactttgaacctaactgatactgttgctggcatgcataagacactaaataaatattttaggtaattcaacattgacttaatgttgagatgtaattaatcacaaacattaaagcaagcttgacttctatattttaaatttcagttgttgccacctcctccctttcatggttccatcagccgccttcatcaaatcaaacaggtaagaagactttccaaactgacagctgttcatttaaaaaagtaaattttatttttctttgtgaaaatacctatgtttcagtaattctaagtgaggtcacgtgtaatattaagtttttatttctaggaatgatttcttcaaaaaaaaaacaaaactaagaagcactttttttggcttattagctattttaattaattaataatttctagaaatactgcatactcttataccttgagtctagcttctttcttccagggatctgaaagtggaatgctacacataaaaattaattttcagcttcataataactgtagttattatttttttaaccctcagatgagtttttttgacagataaaatggccttcatgctattgttttgttcttagtgatctgagttcagggacacattgtacctcactggtttatattttgtgcccatgtgcacgcatgcacgtctctgtgtttgtgtgtttgtgtttgtgtatgtggttgggagggtgtatgtgggtgggtgggtgtgcactcatgtgcacatgcatgcttaatagcacaagcataatacagaattcaaccttttaattatccaaggattagccacagaactcaaaagatcaaatcaccactaccccacaggtggtatttttttctttgacccagctacaagcagacattttttcccccaagagaggcttaacttattattcacttagtactaacaggtactttacatttgtggtctcattttatcttacaacaactttataaggtcagaaactaaaaaggggagaaatttagcaatttacccaatctccagagttggtgaatgtcagagccaagatttggccccagattactggattattttccagctcccctttccctgtttcagtgcacaaagcccataataccatcttgtaatcctagttattagtcctccaactcttgcttcttttccctctctccctttcacccctgtggcatggcttccctaaggtcagcttatccactagcaagaaagtatggtaaaaatggtttttttcctttttttttttttttttttttttttgagacagagtttcgctctgttgcccagactggagtgcagtggctccatcttggttcactgcaacctccacctcccaggttcaagcgattctcctgcctaagcctcccaagtagctgggattacagacgcctgccaccacgcccggctaatttttgtatttttagtagagacggggtttcatcatgttgtccaggctggtcttgaactcctgacctcaggtgatctgcctacctcggcctcccaaattgcagggattacaggcgtgagccaccgtgccaggctgttttttttactttttagtgggtaaaacttgcttttactcctgtctttgtatgtagctattttagaaattcttaaggaatgaaacaagttcaaaggagtaaagtgacctcgtgtttatctgtgcaatatgtttctttgcttctcctaaattaaaccaaatatttgaaaatgggttatgtgttgctatttgctggtgaagcttgatataaatcctaatttacactggttaggaatataagtttaatgcagtttatttccatagtaacataatatgtattataaatatttaaaaatgaaatataagtagaaaatgaatgagatgggaaaagagaaaaacattaattttcaatctggatactgattgaatggaaaattaagacttattttcagcagtttaatggtctgatagatatcttaagttgcatatttcttttttttttttctttgtttttgagatggagtctcactctgtcacccaggcgggagtgcagtggtgctgtctcagctcactacaacctccacctcctgggttcaagggattctcctgcctcagcctcccaagtagctgagatcacaggtgcgtgccaccacacccggctaatttttttgtatttttagtagagatagggtttcaccatgttggtcaggctggtttcgaactcctgacctcaagtgatctgctcacctcagcctcccaaagtgctgggattacaggggtgagccactgtgcctggcataagttgcatatttctttacatgcattctttgactgacttctttgtccctattaaacttaaccttttaagtgcaaaacagaaatgtctggttctctccccattaccttctgaactttcactttaacaacattaataagggcattgatttttcaaaatggggggaataatattggctatctcatagaatcgttttgaggatgaaaagaattacaactgacccttcaacaacctgggtttttaaaaagtaattaatttaatttttacaggtgccatggggtacatgagatactttgatataggtatgcaacatgtaataatcacatcagggtaaatggagtatccatcccttcaagcatttatcctttgtgttacaaacaattcaattatccttttagttatttttaaatgtataattaaattattattgactatagtcaccctgttgtgctagcaaatactgagtcttatttgttctttctaactatatttttgtacccattaaccatcccacttcctcgccacccctcatttacccttcccagcctctggtaaccatccttctaatctctatctccatgagttcaagtgttttaatttttacctcccacaaataagcaagaacatgaggctgggcgcagtggctcacgcctgtattcccggcactttgggaggctgaggtgggcagatcacttgaggtcaggagttcgagaccagtctggccaacatggtgaaaccccgtctctaccaaaaatacaaaaattagccgtgcgtggtgggtgcctgtaatctcagctactcaggaggctgaggctaaagaatcacttgaacctgggaggcggaggttgcagtgagccgagatcgcgccactgcactccagcctgggtgacagagagagactccgtctcaaaaaaaagaaaaaagaagataagttagaacatgcgatgtttgtctttctgtgcctggcttatttcacttaacataatgacctccagtttcatccatgttgctacaaacgactggatccctttttttttttttttttttttttttttgagacagtcttgctctatcacccaggctggagtacagtggcgccatctcagctcactgcaacctctgcctcccaggttcaagtgattttcctgcctcagcctgctgagtagctaggtttataggcccacgccaccacgacaggctaatttttgtattttttgtagagacagggtttcgccatgttgcccaggctggtctcgaactcctgacctcaggtgatcctgcctgcctcagcctcccaaaattctgggattacaggcgtgagccaccgtgcccagcctggatctcattctttttatggctgaatagtactccactgtttatatgtatcacattttctttatccattcatctgttgatgaacacttaggctgcttccaaatcttaggtattgtaaacagtgctgcaataaacatgggaatgtagatatctcttctatatgctgatttcctttttggtgggtgatataccttggagtgagattgctggatcatatggtaactctatttttcattttttgaggaacctccaaacttgaacaacatggatttgaatggcgtgtgatgtgaaaccctcctatacgtatgggtgactttttgtatcctcgggttccagaaggcccactgtggacttgaggatgtgtggattttggtattgcagtgggggggtgctggaaccaattccccacatataccaagggatgactgtaagtaattatgcataatgccaagagtactgcattaaaaaaaatctttttaaatggaaaatttaaaacatggaatatagaatcttcatgtacctaacacccagctttaacaattatccacattttgtacatcctttttcatcgatctgcttctcttttaggggtgggagagagtgctttaaatttctgacatatctttttacccaagtttatgggtatgagaaggactttttttctccataatcacaatgccatcattatgcataacaaattaccttattccttaatgtcatctaaatccatgttatatttttcctaattcttaaaaatgcattttttaactgatccaaacacaatccaaatatgacatttagttgatatatatctcttagatctcttttatttaaaacagcatttttattttattttatttatgttccaggatacatgggcagaatgtgcaggtttgtcacataggtatacgtgttccatggtggtttgctgcacctattgatctgtcatctaggttccctcccctcaccacccaccccgcaacaggccctgatgtgtgttgttcccctccctgtgtccatgtgttctcattgttcaactcccacttaggagtgaggacatgcattgtttggttttccgttcctgtgttagtttgctgaggatgatggcttccagcttcattcatgtccctgcaaaggacatgatctcattcctttttatgactgcatagtattccatggtgtatatgtaccagattttctttatcctgtctatcattgatgggcattcaggttggttccatgtctttgctattgtaaatagtactgcagtaaacatgcgtgtgcatgtgtctttatggtaaaatgaattatattcctttgggtatatactcagtaatgggatttctgggtcaaatgatatttctggttctagatccttgaggaatcgccacaccgtcttccacagtggttgaactaatttacattcccaccaacaatgtaaaagcgttcctatttctccacagccttgccagcatctattgtttcttgagtttttagtcatcgccattctgactggcatgagatggtatgtcactgtggttttgatttgcatttctctaatgatcagtgatgttgagctttttttcgtatgtttgttggccacataaatgtcttcttttgagaagtgtctgttcatatcttttgcccactttttgatggggttgtttgttttttcttgtttcagttccttgtagattctggatattagacctttgtcagatgggtagattgcaaaacttatctcctatgctgtaggttgcctgttcacgctgatgataatttcttttgctgtgcagaagttctttagtttaattagatcctatttgtcaatttttgcttttgttagaattgcttttggcattttcatcatgaagtctttgcccatgcctatgtcctgaatggtattgcctaggttttcttctagggtttttatggttttgggttttacatttaaatctttaatccatcttgagttaatttttgtataaagtataaggaaggggtccagtttcagttttctgcatatggctagccagttttcccagcaccatttattgaataggaaatcctttccccattgcttatttttgtcaggtttgttgaagagcagatggttgtatatgtgtggtgttatttctgaggtctctgttctgttccattggtctatatctctgttttggtaccagcaccatgctgtaaaacagcattttctgcctgttttttgttccatgcctcttatttattgaagaaaccagggagtccatttgtcctgtaaaatgtcccacattctgattttgcttccatgtggtgttactatgttgttttatcctctatttcctgttaaatagtttttttaatttttatttatttatttatttagacggagtcttactctgtcgcccaggctggagtgcagtggcacgatctcggctcactgcaacgtctgcctccctggttcaagcgattctgtaacctcagcctcccgagtagctgggattacaggcgcccaccaccccacccagctaaatttttttttttttaagtagagagggggtttcatcatgttggccatggtagagagggggtttcaccatgttggtctcaaactcctgacctcaggtgatccgcccatcttggcctctcgaagtgctgggattacaggcatgagctaccgcgcctggcctcctgtaaaatagtatgatgaaatttgcttttaattttaaatgaacacacagctccaagtcaatgttaggttctgggccaatatttggtttatgttacacctttcctattaagcaggtaatggacaatttcttctcaactgttgttgttagctgttttctaagtattaaagagactgagacatcaagctagaagttaattttctaaacacagttattattcctacataggaattattttgtgtaattttcctttctaataaaaattttattttatttatttatttttcagacaggttcttgctgtgttgcccaggctggagtgtagtggcatgatcatagctcactgcagcctcaaccttctgggctaaagtgatcctcttgcctcagcctcccaactagctaggactacaggtgcacaccactatgcctggataatttttttattttatttaattaatttatttatttctgagacggagtctcgctctgttgcctaggctggagtgcagtggcatgatctcggctcactgcaaccttcgcctcccgagttcaagcaattctcctgtctcagcctcccgagtagctgggactacaggcacccaccaccacacctggctaacttttgtatttttagtagagacggggtttcaccatattggtccgactggtctagaactcctgacctcaggtgatccacccgcctcggcatcccaaagtgctgggattacaggcatgagccactacgcctggccatttttttaaatttttggagagatgacgtctccctgtgatgcccaggctggtcctgaaatcctggcctcaagtggtactcctgcctcaggctcccaaagtactggcattacaggcatgagccaccacgtgtggcccctaataaaaattgagcttgtattccaaaagatccgaatgcattcagtctgtagttccctgtttcccaaagctctaaacataaattagtgccatgcagaaacagtttgtatatttgctcaggctgccattgcaaagtatcacaaactgggcggcttaaacaacagaaatatattgtttcacatttcttagggctagaagtctgagataaaggtgtcagtagggttgattccttctgagaactgtgagggaggatctgctccaggcctctgcccttggcttgttgatggctatcttcatgttcacatagtgttctccgtgtacatgtgtttgtttctaagtttctccttttcatgaaggacagcggtcatattggattagggcccaccctaatgacctcatcctaatctgcttgcttctgaatatattctgtctctaaataaggtcacatcctgaggcactggggattaggacttcaacacaggaatttgaggggacacaattcaacccataacagtctgctcacagttttttgttatatagctttatatttaattcctgatttgttaaacaggatatgagtcattggcacccagtaacaacttaactttctctgtagtgtcttaagtaaaaatcaataagaagaaattgagctgggcgtggtggttcgtgcctgtaattccagtgacttgagaggccaaagcaggaggatcacttgaggccaggagttcaagaccagcctgggcaacataagaagactccgtctttaaaaaaattttttttttaatttgctggccgggcacggtggctcacgcctgtaatcccagcactttggaaggccgaggcgggtggatcacctgaggtcaggagttcgagaccagcctgaccaacgtgaagaaaccccatctctactaaaaatataaaaattagccagacctggtgaggcatgcctgtaatcccagctactcgggaggctgaggcaggagaatcgcttgaacccgggaaccagaggttgcagtgagctgagattgtaccactgcactcactccagctggtgtgacaaagtaagactccttctccaaaaaaaaaaaatttaaatttgattttagtttacagattgtttcattctttcaacaagcctttattgggtactgtgcaggcactcagtaactaaaatctttcagatgtagtctcctcggagagcaaaagttggtaacttacagttcccatttttaccatgtatcctgaaaaatggaaagctaactttaacatccaagtataacaattctccttaaactaggtttctagtatactgtactctgcttcttacagttataatgcatggctgttgaccttttatacttattttaataatcttattttattataaaccatctcaaatccattttggaaataggcaagacataaatgaaaaagagtcaacactcttctcctaacaaccttcaatagctgattttagctaatgctccaactttcagtgggaggaatattaagcagaattctatctcagtttcacaaaactacctgctctgtacttgttgaccgaatgaactacaaaatactttgagtttcacactagaggagactatctatataatattaaattgaagaactatactaacaattacattttgctgaatttactgttattccattgcttttaaaagactaattatcttcttaaattaccttttccaattccctcattttctgtacctcattgtgtggtatcaaaatagtcacagttttaagactcaaagctctcgatttgatacctcattgtatggtatcaaaatagtcacaggtttaagactcaaagctcttgatttttcttcagttcttccttatttttctactgtatccaattaggcttctaatcctactaattcttccttgacaatatcctctttgttgtcactgctgcttccttcttctgtcccatgggtctagattactgaaataatatcccagtagattttctgtttctcccagtttatccaacttccacaatgaagaccaagataaatgttttttttttttggaacagagtctcgctctgtcgcccaggctggagtgcagtggcgcaatctcggctcactgcaacctctgccttctgggttcacgccattctcctgcctcagcctcccgtgtagctgggactacaggcacctgccaccacgcccagctaattttagtagagacggggtttcaccgtgttagccaggatggtctcgatctcctgacctcgtgatccaaccacctcggcctcccaaagtgctgggattacaggcacaagccactgtgcctggccaaattttttttttttaaaaaacatcattttcctccctctccctctccccctccccctcccccctccccccctcccccctccccctccctctccccacggtctccctctccctctctttccacagtctccctctgatgccgagcggaagctggactgtactgctgccatctcggctcactgcaacctccctgcctgattctcctgcctcagcctgccgagtgcctgcgattgcaggcgcgcgcagccacacctgactggttttcgtatttttttggtggagacggggtttcgctgtgttggccgggctggtctccagctcctaaccgcaagtgatctgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcatctctgcctggccgcccatcgtctgggaggtgaggagcccctctgcctggctgcccagtctggaaagtgaggagcgtctctgcccggccgccatcccatctaggaagtgaggagcgcctcttcccggccgccatcccatctaggaagtgaggagcgtctctgccccgctgccccgtctgggatgtgaggagcgcctctgcccggccgcgaccccgtctgggaggtgaggagcatctctgcccggccgccccgtctgagaagtgaggagaccctccgcctggcaaccgccccgtctgagaagtgaggagcccctccgcccagcagccgccccgtctgagaagtgaggagcccctccgcccggcagccacaccgtctgggaagtgaggagcgtctctgcccggcagccaccccgtccgggagggaggtgggggtcagcccccgccaggccagccgccccatccgggaggtgaggggtgcctctgcccagccgcccctactgggaagtgaggagcccctctgcccggccatccgccccatccaggagggaggtgggggggtcagtcccccgcccggccagccgccccgtccgggagggaggtgggggggtcagccccccgcccggccagccgcctcgtccgggaggtgaggggcgcctctgcccggccgcccctactgggaagtgaggagcccctctgcccggccagccgccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaattcttctgccttgggatcctgtagatctgtgaccttacccccaaccctgtgctctctgaaacatgtgctgtgtccactcagggttaaatggattaagggcggtgcaagatgtgctttgttaaacagatgcttgaaggcagcgtgctcgttaagagtcatcaccactccctattctcaagtacccagggacacaaacactgcggaaggccgcagggtcctctgcctaggaaaaccagagacctttgttcacttgtttatctgctgaccttccctccactattgtcctgagaccctgccaaatccccctctgcgagaaacacgcaagaatgatcaataaaaaaaaaaacaaaaaacaaaaacaaaacaaaaaaaacatcattttcactttcttccccccatacaaaatgtcacaatggcttcccattacctattgaataataataaaaatagctaatatgtgttaagcactgaactgtttgccaggcagtgtgatgagaactgtacagccacctcatcatcctcattcttatcgtcatcttcatatggatgaagaaactgacgctcaggtgacgtcacctgcctaagtttgcacaggtagtaggttatagagctgggatttgactcagttctgtttgtctccaaagccggggtcctgacaatgacgtgattctgcccaaattctttaaattcaaactgtttgattatttaagaacctgtaaaactggccctgtcttacctctcctgttttctctctcattactttgtagcacaaactcagtttcagccaaggtagtctcactatctccaaatctgttgtatttttttccctctcctaaacttttgttcatatgggttcttctgcttggaatacccttccctctactcactgcttgttcatattttatacatctttgaaggactaggtcaaatatttatttatgtatttatttatttattgagacagggtctcatattgttgccaggctggagtgcagtggcacaattgtggctcactgcagcttcaatctcccaggctcaaaagatcctcccacttcagcctcctgagtagctaggtctactgacatgtgtaccacatgtgcccggctaatttttttttttcttttagtagagatgaggtcttgttgttacccaggctgatctcgaactcgtgagctcaaggattcctcctgccttggcttcccaaagtgctgggattacaggcataagccactgtgcgtggccaaattttaattctttcgcacaactcacaccactcttctattatggactaccccaaacatgtattatttatactatagacgaaaatctttaaactcttttgatcacacatcacatcaggagaaaatgtttgagtacatgcctccaacataggtacactgcatttacttatacattttggacatataccactgtgctattatgtgaatcatagaatatatataaagtagaaatataaaaaaggatgagataaggatgaaacgatgtttttagaaaatttaaaaatttggctgggtgcagtggctcacgcctgtaatcccagcactttgggaagcagaggtgggtagatcatctgaggtcaagagtttgagaccagctggccaacatggtgaaaccccatctctactaaaaatgcaaaaattaactgggtgtggtggcatgcacctgtaattccagctactcgggagtctgaggcaggagaatcgcttgaacctgggaggcagaggttgtactgagccgagatcgtgtcactgctctccagcctgggcaacagagtgagattctgtcaccaaaaaaaaataaaaataaaaataaataaaaaaataaaatcccagttacttaggaagctgagacatgagaatcacttaaacctgggaggcagaggtttcagtgagctgagattgcaccactgcactccagcctgtgtgacagagtgagatcctgtctcaaaaaatatataaaagcaacaacaaaaaaactatcctaatgggggtaaagtggcatctcattgtggttttggtttgcatttccataatgacaaatgatgttgagcatcttttcatgtgctttttggtcatttgtatgtattctttggagaaacattcagtctctttactcatattttaattgggttggtttttgttgtcactgtgtggtaggagttctgtatatattttggatattcattccttttcagatatatgatttgcagatatcttctccaattatccagttgtcttttcactctcttgatagtgtcatttgatgcacaaaagtttttttaatttctctgggcgcggtggctcacacctgtaatcctagcactttgggaggccgaggtgggtggatcacgaggtcaggagatcgagaccatcctgtctaacatggtgaaaccccgtctctactaaaaatacaaaaaattagctgggcgtggtggtgggcacctgtagtcccagctactcaggaggctgaatcgggagaatggtgtgaacctgggaggtggagcttgcagtgagccgagatcgcgccactgcattccagcctaggcaacagagcgagactccgtctcaaaaaaaagtccgggcacagtggctcacgcctgtaatcccagcactttgggaggctgaggcaggtggatcacctgaggtcaggagtttgaaaccagcctggccaacacggtgaaaccccatctctgctaaacatacaaaaattagctgggtgtggtggcgggtgcctgtaatcccagctgctcaggaggctgaggcaggagaattgcttgaatccgggaggcagaggttgcagtgagctgagattgcgccattgcactccagcctgggcaacaggagcaaaactccgtctcaaaaaaaaaaaagcattaatttggccgggcgccatggctcacacctgtaatcccagcactttgggaggccaagacgggcggatcacaaggtcaggagttcaagaccagcctgaccaacacgtgaagccccatctctactaaaaatacaaaaattagccgggcctggtggcatgcgcctgtaatccaagctactcaggaggctgagacaggagaatcgcttgaacccaggaggcagaggttgcaggagccgagatcacaccattgcactctagcctggccaacagagtgacacgccatctcagaaaaaaaaaaaagttttttaattttgatgaagaccagtttatctgttttttttctcttgttgcctgtgcctttggtatcatatccaagaaatcattgtgaaatccagtgtcatgaagatttaaccttatgttatcttctaagagatttagagttttatcttttaagttaaagtctttaattcatttcgagtgaatttctgcatagggtaaaaaaaaaaaagggggttcaacttcattcttttgcatgtagagctccagttttctaaacatcatttgttgaaaagattgtcctttccccattgaatggtcctggcatcactgttgaaaaccatttgatcatgtattatgtaaaggcttatttctttttttttttttttttttttttgagacggagtctcgctctgtcgcccaggctaaagtgcagtggcgtgatctcggctcactgcaagctccgcctcccgggttcacgcaattctcctgcctcagcctcccgagtagctgggactacatgcccctgccaccacgcccaactaattttttgtacttttagtagagacggggtttcaccatgttagccaggatggtctcaatctcctgacctcgtgatccgcccacctcggccgcccaaagtgctgggattacaggcgtgagccaccgcgcccggcttgaaggcttatttctgtgcgctctattctgttccattgctatatgcatgttcttttttttttttttttttttttgagacagagtgttgctctctgtcattcaggctggagtacagtagtgcaatttcagctcactgcaacctttgcctccaggattcaagcaattcttgtgcctcagcctcctgagtagctgggattacaggtgtatgctaccacacttggctacattttgtatttttggtagagaagaggtttcaccatgttggccagactggtctcgaactcccaacctcaggtgattcgcctgcctcggcctcacaaagtgctggtatgcatctgttcttatgccagaactacactgttttgactatgtagttttgtaggaagttttgaaatcagaaagtatgaatcctccagctttgtgcatcttttcaaagactgctttggctatttggggtcctttaatattccatatgaattttcagatgggtttttctgtttctgtaaaaaatgtgattgggactttggtaaggggcgcattgcatctgttgatcactttgggtggaattgtcatctaaacattgtcccaatccatgaacatgaatgtctttctgtaggtgggttattaaaaaaaaaaaactacctatgtgaaaatgatacttgtatattaataaaaagtcaaataatatagcaatgtacaaaggaagaaagaacacattactccagatctcactactcattgataaccactgttaagtttctggtgaacatctttctgagcacctctcttacaattttacataaataggatccatttgtctcccatttaatatgtaatagttgttttctgatgtcaatgactagatttaaattatgtttgtctcatcatttacttaagcaaacttaccctgatagacatttaatttgttgtctgtgtactgtgagtaatttttattaatatcatagtattaatggccatccatagctattgtggactagtttcttctctgtcctagtagacctttaaaaagtttagggaaaactgtataattttgaatgcttaatgttgttgcttttgaataaagaaaagtacaaagtttttcatctaatcagttcctgcatatctgatgtactgtaatgcataaataatagatctttggtgtgataatttgtgaagcaataaagggcagagaaccagatacttgtttagagatttatttattctctagttcttctatagcctagtgaataaaaataatggtgcatccaaatgaaatcaaattttataaaaccataggaactgggtattcagtttattctcattttcctacctttacaggaagaagccatggatttaataaatagagaaacaatgtctgaatggtgagtactgtactttgaattactattctgataatttgtatacttaattatatcttttctttcagataggcaaactgcagttttgatttcttttgtaggaagctacaaagtgagatacagataagtcactcttgggaagaaggcttgaaactggtatgatattataacttcagttttgtagaaaatttcaaatttttactgacttacagtgtcggcatatctagttttgctgtaatttctagaaatctaagctctattttgaaacaaaaattgtatctgttgcataaataatttttgagtgctctttttaatttttttttttgagacaaggtctcactatgttgtccaggctggtcttgaactcctgagctcaatggatcgtcctgcctcaacctcccaaaatgctaggattacaggcttgagccattgcgcctagcccttgattgctcttcagaaatacttcatgatttactcataaaaatagctatcattatttgaaagtggggttcaaagtaaacagttttgtgacacaaaaccatagctattgtggaccagtttcttctctgtcctagtaggcataataaaagttcagttgcactagttaaagtgcttagataacaaaacaataaatgatttcactcccttctccataatttatgaactatatattaggagtcttaaaccacagacaatagactctctagaaaattattgcatttttatgcctgtgtgttagtccgttctcacattgctataaggaaatacccaagactgggtaatttacaaaggaaagaggtttaattgactcacagttctgcatggctggggaggcctcaggaaacttacgattatggcagaaggcacctcttcacagggcggcaggagatagaatgagtgccagcaggggaaattccagatgcttataaagccgtcaaatctcgtgagaactcactcactaccacgagaacagcattggggaatttgcccccatgattctattacctcccaccaggttccttccacaacacgtggggattatggggattacagttcaagatgagatttgagtggggacacagccacaccattatcagcctgtaacacattctcccactaacattttaatataaaacctttaatttaaacatacttagaatttagtttcatctcttgttaacatttttaaatgtctgtgtgcacactgtggttacctagttgtggtagctgaatgatatttagtgttcttttctatggacatcccagatagtgacaaaacaagtactgagctgaaaattgaataggagagattctaactaatgtcaatcttcagatttgggaattatttgatatggaaatggatcatcagcagaagcaatggcattttattttcctttgagccctgagtaccttacatgagcagttatccctgattttggagtaggtccaggagaatgagtaggtcatctctggagcctgtcactttttgtgttttggtgctaatacaattgatcgatactgctggagtcctttaactggcccaattctaattactttaggtattggcatggatgagtaagagaatcgtaagtgtgttaggaagaggaagggcacatgtaatacacacttggcttgttttagaaagaaaagggcagattttaaaatcctgaattatgaagtactgattttgtctatgtaaaatctagagacaatttccataaatgtagttattcctgctgtctcatttgcttctaagttctagccaaaacctttttggtcctttcctggatgtagtattatagttttcaataacaaagcacaggtcaaagccaaagagaagagcttaaatttaggatttgtgtttatagtgttgagtactcacattctaggactttctggcatgctgggaagcccctcaatcaccatatagccctcatccccaaaagggaaaagggtgcctttgcttattgaagtgaattttgggttccctgattgctttaggatggcgagagctcttcaccatggtgcagccagtgactcagtagtaaggactcacttccctgtgcaacaggtatctcaagtatttgattaataagcaattggtgctacaattgtacactgctttctgcttacacagaatgacaatggcttacagaaatcatcctctctaaagtgcattgatttaactccagtatcctcaatggcttcttccatcaagaagactgggaaggtaagaaaggagtacctaaaagtctatgtctcttgaaatagttaggaaatatttaggaacattaatggtcaccaaaacaaatattttgggggatatattttgtcacagtacatctgattctaactaacatttttcccttctttttcatttcttcaagtattacttacatgtaataaaattcaccaactttaaagcatagggttagattaattttggtaattgtgtacaatcctgtagccacaaccataatcaagatattgaacagttcccacactcaaaacaatttcctaatgatcttttgtaccccagtctccctccctaccatccctgcccctccctaggaaaccaatgatctgctttccgagaaaagtggcggttttaaaacctctgttccaatttgattttagcagtgtttctctccatcattacaaacttgtgtgagttgcactggttcgccttcaagtcctattcccagtcctatgcaacaatacatcatgtaagtttatgttatatgaaaataccaaattgcttataaaataagaattatagaaacctaaaagaaattatagctccaagttttgtgccaaccaaagaagtgacttctttttagggaaattaaaatgtcattgtttcggctgggcacggtggctcctgcctgtaatcccagcactttgggaggccgaggcgggtggatcacctgaggtaggaagttcaagaccagcctgagcaacatggagaaaccccgtctctactaaaaatacaaaaatagccgggcatggtggtgcatgtctgtaatcccagctactcaggaggctgaggcaggagaatcgtttgaacccaggaggtggaggttgtggtgagctgagatcgtgccattgccctccagcctgggcaacaagagcaaaactccatctcaaaaaaaaaaaaaagtcactgtttcagtttatcattttgtatattgaaaaagtcaggtgactaagaacataagaagaatttagtaattccttcaccctgctaatacataatctttctctaaccaagtttgttaataaggatcagagctatctctagaactttaaacaacttcatccgtgattctcaccttcattcaaggcaagtcccagccaggaatgtaggtttttgtagactctaggattcaaaatcctgaatccttgagaattagaagatagtttgctcctaaggcattccagtttttacccatatgtaaagaaaagcagtaaaatggccgagcatggtggctcacacctgtaatcccaacacttttggaggccaaggcaggcagatcacctaaggtcaggagttcgagaccagcctggccaacatggtgaaaccctgtgtctactaaaaaaatacaaaattagccgagtgtggtggtgcatgcctgtaatcccagctacttgggaggctgaggcaggagaatcacttgaacccaggaggcggaggctgcagtgagcttaaatcacgccactgcactccagcctcggtgacaagagccaaactgcatctcagaaaaaaagtaaaaataaaaacaaagaaaagcagtaaaatgatgtaatatcctacacagagtcccgtttttgtgtatgtccttagatctgttataatgaaatagtcattgttgattttgttaaaaaaaatttcttataatgatcatgatgattttattttagaagaagtcaaaatcctaccaacattattagaccaagtatccttggaccattaaaaagaaaaggtacttttatctaacagtagaagtaaatataactttaagttattttataaaatatctaaaatcaaatgttatacaaaaatgtatttttaaaggctttatttatttaaaatatatttaataagctattagaggcctttcattttatgcaactagaaatatgtataaggacattttgaaaactctaaaatgctatataaatgtgaattgagaaatttaattccaatttagttggctattaggattttcaatataattcaccaaggtagctatcttcattactttctaaaacaatgtagagaataaatgaatgaatgaacagagtgagtcagtcatcaagtattttgctgaatgtcaacccctgcctcactgccacacacacacattgctatcatatgaataagttgacacaaattagatccacttacaacactaaaaatatatatgaaggtgtatgttctttggtgtttagtttctttatgggagttatttttggttaaatatatggaaagtgacccacctactcagtaataaaagggcagtggaaagaataaaagggcagtggaaagatgtcttttttaaaaactcctgcaatcctggatcccacttctcaatggtacctcactaaattatgctcttcttccttttttttttttttttttcttgagacagagtcttgctctgtcacccaggctggagtgcagtggcacaatcttggctcactgcaacctcttcctcccgggttcaagcgattctcctgcctcagcctcaccagtagctgggattacaggtgcctgccaccatgcccagctaatttttttgtatttttagtagagacagagtttcaccatgttggccaggctgttctcgaactcctgacctcaggtgatccacccacctcggcctcccaaagtgctgagattgcaagcataagcctgtatatttagtacaatttttgactacaatggggaggggaaatgggtgaataggaaaggagattaaacttaaaaatgtgtattgtgaaaaatctattaaggtaagaaagaggagtaagaagaataagaggagagaaactgaaatatgctttaatgttctttgtatattttcgattaattaatggcagtcttcctaacaacataactaactcagcatgtactttttgtattctaagattaagggctagataaattctggaaaatactcttttccaaagtaagcacattgttttatgaagatgcttcggttactaagcttaggggtcttttacctgtgctgtgaaattcgggctagtgttgaaaaaatattcaaatatatcagcagtttaagagctgttagaagtcaagggtcaattgagtatttaaaataaagtacgcttaaattgaggagtgttttaccagattaaaatagttctccttttgagacatgtatacataaataggttatcacatgaaaagtatctcgagttttcttagaatttatgattgaaaaattatttttatagatcaattttaacataaaagatgtagtttctgcccagtgtcttcggagatgtgacctgtctcacacttggttttcagctgctctgaaagacgactgccttattcctttgaggtgtccctgagggaactccaaagcgaattctgtatataccacctagtccatattttcagtcataccccaccctccaaagcatgccctgtacaaatgtgctgaaaattcatttggccatttttggccagatacaataacagataaacagaaattgaaatttattcatatattttggaatatgcatattcatttgggaaacaacaaactatgtcctatttggaccccattaatacaaatgaaatgtgggagaaaggtaccataaaaataaaagagaggtcctgaggcagggggcggggggaactaaaaagaatgatgattatgtgaagtgagatcaagattagagtctccaaagcatatgatgtcatattttatggtgagaagcagcagtgacttccattaggaataagcaagagcatgggccgggcacagtggctcatgcctgtaatcccagcactttgggaggccgaggcgggcggatgacttgaggtcaggaattcaagaccagcctggccaacatgacaaaaccctgtctctactaaaaatacaaaaattagccaagggtggtggtgtgtgcctgtaatcccagctactcaggagactgaggcaggagaatcgcctgaatccaggaggcggaagttgcagtgagccgagatcacaccactgcactccagcctggacaacagagtaagactctgtctggaaaaaaaaaaaaaaaggaataagcgagagcaaataagccttcacatcggaatactgcagaaattgggcagctataaatatcgtttgacaagtaatgctggttttagcaaagaaagatctaattttcttttatgaggaatatgttttgatttgtcatgttttcaatgttaaaccaaaaaagagagctgagtagtttttctgtagtgacataaatgtaatctggcaaggcacgggacaccagacttcttttaaactttatgagccatgattacacttctgtggaaggtctatgcaatatcttaatggtgaccttagggttttatcattcaaatagaagttatgggcttgaatgtcagttttgctcaggtccagaaatgattatcatatgaatgtgaaacactgtgcagattttaacatttacttcaaggcaaagattacaaaaatgcagttgttgttttttttgagattagatgttctaccttaatctctaaagatacaattattttgttcattgtgtgctgtaaaagaacttacctatttagttcattgtgtacatttagcaaaataaagatagcaacaacctaaagttttaaaataaggaatgacattaaactcattaaacagccttactacatagctatatcaaatcatcttgcaggccgggcacagtggctcacgcctgtaatcccagcattttgggaggccaaggtgggtggatcacctgaggccaggaatttgagaccagcctggccaacatggtgaaaccccgtctctactaaaaatataaaaaatagctgggcatggtggtttgcacctgtaatcccagctactctggaggctgaagcacgagaattgctggaacctgggaggtggaggttgaagtgagcccagatcatgccactgcactccagcctgggtgacagagcgacttcttcacaaaataataataataataataataatatcatcttatagaatttagttaataatataagaaaattataatcattgaaaacaaaaagtaaatctaaaaacattatatacggtacaaacccaattttatttaaaaaacaattgtgtatacaacatattcaaaaattactaaagaatggttatgtctggataatgattacttaaaattgttttctttgtgcttttctgtattttataaattaattgcagtgaataagtattacttttgcaattaaaataataataaacatgttaaataaaacatctaccttgatctgctgtattgtcataggtgaaatggcatttcaatatcaaccaaaaaagattttccaaggcacaaccaacatgctttcttctgatacttcccaactgtcagaaaataatgtgtagtgagtattaacatgagattttaaacattcattgatcatttttgcttcgttgttaagtctactttggctattgtacgtattcagaagtatggtacattattaactgttcttagaagttttaaaactaatattccaagtggatactataaacctgagttattttattttcttttttttctttttctgaggcagggtctcactctgtcacccaggctgggaatgcagtggcacaatcttggctcactgcaacctccacctcccaggctcaagcagtcctcccacctcagcctcctgagtagctgggaccacagtagctgtgcaccaccgcgcctggctaatttttgtattttttgtagagatggggtttttccatgttgcccaggctggtctcaaactcctgagctcaagcaatccgcttgccttggcctcctaaagtgctgggattacaggcgtgagtcacgtcacctggcagagtgtttttcttatgagatgtgtgtgacactaatatatggtggatacatttttagaagtgagattttggcattagattaagagatattagagaaatacataaaaatgcatccttggaaaaagtcatcttctgcccatcttccttggatttttgtctaccttgttgggttgagagtattattgaaaagcatgcctaagaaagcatgtcttaatgataaaaataggaaatactggaatagatttctttctttttttttttttgttttgttttagacggagtctcgctctgtctcccaggctggagtgcagtggcaccatctcggcttactgcaacctctacctcctgggttcaaacaattctcctgcctcagcctcctgagtagctgggactacaggcgtgtgccaccacacctggctaatttttgtatttttagtatagatggggtttcaccttattggtcaggccggtcttgaactcctgacctcgtgatccacctgccttggccttgcaaagtgcttggattacaggcataagccaccacacctggccatggatttctatttattgttactggtggtttcattgtatgactcttaaaaaactttgcttgtgacaagtgccagttgttagtcatgtattttgcattcatgtgtagacaaagcagagtatacagagagatctcttgagttctgctatcaatgagtggcattttcttcttctagtctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaagtaaaa

SEQ ID NO: 3751 - DNA, 47373 bp, human
ttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttgggtgagccgggttgagatactggaggaggcaagcggtggggaggaggtgttcgggaaagtgatttcctatagaattcccgtccctttatttgttgaggttctgcaggtaactcccttgttcctggtgtccggagatcccaccctcaaccttgggtgggggtagtgggacgggctgacctgagggggagcgcgcacccaccctgaggttgacaaacatctgaatctgaacatcctcccctgatagtccactcggacccgaaagtagcagccagttggtgtggagcacggcttttttctaacttcaacccatttcttacccactcctttgaagaaacttagtatcctcccccactcacctccagatcttctgccatgactgtaatatttgtcatttcagctgctttgtcacctctgaccttcacctccagccgcttgaatggaaatggttgtcaagcaaataagctttggacttttttacatttttttttttgtctttttttgagacggagtcttgctctgtcgcccaggctggagtgcattggcacgatctcagcttactgtaacctccgcctcctggcttcaagcaattctcatgcctcagcctccctagtagctaggattacaggcgcccaccaccacacctggtaattttttgtatttttattttttatttatttgtttatttatttttgagacggagtctcactctgtcgcccaggctggagtgcagtggcgtgatctcggctcactgcaagctccacctcccgggttcacgccattctcctgactcagcctcccaagtagctgggactacaggcgcccaccaacactcccggctaattttttgtatttttagtagagacagggtttcaccgtgttagtcaggatggtcttgatctcctgacctcgtgatccgcccgcctcggcctcccaaagtgctgggattacaggcgtaagccaccgtgcccggcctaattttttgtatttttagtagagacagggtttcaccatgttggccaggctggtctcgaactcctggcctcaggggatccgcctgcctcagcctcccaaagtgctggtattacagacgtgagccactgctcctggcctacacctattttttattggagcagaaagttttggtaccacagaagcttgatctcctaaattacacattctcactgggtgatacttcccccaaggggaagagaaaatagttcttgggggagtgtgaaaaatttttactctttttatgtataaagcgcagatatacatacagtatgtacacagatatatactatatatgtgttattaaaatttcacgaagggggagcaattaggggaaaaatgtctaaaaaggctttttagagggtcaataatgaaaaaaggatttagaaacactacactaaatgatggttaactgtatttctgaagatctgggattactaaatcttgtttccttttttttttttttttaagacggagtctcactgtgtcgcccaggctggagtgcagtggcatgatctcggctcactgcaacctctgcctcccgggttcaagcgattctcctgcctcagactcccgagtagctgggacttcaggcacccgccaccacgcccacctaattttttgtatttttagtagagacggggtttcaccgtgttagccaggatggtcttgatctcctgaccttgtgatccgcccaccttggcctcccaaagtgttgggattacaggcgtgagccactgcgcctggcctaaatcttacttcttaaactagacttttaaaatgagatgttggatttcacatttcagtattataaggttttctagataccgtaaaaatgtctgaaaaatgcattcactacatatgttactaactttgctcttcaccttttgttgcatcatactaattgatagttgtaattcacagtaccatagactatcaggaagggattcagagaccagctttaccctccttgtttaacatatgaggaaactgaggcccataaatctccaaaatgacgtttagtggcagagccagtactaggaagctctgtttcctgactcctaaactactgttctggccactactaaccaatacctaagctgattaactctaaatgaatgcagcttttgggtcatttgaggtaggagagaatatattgttcacaaaatgaaaagcaaactaagattgaccaaaaaaaaatacattacctttttaaaataggcaggtagaaaaacatagaagggggactctgcatgttgtgctgagaacaagaacattttattcactcaggattttgctctaattctgttgtgggaaaaaggaattatgggacccactctactagtagaagagagcagtagggagaatgttggatttattgaagacaatataaaaagaagaaataggttgcaaatagacgatggaagatgtgtactggaaggaacctgtggatcctctttaatgtattaaatacaccagagaaggagtggacccttccctaatccttaaagccctggaaacagagagatctcagttatcccttcataccttgctttgttctgcaaaggatttttttgttttgtttgtttgttttttgcttatattagagcatagctacagtgttacattccatagcttaagatcctgatgcatgaagtaaaatttgtacagaaagataagggtcactagcatatttctgtagtaggagtttaaagatacagaaaccacaaagtggacggagtccagggactctagtctgtcagaaagaagtaacataggaatgatgtgtgacatccctgagattaggggacttgcccagatgatctgagggcatattttgtgctgttgtagaaaatgtagggcatagtcagagaagttattctgaagcaagaaaaatttagagtaggattacactgagccttagttgaattcattttcacctcagttctcatttgcatatgtatactgctcacttttctccctttttttttccttccttggccctctaatacttgagtacttcctctttctaaactatacctggccagtaaagcattcttttcagaaaggtgaaagtcactagcatatttctttagtaggaattaaagatatagaaaccacaaagtggacagagttcagagactccagtccctcagaaagaagtaacataggaatgatgtgtgacatgcctgaggtcagggaacttgcccaaatgatctgaggggatgttttgtgctgttgtagaaaatatttagcttgctaaacattgttgcacctctttcaagtaattttcgaactttgcttgatgtttcttctatataaagaccctcttgcaccagcatttgcagaattaaattccttaggtttgtttctttcatatcaactctttaatacagtattactgttttaaagaagtatctgcactgttttatgtatatcttgaactaataaaaattccaacgtcaaaagttttgaacctcttggttctttatactctttatctctgtaattggctgactttattactggtgtcaataactatacttaaagctaggagttttttcttctctttctctgacccttattcaaagactcagagattaggttcttgtattcctgccagtgcctccctaccttaaaaacctctaccttgaccctgcatttaaactgttactgcctcaattcttttttttttttttcctgagatggagtcttgaggctggagtgcagtggttcaatctcggctcactgcaacctctgcctcctgggctcaagcgattctcctgcctcagcctccgagtagctgggactacaggcatgcaccaccacgccaggctaatttttgtatttttagtagagacgggtttcactatgttggccaggctaatttttgtatttttagtagagatgggtttcactatgttggccaggctagtcttgaacccttgaccttgtgatccacccaccttggcctcccaaagtgctgggattacaggcgtgagccaccactcctgaccctcaattctatttgaaaggcaaattactgccccagagccaaatgcagcccaccacctggatttgcaaataaaattttattggaatggaaccatccccatttgtttagttgttatctatggctactttcccactgcagtggcagaactgaggagttgcaacagatactgtatggcccacaaatcctaaaatatttactctctggcccttcgcagaaaaagtttgcccatcttctggtttattgaacttttacgaacgtggaagaatagcagccatgagaaatgattgctttgggaatataagtgacataaatctattatagtttagacagagctgtttattgatcatttgatgtggaacattgaacatccatccagttatactacttctgctttttccgagttaaaagtagcacttagttcagatatcagctagggttttataaattcatgttgaatgatgcataccagttgaagtatatattgcctgaattctttctttcagttatagtcttactaaaattggcaaacaaatttagggtagactatatcattgtcagccctaagtattaagccccctacacatgtacacaaaaaagaatggaaagaaatagcccattagtgtccctccaattttcttatgagtgactgccagaacatattcctattctcacaaagaaaatgactgggaaagtaagtagaattagatacatccatataccttccattcacaaaatattaagttactgcctgttatatgcaaattatgatgttgcaaagatgtatctcagggctcaataagctttaatagggaatataaatactagaaggacttaaatatatggtagagtaagataagtgcgtagggagcttaagataagtgcgtagggagctaaataaagtgctaggggaattcaaagaaggaagggagaaattacagcgggactggtgagggagaaggaaaagtttatgaagaagttggcatttgagatgggccttcatggattgataggatacaccctggaaaagagggggaacaatggttgggatagtattttaagtattatatgtagaacagacttgaaggcagaaaagcatagatgtgttccagagaactgaatggtccactttgcctgaacccctgactcccagatgttcatctgctgatcagtgctgatctcaggtgaagtttttaccaatccgtgcttttaaaagagttaagtacagcataattaaagatgtcattatgtagttgttaattatctttcctgggcaggactgtactgtactctgagattgttattctcttattttcttaataccaaagggtcattttacaaatgaaatgatggtattggtcaatggtgggatttaaaaaaaaatgacttggcaaaagaaaaaggtggcaactgtatgtttctgcctagattttgttttgaaattgtactagtccttgaaattgaagagtctggagccaaaccgtggatggctttgaatgtcatagtaaagaacgtaactgaatttgacaggcactgaagagagtcactgaaagttgtgagcaaactgttctttaggaagatgcccctggtagtctgttagcctagagaagggaaagaagagaggcgaggagcccaattagactatgcagtctgtggaaaaggaaaaagaccttgaattggtttttggcaaggagcctgacaagaatcaggtggttatcagagagcgagtatagaggtaaaatctaaaatactggcagttgattggatataggcagctaaaacaaaagtattacagatgatttctcacattggaggaacctggatgaagggtacatgtgaaccatctgtattctttttgcaacttcttgtgagtcttaaaccgtttcaaaataaaaagttataataaaaaggaaaagatgccgggcaccgctgggatctgtagtcctagctacttgagaggctgaggcaggagcatcgttgagcctaggagtttgagggcagcctaggcaatatacagcgggacgacatctctgaaaaaacaatgaaatgatgatttcttcaggattacaaggtcaaataggaccaagttcacttgagtgggcaaccatcaaagctgaggacactgacctgtcttcagtgggcatcagctgcacaacttcagtccattgttatcatgggaatgtggcccagtgttgcaaaatcttgcaacttttcaatagaagccagaacgttggaatctgggtgttttttttttttttaatgtgaaatctttcagtgtgcaaaacaaattcaaaaacatttttaacactgtaggccaaaccaaacacatctgtgaaaaatctgagttccatcaacccctgctattggttattcctcgtattcatgtgaaactttgggagttgagagggaattggtatttgcacgttgtatctctgaccataaatttaaatcatttacaggtttacactgaaaatgatgtatttccaagttcacaataaattatattcattctccgtagcatgattaggagtaaagtagtgtgcttgagaattccttaccttatatggagacttgtttaggcccagccaaccaaggctgtatgtgtgtgtgtgttttaatttctacctttgcacagcttgcctttacccttgctgtttaggtatttgaaatctttaaaagaattttgtggccgggcatggtggatcacgcctgtaatcccagcactttggtgggccaaggcgggtggatcacctgaggtcaggagttcaagaccagcctggccaacatggtgaaacctcgtctctactaaaaatacaaaaattagctgggcatggtggtgcgtgcctgtaatcccagctactaggggaggctgaggtaggaggattgcttgaacctgggaggcagaggttgcagtgagctgagatcgtgccactgcactccagcctgggcaacagaacagagcgagactccgtctcaaaaaaaaaaaaaaaaagaattttgtaatggattttatataacacatgtttttgtttttctttttagttttaattcacaggtgttgcaagctgacatgttaagaattaggacaaacagaacaacatttaggaatcgacgctctctggtaaggaaatgcttatagtggcctccctgtctaagacttgtgcttattggtctcaaccaatggtcttcaaacttgagcattcacagggagggcttattaaaacacagatggccagcgggagtctcacccccagggtttctgattaagtagatgggggtggagcatgagaatttgcatttctaacaagttcccactttgagaaacactgctctaaacattactgaaggaaaaataaacacattgactacagttatgattgctgcagctgcaacagaattaatttttaaatcccatatggatttaacatcgagattttatgtataagaccatctggtttcccttttttttttttaaagaaaattctaactttgagaggaaaatttgcagactctcctaaaagtaattttcaggcttttagacttttatctcacatttatcttgaattgtaaataagatttgcttttcatggtattatcatgcaatctctaaattataactcttttctactaattatcctgtaaacatagggaatatacttgtagatcagtaagccaaggtgaatacatgattcattatatgattttattgaggtgaaattcacataacattcaattaactgttttaaaatatacaattcaatggcatttagtgtattcacaatgttgttcaaccagtacctctctctagtttctaaagtgcatacatatccttgtcttgttcctcatcattgaatatgattttagctgtgagtttttggtaaatgtcctttatcatgttaaggaaatgtccttctactcctacttgctgagtatttttctttttcttttctttttttttttcttttttttgagacagagtctcactttgtcacccaggctggagtgcagtgacatgatctcggctcactgcaacctctacctcctgggttcaagctattcttctggtcagcctcccaagtagctgggactacaggcgtgcaccaccatgcccagctaatttttttgtatttttagtagagacaggatttcaccatgttggccaggctggtctcgaactcttgacctcaagtgatctgcccacctcggcatcccaaagtgctgggattacaggtgtgagccattgaatccagccttgctgagtatttttatcatgaaagtgtgttgaattatttcaagtgctttttctgcatctcttgggatgatcatgtgtttccccaccttgttcaattaatatggtatattacattgatttttttccatgttgaattacccttgcattcctgggataaatctttttgtatctgtattcataagagatattgacctgttgttttcttgtggtatcttttgctagctttggtatcagagtaatgctggcgtcatagaatgtattaggaggtactcctttgtcttctacttttgtaagagcttgagtaggattttatgttgattcttgttttttgtttgtttgtttttgtttttgtctttttgagatggagttttgctctttttgcccagctggagtgcagtggcacgatcttggctcactgcaatctctgcctcccgggttcaggcgattctcctgcctcagcctcctgagtagctgggattacaggcacccgccaccacgcccagctaattttttgtacttttagtagagacggggtttcatcatgttggccaggctagtctcaaactcctgacctcaggtgatccacccgccttggcctcccaaagtgcagggattacaggtgtgagccactgtgcctggcctggtgttgattctttaaatgtttagtagagttcagcattgaaaccatctggtcctggacatttctttgttgggaagtttttgattacagactctatctcttgttataggtttgttgagattttctatttcttgaatcagtttggtaatttatgtgttatgtgttatgtattatagatttctcttataatatgatttgtaatgtgatagaatctctagaatacattttagtgaaatgttatagcttgataccaatttaaaaatattgctcgtggccaggcgtggtggcttacacctgtaatcccaacactttgggaggccaaggcgggaggatcacctgaggtcaggagttcaagaccagcctggccaacatggtgaaaccccatctctaccaaaaatacaaaattagttggatgtggtggtgcatgcctgtaatcccagctactggggaggctgaggcaggagaatcgcttcaacccgggagttggaggttgtgagccaagatcgcgccactgcactccagcctggtgacagagtgagactttctctcaaaacaaacaaacaaacaaacaaaaacaaaaaaaaatattgcttgctaatcttaaaactggacattttcttcttcatagaatgatattcaatattgttcccacaaatgcattaattttatagtgggagaaattataactgttcattaaataaatatttcttctttctactcatttactcatccattcaacgatatttgttgagcacctgcttgcctctcaaagccttccatacctatccagtcttctactcaacgaagccaacatagtggtttaggacccactatgtattaggccctgatctagttgccagggttgatctaactgagtttggggaggagataacatcttagttgagatcttactgatgtgagagggttagctagtttgggatattggtggcaggggtagacaatattcctggtagaaaacagcatgcttgaagtcctggaaaaggaagtgtggtgtatagataaaagagtgtgtataaaatttgaaagaagtgcattttagctacagtgaaagcaaagatacagtggtgagagatgtggttgaagaagtagactagtgcaatatcttgtagggccttcaagtcatgttaagtattttgcactttatcctagggtcagtgagaagccattgaagagttttgagccaatgattgacatgatcagatttgttaaaagattgccctggctgcagagtggaaagtggattggaagagggcaaacgtatatgcaagaagatcagataggctactgcaatcaccctggcaaagagctgatggtagcttggactagtgtgatggtagtggaaatagagaaaagttccagattcaggagaaatttcaaagatggaatcaatggacggtgggaaacagtggaggcaaacctgactcctaggtctctagcttgggcagctgatgggatggtagtgacacagaataagaagggaccattgcaagaagagtagatttacaaaggaggatgagtttagctttgtacatgttacattggaggttctcttggacctgtaaactagtgatgttcgatgtactagtttgaagctcaggagtgagagctggactagagataaccatttgggaatcattggtagattgttatttaaaactgtgggaattaatgatatgacctacaaagagagtatagaaagagcagagaagaagttgcaggacaaaactttaaaaatcaccaacacttaaaaatcagtcagaagaagagtgatggactaagtagagaggcaggaggaggcttcagaagagagtagtaccatgaaaaaacaaggaaaagtagtaagtcatatgctgtcaagccgtcaaacagactgaaaagtgtcctttgaattaccaaaacagatattactcatgaattcttatatttgaaagcactttcagtagaaggaggagtggggtgagattaagccagatttgattttgaagaataactgagagccaaggacctataaatggcactgtacatccaggctcagttatttgggaggcaaatccctcatctgtaaaatgggaatgtaaaagtaactgctttgtaggtttgttgtggattaccttggtcagtatgaagcactcagcacagcactggcacatactaaatgctcaataaatatgtgggtttttttaaatcagtaatagtacatatagtcagcaaccggtgcacctggctttttaaaaattataattttaaaatctttttttctagtaccaaatacttaaaggatattttttctttctttttttttttttttttttttttatttgagacagatctcttgcccaggctggagtgcagtgacgtgatctcggctcactgcaaccttcgcctcctgggttcaagcgattcttctgcctcagcctcctgagtagctgggactacaggcacgcgccaccacacctggctaatgttcgtatttttagtagagatggggtttcaccatattggccaggctggtctcaaactcctgacctcgtgatccgcctgcctcggcctcccaaagtactgggattacaggcataagccactgtgcccggcgattcttggcattttaaaaatgcataacattccttaggaattctaggctcctaatttgcataacgttcagtttaatataatgtatatttaaaataaaccatcttatataacagattgtgtttggcagaattgaagtcattttaacttattggatgatggggatttcaaggcttgttggtttagcttgctatagcaatactatgcatatgcttttattgtgtctaagtatcacttcattattattataagacataagtaagtatatacttacctttagtatagaactgctgaattttctaggagaatgacatgatgaattagaatgcttttggcaaaagcagtaaaatccaattagaagagacttaaacagcctgggcgaggtgactcaggcctgtaatcccagcactttgggaggccaaggtgggcggatcacctgaggtcgggagttcaagaccaacctggccaacatggtgaaaccatgtctctcctaaaaatacaaaaattagccgggcatggtggcatgcgcctgtaatcccagctactcaggaggctgagacaggaaaatcgcttgaacccgggaagtgaagtttgcagtgagccgagatcacgccactgcactccaacctgggtgacagagtaagactctgtctcaaaaacaaaaacaaaagcaaacaaacaaacaaaaaacagagagacttaaacaataaggagcaataaggagcattattatctcaaataataagaagccccaagaaaaggaggttctaggccgggttagttcagtgggccaatgacatcatcagagacccaggttccttctatctttccaccctaccatcttcagcagccacagttaattatgtaactagtaattagacccagggttcaaaatcaatggatagcaagctcttatatatatttaaagatgtcgagaaggatatctatcaacctatctttagtagatatctctggagcatgacattataggcagaattttatttttactttatgcatttctatactagttggatgtttttcacaaagcatgagcaatacaggtgttttcatttctagtagatattatattacaaaatagaaacattattcttgaaaaaatacaaatattattgaatgatatcataaactataagtttaatggttatgtcctatactggtctatccttaaaattggtgccacaggcatctaaagtagccaaattcatagacacagaaggtagaatggtggttgctaggggctgggaggaggagggaatggggagttgttgtttaaagggtacagttttgcaagggtacaattttaaagggtttcagttttgcacgatgaaaagagttttggagattggctgcacaacagtgggaatgtacctaacactgctgaactgtatacttcaaaatggttaagatggtaagtttcacgttagtgtattttaccacaattttaaaaattggtgctgcttttcatgtatttaaatatgggtaaaacaggctgggcacagtagctcacgcctgtaatcccagcactttcagaggccgaggcaggcggattacttgagttcaggagtttgagattagcctggtcaacatagtgaaaccccgtctctactaaaaatacgaaaaattagccaggtctggtggcacgcgcctgtaatcccagttacttgggaggctgaggcaggagaatctcttgaacccggggagtgaagcttgcagtgagctgagatcccgccactgcactccagcctgggcgacagagacagactccatatgaaaaaaatatatatatacacatatatatgtatatatatatattttatattatatgtgtgtgtgtgtgtatatatatatatatatgggtgtgtgtgtgtatacatacgtatataggtaaaaccgtgttttagaaacaaatcactgtgacagagggcattgaagagccatgggtttttgtgttgaatgaacacaaaaataaagatgcgtattttccaagcattgtaaaaaaaaaaaaaaaaaaaaaaactgttccctcacaattattttgtttaattaagtgcaaatattttcttcacttctctcaggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcattatttctattttaatactttgtttcatgtggaaaaattatctaaggtaattcctttgcaaacgccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctactaaaaatacaaaaaaattagctgggcatgatggtacgtgcctgtagtcccaactactcaggaggctgagacaggagaattgcttgaacctgggagatggaggttgcactgagctgagattgcaccactgcactccagcctgggtgacagagcgagactccgtctcaaaaaaaaaaagaaaaaatatgtataacaaatcctggtgacacatgtttacctatgtaacaaaccttcacatgtacccccaaacctaaaataaaagttaaataaataaaaaattaaaaaatagaaagtaattgtcttatttatgacatgtcattataatacagccaaagtgtcataatttctatagaaagtatatgtatacatttaagttcaggttatatatctttttcattagattataaactttataaaccatagtgtttcatgttatatattgtgaattttctgggcatttgattgatgcagatgtgaaccttagtagcatgaattaaacgtattaaaattctgcctcttcaaaggtgtgtgtgtgtatctgtatatatgtgtatatatatgtatatttgtatacgtgtattctatgtacatatatacatatatacatacacgtatacatatatatgcatatacatgcaaaatgtatacatgtacacatatatatccatgtgtatatgagagtttttcaggaaaacctaaatttttcagattctgttcatgccactgcacaacttctcaattagtgttattaaagggaaacactgaggaagaatctccaacactgtataaatcacaatgttttctgcttgctttgaaagtttgattatttttatagtatgccttaagaatgggcacgtaaatattttttaaattagcaatatttggggttcaaagtaaaaaagaaaaaaaagtcacagtatctaatgttgagagggtatgaggaaataggtattctaatacactactgggaagtaaatttgtataagttttctggagggcagcttggtgatatgtatcaacaaccttgcaacccagaaactccagctctatgaattgatcctaaagaattaattaaggatgtgcacaaacattagcttaaaagatattattacaacattatttataagagctagcaaaaaatatggcaacagcctgaatgtctaacaatagggaataggtcaatcgaaagagccttcgttacgtgtatttgaattccagttctagcaatgactgcataaccccttggacaagttgcttaatcactgtagccctcagtttttctgaggcaaaatgaaggtgataataatgcctacctcatggggttgctgtgagaattgagtgagataaaacgtgtggcacataataaaagtgctgcttattattatggtacgtccttacagtataatattcagcacttaaaatggtgttgcagatgaattttaacatggaaagactcagaatgtattaaattatatatattgagtatatatgctttataatgagaaaaaatgtgagcctatttctgttaaaaacaaaaagatcagggccaggcccggtggctcatgcctgtaatcccagcactttgggaggccaaggcgggtggatcacttgaagccaggagttcgagaccagtctggccaacatggagaaaccctgtctctactaaaaatataaaaattagccgggcgtggtggcgcacgcctgtaatcccagctactcgggaggctgaggcaggagaaatgctttaacccaggaggtggaggttgcattgagccaaaattgggccactggccactgcactttagcctgggtgacagactgagattccttctcaaaaaaagaaaaaagaaaaaaaataaaagatcaggacaaacaggcagagcataggggaattttaggacagtgaaactattctgtaccatactataatgatggatgcatgtcatacaaaacccttagcatgtccaacaccaggagtgaacctaaatgtaaactatgaactttgggtggtaatgatgtgccaatgcaggttcattggttgtaaaaaatgcaccattctggtgagggatgttggtagtgggagaggctgcacttgtgtgagagccggaggggggtatgtgggaactctttataatttctgttcaatttcgctgtgaactgaagagtgctctaaaaaataaaatatattaaaaataaataaatgaaagttcaaataggaaaagactggaaactgctgggtaacaggggacagatagcctagttttataaatacttagcatataattcaaattgtttatgtatcattaaaggatgtattctagagtgtttgatgatggtagtaataatggtggtagtagtaatagttaccatttatttagcacaaactctgtgccaggtgctgtgctaaacacattacatgtattatcaccattatcacattaaatagatgcttaaaacagcaactctagcatgttgttcataacactattgcctatagcaacaaattatatatccaatgtatccctttaatataagttttatccagaaaagatttctgacttttgttagaagggtcagctagtagcattattgatttgaattacaaatttccttaagatatcaaccctggaacatgattagtacaggccagtctgagttatgcgccagtcaagagtccacaactgtcagattttttttattattattattttttgagtcagtcttgctctgtcatccaggctggaatgcagttgatcttggttcactgcaacctccgcctcccaggttcaagtgattctcctgtggcagcctccagagtagctgagattataggcgcctgctaccacgcccggatctttttttttttttttttttttgtctttagtagagatggggtttcaccatgttggccaggctggtcttgaactcctgacctcaagtgatctgcctgccttggcctgtcaaagtgctaggattacaggtgtgagccaccgcatccagagtgacatgtttatacccattctctggatagcaatagaaccaggctcagggctgatgatatgtatctgagtatatctattccaaagttaaatagatggtgctattaggtgtaacctgctcttctcctatgtataacagagtagatcattttcccacagttcaaactctttgagcatgacatttaaagctttctaatatcttcacgcttttggcctcagagtcctttctccctccacgaacttggtgtgccactcacacagggccagtatcctgtcttaaaacatgccaagcactttcacttttctgttgcttatgctggcaaactccttgttctgaaggtccaactgaaataccaccttatgcctttcttatttgtcttccacctcccagcccctacacacacccacttcatctttgctttttattcccaccccactttgctttcatttgacatgcacttccttgtctcttatataaaatctgcttccaagactggtttcttcagtggattgtaaggtctctgagtaataactgagggtaataacaacagcttattagctgtcttttttttttaagaaaaaaattctctcattcccctctgagcagaaaaatagctcattaaacatagcaagtattcaaaaaatagtgaaatacttaacagctagccatattttgacaatagcgaattattgtggtgaagtagttgttgctaattgtcaaataaaatttatatgtagtaaattttcagttacccacataccaattttctattgttatttttacaaccttggctgtttcttctactttctagcaaatgatttgaaaaaaaacaaactgattttaatactttaagcaacatataattagtgaggtgatatattccttaagcagcaatatgatacattttaaaacccaacaaaaattcagactatctgcttcatagaaacatttatttatccaacacatactttattttatgtatgtatttatttatttatttatttggagatggtgtcttgctctgttccccaggctggagtgcagtggcacgatctcagctcactgtaagctctgcctcccaggttcaagtgattcttctgcctcagcctcctgagtagctggggttacaggcacccgccaccatgcctggctaatttttgtatttttaggagagacagggtttcactatgttggccaggctggtctcaaactcctgacctcaagtgatccacccgcctccgcctccccctcccgaagtgctgggattacaggcatgagccaccacacatggcccaacacatactttttgaacactcatcttccctccactcactaactcactcctcttactgcctttcatggccacactccatctattggtttctactgggaaccttagcaacctctttttcaaccttctggtcatttctccaatctacctccttctcttcactctccctttttcatttagaccctcaccatctgtgacctggcctgtgaccctgcgtctagtccctcttccatccaccatcaatgtgttctgcatgatgttgctagggttacctttttaaagcagatatgatcttgtttaaacagctttgaggtttaagaactcagaggaatctatgctctgggtttcctattgtgctcaaaggctaaagtccaaaaactacaatctggttttagcctaatttccctaaatttgtttcctgttgtaccctcgcaggtactaagtttcagccaccctgaacctttctgttccctgaacattcctctctgcctgagtgtttcctctcactccttgaaatgtcctccctcctcttctctatctaatgagttgctactcctctatgaagacttcctcaagacccacacagagttctctgtcctttgaactctgtcctttgaacccaaatcgtaactctgttctgccatttggctgtgacctagtttctgctaactagacttagactttgacttgctcaaggacaggaaaatgtcttatttatctttcgatcttcagagtctagctcagtgctctctctctctctctctctctctctctctctctctctatatatatatatatatatatatgtatatttgtaaaggtgggtgtttgccatcttgcttaggctggtcttgaactcctggcctcaagtgatcctctcaaagtgccggaataataggcatgagcctcccgtgcctggcctccaggtcttttatttttcttaaaaatcccaagtagctgggatcagaggcacatgccaccacgcatggctaatttttgtatttttagtagagatggggtttcaccatgttggccaggctggtcttgaactcctggcctcaagtgatctgcctgccttggcctcccaaagtgctgggaatacaggcatgagctaccgcgcccggcctcattcaatattttgaatgtacaactcaatgtgctcttaagatagaatttgaaactaagatatggtaaacacattatctggcattttaagaaataaccacggtacagaaagagtttacagatgaattctgaaggtaattttcaagcctcattttcacacttagctttaaatccctccattctttcattcccctcttgtgtgggtcctcataagctttgagaaaagactgaaaaggaaaaagtagccccgaaaaagagaaaggacctagacaagaagtatcttagcaaccaagagtaaaatgtgctaaatgacttgaaagtgattaccttagagtcatttcatattatgaaagtttggtttcccagctagattccaggatatttgatgtagttattctgtttatgatttttgggcagtatgcttggcaagctagctactgattcaatgactgtttcagctttttgttctgggtaatacctctacctaagctttaatgatgggctaaaactggcaagaaaaatgaggcaattttaagatctagtgccttaggaaagaaaaggtagagacaaacaaaatcctctattgatgttctgctctgtatttattatgataacagttattttgttctgttttggaaagtgttgatttttgattagtataattttcagtcaagatccagttggatctttttttaactttgaacctaactgatactgttgctggcatgcataagacactaaataaatattttaggtaattcaacattgacttaatgttgagatgtaattaatcacaaacattaaagcaagcttgacttctatattttaaatttcagttgttgccacctcctccctttcatggttccatcagccgccttcatcaaatcaaacaggtaagaagactttccaaactgacagctgttcatttaaaaaagtaaattttatttttctttgtgaaaatacctatgtttcagtaattctaagtgaggtcacgtgtaatattaagtttttatttctaggaatgatttcttcaaaaaaaaaacaaaactaagaagcactttttttggcttattagctattttaattaattaataatttctagaaatactgcatactcttataccttgagtctagcttctttcttccagggatctgaaagtggaatgctacacataaaaattaattttcagcttcataataactgtagttattatttttttaaccctcagatgagtttttttgacagataaaatggccttcatgctattgttttgttcttagtgatctgagttcagggacacattgtacctcactggtttatattttgtgcccatgtgcacgcatgcacgtctctgtgtttgtgtgtttgtgtttgtgtatgtggttgggagggtgtatgtgggtgggtgggtgtgcactcatgtgcacatgcatgcttaatagcacaagcataatacagaattcaaccttttaattatccaaggattagccacagaactcaaaagatcaaatcaccactaccccacaggtggtatttttttctttgacccagctacaagcagacattttttcccccaagagaggcttaacttattattcacttagtactaacaggtactttacatttgtggtctcattttatcttacaacaactttataaggtcagaaactaaaaaggggagaaatttagcaatttacccaatctccagagttggtgaatgtcagagccaagatttggccccagattactggattattttccagctcccctttccctgtttcagtgcacaaagcccataataccatcttgtaatcctagttattagtcctccaactcttgcttcttttccctctctccctttcacccctgtggcatggcttccctaaggtcagcttatccactagcaagaaagtatggtaaaaatggtttttttcctttttttttttttttttttttttttgagacagagtttcgctctgttgcccagactggagtgcagtggctccatcttggttcactgcaacctccacctcccaggttcaagcgattctcctgcctaagcctcccaagtagctgggattacagacgcctgccaccacgcccggctaatttttgtatttttagtagagacggggtttcatcatgttgtccaggctggtcttgaactcctgacctcaggtgatctgcctacctcggcctcccaaattgcagggattacaggcgtgagccaccgtgccaggctgttttttttactttttagtgggtaaaacttgcttttactcctgtctttgtatgtagctattttagaaattcttaaggaatgaaacaagttcaaaggagtaaagtgacctcgtgtttatctgtgcaatatgtttctttgcttctcctaaattaaaccaaatatttgaaaatgggttatgtgttgctatttgctggtgaagcttgatataaatcctaatttacactggttaggaatataagtttaatgcagtttatttccatagtaacataatatgtattataaatatttaaaaatgaaatataagtagaaaatgaatgagatgggaaaagagaaaaacattaattttcaatctggatactgattgaatggaaaattaagacttattttcagcagtttaatggtctgatagatatcttaagttgcatatttcttttttttttttctttgtttttgagatggagtctcactctgtcacccaggcgggagtgcagtggtgctgtctcagctcactacaacctccacctcctgggttcaagggattctcctgcctcagcctcccaagtagctgagatcacaggtgcgtgccaccacacccggctaatttttttgtatttttagtagagatagggtttcaccatgttggtcaggctggtttcgaactcctgacctcaagtgatctgctcacctcagcctcccaaagtgctgggattacaggggtgagccactgtgcctggcataagttgcatatttctttacatgcattctttgactgacttctttgtccctattaaacttaaccttttaagtgcaaaacagaaatgtctggttctctccccattaccttctgaactttcactttaacaacattaataagggcattgatttttcaaaatggggggaataatattggctatctcatagaatcgttttgaggatgaaaagaattacaactgacccttcaacaacctgggtttttaaaaagtaattaatttaatttttacaggtgccatggggtacatgagatactttgatataggtatgcaacatgtaataatcacatcagggtaaatggagtatccatcccttcaagcatttatcctttgtgttacaaacaattcaattatccttttagttatttttaaatgtataattaaattattattgactatagtcaccctgttgtgctagcaaatactgagtcttatttgttctttctaactatatttttgtacccattaaccatcccacttcctcgccacccctcatttacccttcccagcctctggtaaccatccttctaatctctatctccatgagttcaagtgttttaatttttacctcccacaaataagcaagaacatgaggctgggcgcagtggctcacgcctgtattcccggcactttgggaggctgaggtgggcagatcacttgaggtcaggagttcgagaccagtctggccaacatggtgaaaccccgtctctaccaaaaatacaaaaattagccgtgcgtggtgggtgcctgtaatctcagctactcaggaggctgaggctaaagaatcacttgaacctgggaggcggaggttgcagtgagccgagatcgcgccactgcactccagcctgggtgacagagagagactccgtctcaaaaaaaagaaaaaagaagataagttagaacatgcgatgtttgtctttctgtgcctggcttatttcacttaacataatgacctccagtttcatccatgttgctacaaacgactggatccctttttttttttttttttttttttttttgagacagtcttgctctatcacccaggctggagtacagtggcgccatctcagctcactgcaacctctgcctcccaggttcaagtgattttcctgcctcagcctgctgagtagctaggtttataggcccacgccaccacgacaggctaatttttgtattttttgtagagacagggtttcgccatgttgcccaggctggtctcgaactcctgacctcaggtgatcctgcctgcctcagcctcccaaaattctgggattacaggcgtgagccaccgtgcccagcctggatctcattctttttatggctgaatagtactccactgtttatatgtatcacattttctttatccattcatctgttgatgaacacttaggctgcttccaaatcttaggtattgtaaacagtgctgcaataaacatgggaatgtagatatctcttctatatgctgatttcctttttggtgggtgatataccttggagtgagattgctggatcatatggtaactctatttttcattttttgaggaacctccaaacttgaacaacatggatttgaatggcgtgtgatgtgaaaccctcctatacgtatgggtgactttttgtatcctcgggttccagaaggcccactgtggacttgaggatgtgtggattttggtattgcagtgggggggtgctggaaccaattccccacatataccaagggatgactgtaagtaattatgcataatgccaagagtactgcattaaaaaaaatctttttaaatggaaaatttaaaacatggaatatagaatcttcatgtacctaacacccagctttaacaattatccacattttgtacatcctttttcatcgatctgcttctcttttaggggtgggagagagtgctttaaatttctgacatatctttttacccaagtttatgggtatgagaaggactttttttctccataatcacaatgccatcattatgcataacaaattaccttattccttaatgtcatctaaatccatgttatatttttcctaattcttaaaaatgcattttttaactgatccaaacacaatccaaatatgacatttagttgatatatatctcttagatctcttttatttaaaacagcatttttattttattttatttatgttccaggatacatgggcagaatgtgcaggtttgtcacataggtatacgtgttccatggtggtttgctgcacctattgatctgtcatctaggttccctcccctcaccacccaccccgcaacaggccctgatgtgtgttgttcccctccctgtgtccatgtgttctcattgttcaactcccacttaggagtgaggacatgcattgtttggttttccgttcctgtgttagtttgctgaggatgatggcttccagcttcattcatgtccctgcaaaggacatgatctcattcctttttatgactgcatagtattccatggtgtatatgtaccagattttctttatcctgtctatcattgatgggcattcaggttggttccatgtctttgctattgtaaatagtactgcagtaaacatgcgtgtgcatgtgtctttatggtaaaatgaattatattcctttgggtatatactcagtaatgggatttctgggtcaaatgatatttctggttctagatccttgaggaatcgccacaccgtcttccacagtggttgaactaatttacattcccaccaacaatgtaaaagcgttcctatttctccacagccttgccagcatctattgtttcttgagtttttagtcatcgccattctgactggcatgagatggtatgtcactgtggttttgatttgcatttctctaatgatcagtgatgttgagctttttttcgtatgtttgttggccacataaatgtcttcttttgagaagtgtctgttcatatcttttgcccactttttgatggggttgtttgttttttcttgtttcagttccttgtagattctggatattagacctttgtcagatgggtagattgcaaaacttatctcctatgctgtaggttgcctgttcacgctgatgataatttcttttgctgtgcagaagttctttagtttaattagatcctatttgtcaatttttgcttttgttagaattgcttttggcattttcatcatgaagtctttgcccatgcctatgtcctgaatggtattgcctaggttttcttctagggtttttatggttttgggttttacatttaaatctttaatccatcttgagttaatttttgtataaagtataaggaaggggtccagtttcagttttctgcatatggctagccagttttcccagcaccatttattgaataggaaatcctttccccattgcttatttttgtcaggtttgttgaagagcagatggttgtatatgtgtggtgttatttctgaggtctctgttctgttccattggtctatatctctgttttggtaccagcaccatgctgtaaaacagcattttctgcctgttttttgttccatgcctcttatttattgaagaaaccagggagtccatttgtcctgtaaaatgtcccacattctgattttgcttccatgtggtgttactatgttgttttatcctctatttcctgttaaatagtttttttaatttttatttatttatttatttagacggagtcttactctgtcgcccaggctggagtgcagtggcacgatctcggctcactgcaacgtctgcctccctggttcaagcgattctgtaacctcagcctcccgagtagctgggattacaggcgcccaccaccccacccagctaaatttttttttttttaagtagagagggggtttcatcatgttggccatggtagagagggggtttcaccatgttggtctcaaactcctgacctcaggtgatccgcccatcttggcctctcgaagtgctgggattacaggcatgagctaccgcgcctggcctcctgtaaaatagtatgatgaaatttgcttttaattttaaatgaacacacagctccaagtcaatgttaggttctgggccaatatttggtttatgttacacctttcctattaagcaggtaatggacaatttcttctcaactgttgttgttagctgttttctaagtattaaagagactgagacatcaagctagaagttaattttctaaacacagttattattcctacataggaattattttgtgtaattttcctttctaataaaaattttattttatttatttatttttcagacaggttcttgctgtgttgcccaggctggagtgtagtggcatgatcatagctcactgcagcctcaaccttctgggctaaagtgatcctcttgcctcagcctcccaactagctaggactacaggtgcacaccactatgcctggataatttttttattttatttaattaatttatttatttctgagacggagtctcgctctgttgcctaggctggagtgcagtggcatgatctcggctcactgcaaccttcgcctcccgagttcaagcaattctcctgtctcagcctcccgagtagctgggactacaggcacccaccaccacacctggctaacttttgtatttttagtagagacggggtttcaccatattggtccgactggtctagaactcctgacctcaggtgatccacccgcctcggcatcccaaagtgctgggattacaggcatgagccactacgcctggccatttttttaaatttttggagagatgacgtctccctgtgatgcccaggctggtcctgaaatcctggcctcaagtggtactcctgcctcaggctcccaaagtactggcattacaggcatgagccaccacgtgtggcccctaataaaaattgagcttgtattccaaaagatccgaatgcattcagtctgtagttccctgtttcccaaagctctaaacataaattagtgccatgcagaaacagtttgtatatttgctcaggctgccattgcaaagtatcacaaactgggcggcttaaacaacagaaatatattgtttcacatttcttagggctagaagtctgagataaaggtgtcagtagggttgattccttctgagaactgtgagggaggatctgctccaggcctctgcccttggcttgttgatggctatcttcatgttcacatagtgttctccgtgtacatgtgtttgtttctaagtttctccttttcatgaaggacagcggtcatattggattagggcccaccctaatgacctcatcctaatctgcttgcttctgaatatattctgtctctaaataaggtcacatcctgaggcactggggattaggacttcaacacaggaatttgaggggacacaattcaacccataacagtctgctcacagttttttgttatatagctttatatttaattcctgatttgttaaacaggatatgagtcattggcacccagtaacaacttaactttctctgtagtgtcttaagtaaaaatcaataagaagaaattgagctgggcgtggtggttcgtgcctgtaattccagtgacttgagaggccaaagcaggaggatcacttgaggccaggagttcaagaccagcctgggcaacataagaagactccgtctttaaaaaaattttttttttaatttgctggccgggcacggtggctcacgcctgtaatcccagcactttggaaggccgaggcgggtggatcacctgaggtcaggagttcgagaccagcctgaccaacgtgaagaaaccccatctctactaaaaatataaaaattagccagacctggtgaggcatgcctgtaatcccagctactcgggaggctgaggcaggagaatcgcttgaacccgggaaccagaggttgcagtgagctgagattgtaccactgcactcactccagctggtgtgacaaagtaagactccttctccaaaaaaaaaaaatttaaatttgattttagtttacagattgtttcattctttcaacaagcctttattgggtactgtgcaggcactcagtaactaaaatctttcagatgtagtctcctcggagagcaaaagttggtaacttacagttcccatttttaccatgtatcctgaaaaatggaaagctaactttaacatccaagtataacaattctccttaaactaggtttctagtatactgtactctgcttcttacagttataatgcatggctgttgaccttttatacttattttaataatcttattttattataaaccatctcaaatccattttggaaataggcaagacataaatgaaaaagagtcaacactcttctcctaacaaccttcaatagctgattttagctaatgctccaactttcagtgggaggaatattaagcagaattctatctcagtttcacaaaactacctgctctgtacttgttgaccgaatgaactacaaaatactttgagtttcacactagaggagactatctatataatattaaattgaagaactatactaacaattacattttgctgaatttactgttattccattgcttttaaaagactaattatcttcttaaattaccttttccaattccctcattttctgtacctcattgtgtggtatcaaaatagtcacagttttaagactcaaagctctcgatttgatacctcattgtatggtatcaaaatagtcacaggtttaagactcaaagctcttgatttttcttcagttcttccttatttttctactgtatccaattaggcttctaatcctactaattcttccttgacaatatcctctttgttgtcactgctgcttccttcttctgtcccatgggtctagattactgaaataatatcccagtagattttctgtttctcccagtttatccaacttccacaatgaagaccaagataaatgttttttttttttggaacagagtctcgctctgtcgcccaggctggagtgcagtggcgcaatctcggctcactgcaacctctgccttctgggttcacgccattctcctgcctcagcctcccgtgtagctgggactacaggcacctgccaccacgcccagctaattttagtagagacggggtttcaccgtgttagccaggatggtctcgatctcctgacctcgtgatccaaccacctcggcctcccaaagtgctgggattacaggcacaagccactgtgcctggccaaattttttttttttaaaaaacatcattttcctccctctccctctccccctccccctcccccctccccccctcccccctccccctccctctccccacggtctccctctccctctctttccacagtctccctctgatgccgagcggaagctggactgtactgctgccatctcggctcactgcaacctccctgcctgattctcctgcctcagcctgccgagtgcctgcgattgcaggcgcgcgcagccacacctgactggttttcgtatttttttggtggagacggggtttcgctgtgttggccgggctggtctccagctcctaaccgcaagtgatctgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcatctctgcctggccgcccatcgtctgggaggtgaggagcccctctgcctggctgcccagtctggaaagtgaggagcgtctctgcccggccgccatcccatctaggaagtgaggagcgcctcttcccggccgccatcccatctaggaagtgaggagcgtctctgccccgctgccccgtctgggatgtgaggagcgcctctgcccggccgcgaccccgtctgggaggtgaggagcatctctgcccggccgccccgtctgagaagtgaggagaccctccgcctggcaaccgccccgtctgagaagtgaggagcccctccgcccagcagccgccccgtctgagaagtgaggagcccctccgcccggcagccacaccgtctgggaagtgaggagcgtctctgcccggcagccaccccgtccgggagggaggtgggggtcagcccccgccaggccagccgccccatccgggaggtgaggggtgcctctgcccagccgcccctactgggaagtgaggagcccctctgcccggccatccgccccatccaggagggaggtgggggggtcagtcccccgcccggccagccgccccgtccgggagggaggtgggggggtcagccccccgcccggccagccgcctcgtccgggaggtgaggggcgcctctgcccggccgcccctactgggaagtgaggagcccctctgcccggccagccgccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaattcttctgccttgggatcctgtagatctgtgaccttacccccaaccctgtgctctctgaaacatgtgctgtgtccactcagggttaaatggattaagggcggtgcaagatgtgctttgttaaacagatgcttgaaggcagcgtgctcgttaagagtcatcaccactccctattctcaagtacccagggacacaaacactgcggaaggccgcagggtcctctgcctaggaaaaccagagacctttgttcacttgtttatctgctgaccttccctccactattgtcctgagaccctgccaaatccccctctgcgagaaacacgcaagaatgatcaataaaaaaaaaaacaaaaaacaaaaacaaaacaaaaaaaacatcattttcactttcttccccccatacaaaatgtcacaatggcttcccattacctattgaataataataaaaatagctaatatgtgttaagcactgaactgtttgccaggcagtgtgatgagaactgtacagccacctcatcatcctcattcttatcgtcatcttcatatggatgaagaaactgacgctcaggtgacgtcacctgcctaagtttgcacaggtagtaggttatagagctgggatttgactcagttctgtttgtctccaaagccggggtcctgacaatgacgtgattctgcccaaattctttaaattcaaactgtttgattatttaagaacctgtaaaactggccctgtcttacctctcctgttttctctctcattactttgtagcacaaactcagtttcagccaaggtagtctcactatctccaaatctgttgtatttttttccctctcctaaacttttgttcatatgggttcttctgcttggaatacccttccctctactcactgcttgttcatattttatacatctttgaaggactaggtcaaatatttatttatgtatttatttatttattgagacagggtctcatattgttgccaggctggagtgcagtggcacaattgtggctcactgcagcttcaatctcccaggctcaaaagatcctcccacttcagcctcctgagtagctaggtctactgacatgtgtaccacatgtgcccggctaatttttttttttcttttagtagagatgaggtcttgttgttacccaggctgatctcgaactcgtgagctcaaggattcctcctgccttggcttcccaaagtgctgggattacaggcataagccactgtgcgtggccaaattttaattctttcgcacaactcacaccactcttctattatggactaccccaaacatgtattatttatactatagacgaaaatctttaaactcttttgatcacacatcacatcaggagaaaatgtttgagtacatgcctccaacataggtacactgcatttacttatacattttggacatataccactgtgctattatgtgaatcatagaatatatataaagtagaaatataaaaaaggatgagataaggatgaaacgatgtttttagaaaatttaaaaatttggctgggtgcagtggctcacgcctgtaatcccagcactttgggaagcagaggtgggtagatcatctgaggtcaagagtttgagaccagctggccaacatggtgaaaccccatctctactaaaaatgcaaaaattaactgggtgtggtggcatgcacctgtaattccagctactcgggagtctgaggcaggagaatcgcttgaacctgggaggcagaggttgtactgagccgagatcgtgtcactgctctccagcctgggcaacagagtgagattctgtcaccaaaaaaaaataaaaataaaaataaataaaaaaataaaatcccagttacttaggaagctgagacatgagaatcacttaaacctgggaggcagaggtttcagtgagctgagattgcaccactgcactccagcctgtgtgacagagtgagatcctgtctcaaaaaatatataaaagcaacaacaaaaaaactatcctaatgggggtaaagtggcatctcattgtggttttggtttgcatttccataatgacaaatgatgttgagcatcttttcatgtgctttttggtcatttgtatgtattctttggagaaacattcagtctctttactcatattttaattgggttggtttttgttgtcactgtgtggtaggagttctgtatatattttggatattcattccttttcagatatatgatttgcagatatcttctccaattatccagttgtcttttcactctcttgatagtgtcatttgatgcacaaaagtttttttaatttctctgggcgcggtggctcacacctgtaatcctagcactttgggaggccgaggtgggtggatcacgaggtcaggagatcgagaccatcctgtctaacatggtgaaaccccgtctctactaaaaatacaaaaaattagctgggcgtggtggtgggcacctgtagtcccagctactcaggaggctgaatcgggagaatggtgtgaacctgggaggtggagcttgcagtgagccgagatcgcgccactgcattccagcctaggcaacagagcgagactccgtctcaaaaaaaagtccgggcacagtggctcacgcctgtaatcccagcactttgggaggctgaggcaggtggatcacctgaggtcaggagtttgaaaccagcctggccaacacggtgaaaccccatctctgctaaacatacaaaaattagctgggtgtggtggcgggtgcctgtaatcccagctgctcaggaggctgaggcaggagaattgcttgaatccgggaggcagaggttgcagtgagctgagattgcgccattgcactccagcctgggcaacaggagcaaaactccgtctcaaaaaaaaaaaagcattaatttggccgggcgccatggctcacacctgtaatcccagcactttgggaggccaagacgggcggatcacaaggtcaggagttcaagaccagcctgaccaacacgtgaagccccatctctactaaaaatacaaaaattagccgggcctggtggcatgcgcctgtaatccaagctactcaggaggctgagacaggagaatcgcttgaacccaggaggcagaggttgcaggagccgagatcacaccattgcactctagcctggccaacagagtgacacgccatctcagaaaaaaaaaaaagttttttaattttgatgaagaccagtttatctgttttttttctcttgttgcctgtgcctttggtatcatatccaagaaatcattgtgaaatccagtgtcatgaagatttaaccttatgttatcttctaagagatttagagttttatcttttaagttaaagtctttaattcatttcgagtgaatttctgcatagggtaaaaaaaaaaaagggggttcaacttcattcttttgcatgtagagctccagttttctaaacatcatttgttgaaaagattgtcctttccccattgaatggtcctggcatcactgttgaaaaccatttgatcatgtattatgtaaaggcttatttctttttttttttttttttttttttgagacggagtctcgctctgtcgcccaggctaaagtgcagtggcgtgatctcggctcactgcaagctccgcctcccgggttcacgcaattctcctgcctcagcctcccgagtagctgggactacatgcccctgccaccacgcccaactaattttttgtacttttagtagagacggggtttcaccatgttagccaggatggtctcaatctcctgacctcgtgatccgcccacctcggccgcccaaagtgctgggattacaggcgtgagccaccgcgcccggcttgaaggcttatttctgtgcgctctattctgttccattgctatatgcatgttcttttttttttttttttttttttgagacagagtgttgctctctgtcattcaggctggagtacagtagtgcaatttcagctcactgcaacctttgcctccaggattcaagcaattcttgtgcctcagcctcctgagtagctgggattacaggtgtatgctaccacacttggctacattttgtatttttggtagagaagaggtttcaccatgttggccagactggtctcgaactcccaacctcaggtgattcgcctgcctcggcctcacaaagtgctggtatgcatctgttcttatgccagaactacactgttttgactatgtagttttgtaggaagttttgaaatcagaaagtatgaatcctccagctttgtgcatcttttcaaagactgctttggctatttggggtcctttaatattccatatgaattttcagatgggtttttctgtttctgtaaaaaatgtgattgggactttggtaaggggcgcattgcatctgttgatcactttgggtggaattgtcatctaaacattgtcccaatccatgaacatgaatgtctttctgtaggtgggttattaaaaaaaaaaaactacctatgtgaaaatgatacttgtatattaataaaaagtcaaataatatagcaatgtacaaaggaagaaagaacacattactccagatctcactactcattgataaccactgttaagtttctggtgaacatctttctgagcacctctcttacaattttacataaataggatccatttgtctcccatttaatatgtaatagttgttttctgatgtcaatgactagatttaaattatgtttgtctcatcatttacttaagcaaacttaccctgatagacatttaatttgttgtctgtgtactgtgagtaatttttattaatatcatagtattaatggccatccatagctattgtggactagtttcttctctgtcctagtagacctttaaaaagtttagggaaaactgtataattttgaatgcttaatgttgttgcttttgaataaagaaaagtacaaagtttttcatctaatcagttcctgcatatctgatgtactgtaatgcataaataatagatctttggtgtgataatttgtgaagcaataaagggcagagaaccagatacttgtttagagatttatttattctctagttcttctatagcctagtgaataaaaataatggtgcatccaaatgaaatcaaattttataaaaccataggaactgggtattcagtttattctcattttcctacctttacaggaagaagccatggatttaataaatagagaaacaatgtctgaatggtgagtactgtactttgaattactattctgataatttgtatacttaattatatcttttctttcagataggcaaactgcagttttgatttcttttgtaggaagctacaaagtgagatacagataagtcactcttgggaagaaggcttgaaactggtatgatattataacttcagttttgtagaaaatttcaaatttttactgacttacagtgtcggcatatctagttttgctgtaatttctagaaatctaagctctattttgaaacaaaaattgtatctgttgcataaataatttttgagtgctctttttaatttttttttttgagacaaggtctcactatgttgtccaggctggtcttgaactcctgagctcaatggatcgtcctgcctcaacctcccaaaatgctaggattacaggcttgagccattgcgcctagcccttgattgctcttcagaaatacttcatgatttactcataaaaatagctatcattatttgaaagtggggttcaaagtaaacagttttgtgacacaaaaccatagctattgtggaccagtttcttctctgtcctagtaggcataataaaagttcagttgcactagttaaagtgcttagataacaaaacaataaatgatttcactcccttctccataatttatgaactatatattaggagtcttaaaccacagacaatagactctctagaaaattattgcatttttatgcctgtgtgttagtccgttctcacattgctataaggaaatacccaagactgggtaatttacaaaggaaagaggtttaattgactcacagttctgcatggctggggaggcctcaggaaacttacgattatggcagaaggcacctcttcacagggcggcaggagatagaatgagtgccagcaggggaaattccagatgcttataaagccgtcaaatctcgtgagaactcactcactaccacgagaacagcattggggaatttgcccccatgattctattacctcccaccaggttccttccacaacacgtggggattatggggattacagttcaagatgagatttgagtggggacacagccacaccattatcagcctgtaacacattctcccactaacattttaatataaaacctttaatttaaacatacttagaatttagtttcatctcttgttaacatttttaaatgtctgtgtgcacactgtggttacctagttgtggtagctgaatgatatttagtgttcttttctatggacatcccagatagtgacaaaacaagtactgagctgaaaattgaataggagagattctaactaatgtcaatcttcagatttgggaattatttgatatggaaatggatcatcagcagaagcaatggcattttattttcctttgagccctgagtaccttacatgagcagttatccctgattttggagtaggtccaggagaatgagtaggtcatctctggagcctgtcactttttgtgttttggtgctaatacaattgatcgatactgctggagtcctttaactggcccaattctaattactttaggtattggcatggatgagtaagagaatcgtaagtgtgttaggaagaggaagggcacatgtaatacacacttggcttgttttagaaagaaaagggcagattttaaaatcctgaattatgaagtactgattttgtctatgtaaaatctagagacaatttccataaatgtagttattcctgctgtctcatttgcttctaagttctagccaaaacctttttggtcctttcctggatgtagtattatagttttcaataacaaagcacaggtcaaagccaaagagaagagcttaaatttaggatttgtgtttatagtgttgagtactcacattctaggactttctggcatgctgggaagcccctcaatcaccatatagccctcatccccaaaagggaaaagggtgcctttgcttattgaagtgaattttgggttccctgattgctttaggatggcgagagctcttcaccatggtgcagccagtgactcagtagtaaggactcacttccctgtgcaacaggtatctcaagtatttgattaataagcaattggtgctacaattgtacactgctttctgcttacacagaatgacaatggcttacagaaatcatcctctctaaagtgcattgatttaactccagtatcctcaatggcttcttccatcaagaagactgggaaggtaagaaaggagtacctaaaagtctatgtctcttgaaatagttaggaaatatttaggaacattaatggtcaccaaaacaaatattttgggggatatattttgtcacagtacatctgattctaactaacatttttcccttctttttcatttcttcaagtattacttacatgtaataaaattcaccaactttaaagcatagggttagattaattttggtaattgtgtacaatcctgtagccacaaccataatcaagatattgaacagttcccacactcaaaacaatttcctaatgatcttttgtaccccagtctccctccctaccatccctgcccctccctaggaaaccaatgatctgctttccgagaaaagtggcggttttaaaacctctgttccaatttgattttagcagtgtttctctccatcattacaaacttgtgtgagttgcactggttcgccttcaagtcctattcccagtcctatgcaacaatacatcatgtaagtttatgttatatgaaaataccaaattgcttataaaataagaattatagaaacctaaaagaaattatagctccaagttttgtgccaaccaaagaagtgacttctttttagggaaattaaaatgtcattgtttcggctgggcacggtggctcctgcctgtaatcccagcactttgggaggccgaggcgggtggatcacctgaggtaggaagttcaagaccagcctgagcaacatggagaaaccccgtctctactaaaaatacaaaaatagccgggcatggtggtgcatgtctgtaatcccagctactcaggaggctgaggcaggagaatcgtttgaacccaggaggtggaggttgtggtgagctgagatcgtgccattgccctccagcctgggcaacaagagcaaaactccatctcaaaaaaaaaaaaaagtcactgtttcagtttatcattttgtatattgaaaaagtcaggtgactaagaacataagaagaatttagtaattccttcaccctgctaatacataatctttctctaaccaagtttgttaataaggatcagagctatctctagaactttaaacaacttcatccgtgattctcaccttcattcaaggcaagtcccagccaggaatgtaggtttttgtagactctaggattcaaaatcctgaatccttgagaattagaagatagtttgctcctaaggcattccagtttttacccatatgtaaagaaaagcagtaaaatggccgagcatggtggctcacacctgtaatcccaacacttttggaggccaaggcaggcagatcacctaaggtcaggagttcgagaccagcctggccaacatggtgaaaccctgtgtctactaaaaaaatacaaaattagccgagtgtggtggtgcatgcctgtaatcccagctacttgggaggctgaggcaggagaatcacttgaacccaggaggcggaggctgcagtgagcttaaatcacgccactgcactccagcctcggtgacaagagccaaactgcatctcagaaaaaaagtaaaaataaaaacaaagaaaagcagtaaaatgatgtaatatcctacacagagtcccgtttttgtgtatgtccttagatctgttataatgaaatagtcattgttgattttgttaaaaaaaatttcttataatgatcatgatgattttattttagaagaagtcaaaatcctaccaacattattagaccaagtatccttggaccattaaaaagaaaaggtacttttatctaacagtagaagtaaatataactttaagttattttataaaatatctaaaatcaaatgttatacaaaaatgtatttttaaaggctttatttatttaaaatatatttaataagctattagaggcctttcattttatgcaactagaaatatgtataaggacattttgaaaactctaaaatgctatataaatgtgaattgagaaatttaattccaatttagttggctattaggattttcaatataattcaccaaggtagctatcttcattactttctaaaacaatgtagagaataaatgaatgaatgaacagagtgagtcagtcatcaagtattttgctgaatgtcaacccctgcctcactgccacacacacacattgctatcatatgaataagttgacacaaattagatccacttacaacactaaaaatatatatgaaggtgtatgttctttggtgtttagtttctttatgggagttatttttggttaaatatatggaaagtgacccacctactcagtaataaaagggcagtggaaagaataaaagggcagtggaaagatgtcttttttaaaaactcctgcaatcctggatcccacttctcaatggtacctcactaaattatgctcttcttccttttttttttttttttttcttgagacagagtcttgctctgtcacccaggctggagtgcagtggcacaatcttggctcactgcaacctcttcctcccgggttcaagcgattctcctgcctcagcctcaccagtagctgggattacaggtgcctgccaccatgcccagctaatttttttgtatttttagtagagacagagtttcaccatgttggccaggctgttctcgaactcctgacctcaggtgatccacccacctcggcctcccaaagtgctgagattgcaagcataagcctgtatatttagtacaatttttgactacaatggggaggggaaatgggtgaataggaaaggagattaaacttaaaaatgtgtattgtgaaaaatctattaaggtaagaaagaggagtaagaagaataagaggagagaaactgaaatatgctttaatgttctttgtatattttcgattaattaatggcagtcttcctaacaacataactaactcagcatgtactttttgtattctaagattaagggctagataaattctggaaaatactcttttccaaagtaagcacattgttttatgaagatgcttcggttactaagcttaggggtcttttacctgtgctgtgaaattcgggctagtgttgaaaaaatattcaaatatatcagcagtttaagagctgttagaagtcaagggtcaattgagtatttaaaataaagtacgcttaaattgaggagtgttttaccagattaaaatagttctccttttgagacatgtatacataaataggttatcacatgaaaagtatctcgagttttcttagaatttatgattgaaaaattatttttatagatcaattttaacataaaagatgtagtttctgcccagtgtcttcggagatgtgacctgtctcacacttggttttcagctgctctgaaagacgactgccttattcctttgaggtgtccctgagggaactccaaagcgaattctgtatataccacctagtccatattttcagtcataccccaccctccaaagcatgccctgtacaaatgtgctgaaaattcatttggccatttttggccagatacaataacagataaacagaaattgaaatttattcatatattttggaatatgcatattcatttgggaaacaacaaactatgtcctatttggaccccattaatacaaatgaaatgtgggagaaaggtaccataaaaataaaagagaggtcctgaggcagggggcggggggaactaaaaagaatgatgattatgtgaagtgagatcaagattagagtctccaaagcatatgatgtcatattttatggtgagaagcagcagtgacttccattaggaataagcaagagcatgggccgggcacagtggctcatgcctgtaatcccagcactttgggaggccgaggcgggcggatgacttgaggtcaggaattcaagaccagcctggccaacatgacaaaaccctgtctctactaaaaatacaaaaattagccaagggtggtggtgtgtgcctgtaatcccagctactcaggagactgaggcaggagaatcgcctgaatccaggaggcggaagttgcagtgagccgagatcacaccactgcactccagcctggacaacagagtaagactctgtctggaaaaaaaaaaaaaaaggaataagcgagagcaaataagccttcacatcggaatactgcagaaattgggcagctataaatatcgtttgacaagtaatgctggttttagcaaagaaagatctaattttcttttatgaggaatatgttttgatttgtcatgttttcaatgttaaaccaaaaaagagagctgagtagtttttctgtagtgacataaatgtaatctggcaaggcacgggacaccagacttcttttaaactttatgagccatgattacacttctgtggaaggtctatgcaatatcttaatggtgaccttagggttttatcattcaaatagaagttatgggcttgaatgtcagttttgctcaggtccagaaatgattatcatatgaatgtgaaacactgtgcagattttaacatttacttcaaggcaaagattacaaaaatgcagttgttgttttttttgagattagatgttctaccttaatctctaaagatacaattattttgttcattgtgtgctgtaaaagaacttacctatttagttcattgtgtacatttagcaaaataaagatagcaacaacctaaagttttaaaataaggaatgacattaaactcattaaacagccttactacatagctatatcaaatcatcttgcaggccgggcacagtggctcacgcctgtaatcccagcattttgggaggccaaggtgggtggatcacctgaggccaggaatttgagaccagcctggccaacatggtgaaaccccgtctctactaaaaatataaaaaatagctgggcatggtggtttgcacctgtaatcccagctactctggaggctgaagcacgagaattgctggaacctgggaggtggaggttgaagtgagcccagatcatgccactgcactccagcctgggtgacagagcgacttcttcacaaaataataataataataataataatatcatcttatagaatttagttaataatataagaaaattataatcattgaaaacaaaaagtaaatctaaaaacattatatacggtacaaacccaattttatttaaaaaacaattgtgtatacaacatattcaaaaattactaaagaatggttatgtctggataatgattacttaaaattgttttctttgtgcttttctgtattttataaattaattgcagtgaataagtattacttttgcaattaaaataataataaacatgttaaataaaacatctaccttgatctgctgtattgtcataggtgaaatggcatttcaatatcaaccaaaaaagattttccaaggcacaaccaacatgctttcttctgatacttcccaactgtcagaaaataatgtgtagtgagtattaacatgagattttaaacattcattgatcatttttgcttcgttgttaagtctactttggctattgtacgtattcagaagtatggtacattattaactgttcttagaagttttaaaactaatattccaagtggatactataaacctgagttattttattttcttttttttctttttctgaggcagggtctcactctgtcacccaggctgggaatgcagtggcacaatcttggctcactgcaacctccacctcccaggctcaagcagtcctcccacctcagcctcctgagtagctgggaccacagtagctgtgcaccaccgcgcctggctaatttttgtattttttgtagagatggggtttttccatgttgcccaggctggtctcaaactcctgagctcaagcaatccgcttgccttggcctcctaaagtgctgggattacaggcgtgagtcacgtcacctggcagagtgtttttcttatgagatgtgtgtgacactaatatatggtggatacatttttagaagtgagattttggcattagattaagagatattagagaaatacataaaaatgcatccttggaaaaagtcatcttctgcccatcttccttggatttttgtctaccttgttgggttgagagtattattgaaaagcatgcctaagaaagcatgtcttaatgataaaaataggaaatactggaatagatttctttctttttttttttttgttttgttttagacggagtctcgctctgtctcccaggctggagtgcagtggcaccatctcggcttactgcaacctctacctcctgggttcaaacaattctcctgcctcagcctcctgagtagctgggactacaggcgtgtgccaccacacctggctaatttttgtatttttagtatagatggggtttcaccttattggtcaggccggtcttgaactcctgacctcgtgatccacctgccttggccttgcaaagtgcttggattacaggcataagccaccacacctggccatggatttctatttattgttactggtggtttcattgtatgactcttaaaaaactttgcttgtgacaagtgccagttgttagtcatgtattttgcattcatgtgtagacaaagcagagtatacagagagatctcttgagttctgctatcaatgagtggcattttcttcttctagtctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaagtaaaatgatgtttgacaattatgt

SEQ ID NO: 3752 - DNA, 628 bp, human
atgggaggaggacgaggacttctaggccgggagaccctcgggcctggggaccggtgctctgggaagggtccgctgtgttactggccgccgccagggtcgccaccggcgccctccctccgcgcctccctccccctcgagccgccacgatgtcccctgcgctcctgtcccctcccgcgtagtgcttgcctttgttccaggaatagcgctccaggctcctgctgccgcccctgggcctcactctggagcgggctgcctccgccctctcgtgccagctcagcccctcccatgcacatttggacgctgtcctgcgctccagttgcacaaagctgagctcctgttacacactgacagaccactgacagccgccgctgccaacccccctcctcctcaccagacttccagacgactacatcatgctgcccacagacctgcgctgccactgccatcgccatccatcgcattccaccgacagactgctgcttctagtgatctgtactcacctcggaggtatctgggctggacacagcccctggacaatgatccagacagctggctgcccctcaagggacctgttaccttcagcgagacccatttcctccccaatcccagagactttttgtgctcctgc

SEQ ID NO: 3753 - DNA, 2016 bp, human
tacgcctcggtgcagcccccggcgaagcccagcgcagctcagctaaactcagcggagccagcgcggcgcgatggaaggtcgagtgcagctgatgaaggccctcctggctcggcccctccggcccgcggcgcgtcgctggaggaacccgattccctttcccgagacgtttgatggcgataccgaccggctcccggagttcatcgtgcagacgagctcctacatgttcgtggacgagaacacgttctccaacgacgccctgaaggtgacgttcctcatcacccgcctcacggggcccgccctgcagtgggtgatcccctacatcaagaaggagagccccctcctcagtgattaccggggcttcctggctgagatgaagcgggtctttggatgggaggaggacgaggacttctaggccgggagaccctcgggcctggggaccggtgctctgggaagggtccgctgtgttactggccgccgccagggtcgccaccggcgccctccctccgcgcctccctccccctcgagccgccacgatgtcccctgcgctcctgtcccctcccgcgtagtgcttgcctttgttccaggaatagcgctccaggctcctgctgccgcccctgggcctcactctggagcgggctgcctccgccctctcgtgccagctcagcccctcccatgcacatttggacgctgtcctgcgctccagttgcacaaagctgagctcctgttacacactgacagaccactgacagccgccgctgccaacccccctcctcctcaccagacttccagacgactacatcatgctgcccacagacctgcgctgccactgccatcgccatccatcgcattccaccgacagactgctgcttctagtgatctgtactcacctcggaggtatctgggctggacacagcccctggacaatgatccagacagctggctgcccctcaagggacctgttaccttcagcgagacccatttcctccccaatcccagagactttttgtgctcctgccacatggctgccagggctcagttgtgcctggcagccaaatcgagtctctcattttctcttgtggaccagttagttttgcccagaatccatttctcttctgaatttgcagcattttctcaggtgctttttgatcaacaaaataacttgtatcttctgcttaactcctttatactacctggagaaaagtattttccatattttcaataaatgtcagacactattgagaaagaaatagagtctgaatgaatatggcacctttccctccctggtcctgtaaatgtggtccatatcttgttcagaagcgatatcccctgccattcagtgactgatgttgactcctgcattataaaacatctaagatagagtcctgtggtaacctgggggatagtgtccccactggtgatccttctgtcccagatgttgaatcctctaaaccagttaggattatcccaagcctcttagtaaatgaatcgttacctcattttggtcaacactatgtgagaagtcagccagcaggctcttggaaaatgtatcctcatttccagaaagtggtttgaaaacacaattcccaaattgttacaaaccataaatcccacacagattattggtgaacagctgtaaaattttactcaacccatgattcagggaaccaacagaattatataggtgcttttcaaaagcatttataaattcttgattatgtaggtagtggggggaaatgcagaaatgagatcattaatttagatacaaacctggttgatgaccagggggttttattttgcagaagaattgggtatttggtatcattttattcaattacatgtgatcctggtacatttcataagcttgggtaaaaaaattttttgttattttccatgcacaataagggaaatgttttaattggctttgtgcctcctgctttacaacagttctggcctcaagttaccaggtagcctgaactttgattttattttaccattaaattgctttaataccattgt

SEQ ID NO: 3754 - DNA, 3245 bp, human
ggggcgacagtgtccccgcccgcccccggccgggtcgcgggcatgaaggacagctggatcgcggcggggggcggaggtggggcggcccgggcccctggactctagacctacgccgcccgggcacgaaggcccagccctggccctggccgcggtctcagcccgggaccccggatcgcgcagaaatgcactgaacaggcccctacaattgggctccagaaactacctgagctcggactacctgttgcctcacattggcaaaagagggggaaaccagaaggagggaattctgctgcggcgacttgactttccccgccccgagcagaaaggtaggaggcgacaggttggaatgggggaggggctgtggctctgccctgcagaggtcggggcgccttggcagttggggggaaatatggaaggcaccggagcaaaccagcccgaagagctgtggagcccaggtggggaaaggaaaggcagccgcaggctctcccctcctccccagtcatgattgcaggatagggtgaggggcagccgcctcccgctcattccccagtgccggcctccctttccgcagaggcccccagggtgtccactgaaacctggggaatggaaggtagtgggctgggggcggccccgggaaggccctagaggagcaacgatgcccccacccttctcttccccaccagtcggtgggcatagggaggacggttctcttctaggccgagccctacgtctgttctcttctcagccctcagccctgggtctctctgcagctcctgcacagcccttggcaaaactgcctcctgccctgtctttggggccagaggactggtctctccctgctcctgctgtccgtcgtgttcccctgcccctacctgagggcaccctgcaagctttgcatttggagactgggaagagtgggagagacgcattcctaccgtcccctccccccacagtcttgctcttccgccatgtcagcccatgctccctaaggaccgtagctagcaaggccctcccagggccagagtcccatcctccagccccagacggcctcgagaagcccactgtgtactgaagtgatctgggaaaaagagacctccctgagcacacagcagctctcagcctggggtgggcagagcagatggaggaggggcttgcagaggaggccattcctgggggaagcaaggacgtatctggtggccaggcaactgaggtccccatctctttctttctctttcaggcattgacgtttgtaggcggtgacccgccccttctctggccttgccaagagtctcatccctaccctggggcacctctgaccctggacctgcttgggcagaggcagcgtgaagggcctgaacaagaggagaagaagggccttcctagtagaggcacagcatggacaaaggctcacaggggtgggggtgcccagtgatcgagtcctggcttgggagggaaggtctgagttccctgggaactgaaatcggctagcagcactgtgagagaggtgtatttccccctcctaatgacagaggaaaccgaggcttcggggagggggggatttgcccttgacatgcagataggatgaggaggaactgcgtgtgcccctgggcctgcaggctcccacacccctccccagtcttctccaagacctggcatgatgggaggagggaggggaaagtgaagagggaagcatagggctcctagggcaccaagggagaggggcccaagggtagggaatctggggatctcgctttctttggagcagtacagaagatcacaggaaagattaggacagacagctgagatggcagacaggagagatgggccccaggatccctggggagccaagctttcccccacagcctagcctccccaccccacctggagcttcaccaagggcttttcagcagtgaagtggcacaaacctcccagtttggtgggcaagtggggctgatggtggtgtcatggctcctggagacacgacataaccaggagggtgaagggataaacctggggtgggctggggctgagacccatggcatgaccccaattctctctcctcaagctcgacccccccgccatccccaggatcacacaggagaatctcatcctcacggcttggattggtcctgggggcccccggttgtgctgctaactggtgtacaatgctcaagagcagcccagaggggagccaggaagggaccctcgccctcacctgctatccccatttccgcatctcttgcactggtaccctgagggccacattctcagttcctgggattgaaaactgcagcagtctggccagctccagggacagagtgatccaaccacctaccacgtaccctcctcagcaggccactggacccaggtcctgaatgaagctgtccgcctgcctcaccccagaagaggctggacagtggctgcctcgtgccccctgcagtctcccacagccagggcccgatggggtgcctccttgtcccaagtctcctgagaacccctgaccttgctggcctctctcatccgccccaaccctgtccacccttgaccacctctgggggcctgtcagcctgctggtccccccaacagatctctgggggcagcctctgtgggacaagagtgatacagagctggaggagaagaggagtgaggggcctccttgtgtctgatgcacagatgtggccctttcaaaccctggtgtcaccctctgggtgactggatccctagctccagcctcttcctgggccagccaggaagggtggaggaaagttctttgctgattgcatgtgtgatacagtggggggtgcctgagccctccccatgcaaggggctcatcctgggactctggaagctgcttccctactgggagaaatgtgtgtcggagctgcaggggtccctaccctcagagacccccgactgcagggaacccaccccataagagggtcacggatgtccatgtccgcccaccccccgtggcttctgctgtggctatattggcctagaggggctgactggggaggagcagggctaagccctcagcatttgctcctgtccctgccttttcacccctgctgcctgaagtggtagccccgcctgctgcttctctacctcccctccccacctcttctctcccctacagggcccttgctgcgtgatggggtctccatgcactttatttatttgcagtctgttttctaggcggtggagcttctagacaccgaccggaatgacatacgtttctgtgtgtg

SEQ ID NO: 3755 - DNA, 1777 bp, human
tcggcggctctgtctgcggcggcggcggcggcagccctgtctggcttggcggttcggctgtcgcgctcggcggcggcccgaggctcatacggcgccttctgcaaggggctcacgcgcacgctgctcaccttcttcgacctggcctggcggctgcgcatgaacttcccctacttctacatcgtggcctcggtgatgctcaacgtccgcctgcaagtgcggatcgagtgagcgccggcggcggcggcggccgcggaggcccggctggaggggcgacagtgtccccgcccgcccccggccgggtcgcgggcatgaaggacagctggatcgcggcggggggcggaggtggggcggcccgggcccctggactctagacctacgccgcccgggcacgaaggcccagccctggccctggccgcggtctcagcccgggaccccggatcgcgcagaaatgcactgaacaggcccctacaattgggctccagaaactacctgagctcggactacctgttgcctcacattggcaaaagagggggaaaccagaaggagggaattctgctgcggcgacttgactttccccgccccgagcagaaaggtaggaggcgacaggttggaatgggggaggggctgtggctctgccctgcagaggtcggggcgccttggcagttggggggaaatatggaaggcaccggagcaaaccagcccgaagagctgtggagcccaggtggggaaaggaaaggcagccgcaggctctcccctcctccccagtcatgattgcaggatagggtgaggggcagccgcctcccgctcattccccagtgccggcctccctttccgcagaggcccccagggtgtccactgaaacctggggaatggaaggtagtgggctgggggcggccccgggaaggccctagaggagcaacgatgcccccacccttctcttccccaccagtcggtgggcatagggaggacggttctcttctaggccgagccctacgtctgttctcttctcagccctcagccctgggtctctctgcagctcctgcacagcccttggcaaaactgcctcctgccctgtctttggggccagaggactggtctctccctgctcctgctgtccgtcgtgttcccctgcccctacctgagggcaccctgcaagctttgcatttggagactgggaagagtgggagagacgcattcctaccgtcccctccccccacagtcttgctcttccgccatgtcagcccatgctccctaaggaccgtagctagcaaggccctcccagggccagagtcccatcctccagccccagacggcctcgagaagcccactgtgtactgaagtgatctgggaaaaagagacctccctgagcacacagcagctctcagcctggggtgggcagagcagatggaggaggggcttgcagaggaggccattcctgggggaagcaaggacgtatctggtggccaggcaactgaggtccccatctctttctttctctttcaggcattgacgtttgtaggcggtgacccgccccttctctggccttgccaagagtctcatccctaccctggggcacctctgaccctggacctgcttgggcagaggcagcgtgaagggcctgaacaagaggagaagaagggccttcctagtagaggcacagcatggacaaaggctcacaggggtgggggtgcccagtgatcgagtcctggcttgggagggaaggtctgagttccctgggaactgaaatcggctagcagcactgtgagagaggtgtatt

SEQ ID NO: 3756 - DNA, 203 bp, human
gcggcggcagccctgtctggcttggcggttcggctgtcgcgctcggcggcggcccgaggctcatacggcgccttctgcaaggggctcacgcgcacgctgctcaccttcttcgacctggcctggcggctgcgcatgaacttcccctacttctacatcgtggcctcggtgatgctcaacgtccgcctgcaagtgcggatcgagtg

SEQ ID NO: 3757 - DNA, 621 bp, human
acgccctttgaatcctgcagttctcagtgcagacaatgttttgcttgagagaagctactttctaggcacttcaacattcattcaggagagctgcctcacaagtgccctgaatgcgggaaaggattccctcataggtccaaccgttatcggcaccagccagttcacgtgtgggagacccctgtgaatgcacagtgcataacaagcgaataataagtcgcacctcacagcacctgtgaagacgttgtgataaggaaatgtatgagtgccttgagtgcaggaaaggtgtttctcctagatcaagtctgacaggacacccgaatgctttcacaggtgaaaaatctcaaggttgtcacagttgtggggaaagctttagtcagtcgacagctcttttttgcacccgagaacacacgctgaggggataccatttatatgtgatacttgcgggacaagctacagacagagatcaagtcttgttattcgcttaagaatctatacgtgggagaagccatacaaatgtaggcactgctctaaaagcttcataaagagagcagaccatatgatgcaccaagctgcacactttagagagttctctaagcatatcttgagggaaacaggtcctac

SEQ ID NO: 3758 - DNA, 72 bp, human
aagactatacttgcagggatcatttctgtagttggttactagagaagtttctgtgacagggcacagtaccaa

SEQ ID NO: 3759 - DNA, 14431 bp, human
atgctcaggcttctgagacgtgctttggccttcttccatagtacagcccaccccacagagcagcagcgcccacagcagcagggcccacagcagcagggcccacagcagcaggacccacaggagcagggcccacagcagcaggacccacaggagcaggacccacagcagcaggacccacagcagcaggacccacagcagcaggacccacaaggagcagggcccacagcagcagggcccacagcagcaggacccacaggagcagggcccacaggagcagggcccacaggagcagggcccacagcagcaggggctcccagaaggtattcctctgtgtgttcccttggcccccaccccagaagcctcctaataggggctctcctcacccccggtatgaggatctggtggctctggcgggtacagcacgtgacggcggctccatcttctgtgcgtgcatgggtaggcgtcctgcgtccccaacaagtccctgagaaccaactcccaaactctcctgtccatctaaagcgggatggtgttgacagagaccaccttgggggctgtaccgcctgtggttttccccaacatggatgtgcagcacatgcctatttatatttccagtaggcaagaaactccctaattgcgagtgaatttaggcttgtatcccaagcagaaatttaatttgaagccaagtggatgcctcatacatatccggtcctgtaggagagcagagaacccgttgtgcgggccaactgctgaggtcagatccataaatattgctggtcagctaggcttgtgtagaattaaaaagagagagagagagagataaaatgaaaaggagaaggagaccttttggatgccgttttgggctggccatcaatctccagatatcttttagtgctttgtctgctgagatggttaagtatctatacaaggtactagtcattatgttggtgataatggtggagtgatatagtaggagcagaagctaaaagactctcacatgtagatatggtgataacaagtaacatttacactctcttgtgcaagacactccacagctctcgacagttgatgtgcatgtgtcagttaatacaaggcgggcgcagtggctcatgccagctctttgggagttccaggcgggtggatcacttgagtccaggagtttgagaccagcctgagataacatagtgaaactccgtctctactaaaaacacaaaaattagccgggtgtggcggcatgcacccgtcatcccagctgctcgggaggctgagacatgagaaccacctgaacctgggaggcggaggttgctgagagccgagatcgcgccactgcactccagcctgggtgacagagccagactttgctcaaaaaattaaaaattacttgaaaattaaaaaatttttaaattaaaaaaaagaaaactgcaacaaccctattaggtgaaaatttgattgttgtggattgacagaagaaaacaaagtcagagacgttaaaaaacttctctgcccaagtttatgcagatggtgagtgtaagacatatttgtagtagatgtttgcatttgaggctaataatgtgacttttgtttctttatcttgtaggtgacacccagttgacaactgtgcagggagttgtcacaagtttctgtggtgattatggcgtgattgatgagtcgatctacttcagtagtgatgttgtgactggcaacgtgcctctaaaagttggacaaaaagttaatgtggttgtggaagaagataaaatactttatggattgagagcaatcaaggtgagatgtgcatgagtctgggaattgtgtcttatctcaatgggttttctttctccatctttctattcttgtattaatgcaacatctctactgtgatccgtagagtggatgtagactgcaatttgaagccccacccctctgaagctgtaggttcttgtgttctaatatttgtagtgatatctgctttaaaacataaaaattactcatctattattctaatctttaaacaacatgggtaacaataataattattgaactctatacaatccttcaacttcccttatcaggtaaaaaaccattttctgtagtgtgcattcatagcagtggaattgctatgtgaaaccatgtgccttgtaaacattttaaaaagagcttcatggaggtatagttcacaaaccacagaactctcttaagggtacaattcagtaacatttggcagatttacagagtcctgagaatatcacctgagtccagatatttacccattcagtggctattatgaaattattctttaggtctactgtactaattgattctctcagcaataggcagtaagactgcccatctgcccatataggcaaggacaacaatattatcaatctgaaatctttgcaaatatgagaagggaaaagcagtctcatcattcgtttggaattattaaggatcttaatgagattacagcaagtttcctttcttggacttattatacaatagggatatttatggctatctctatggtaggaacattagatttgtaataggaaagtttgtatatgacgtccttgtggcatttcctccgataccatcttttttctttgctttatatctttcattcttttacagccttattgagatataggtcacgtgattcaccatgcaattcccccatctacagggtacaatccagtggtttctagtttgttcacagtgttaggcaacaatcaccacaaacaactttagaacattttcatcactcaaaaaggaagctccataaccattcatagtcttttcccatttctccctgatcccccaactgtcccctccccctgcaacatccagccctaggaaatcacttatccattttctgtttatatatatttgcccattctggacagttaaaaaaggttccttctatataactgtaatgatatgtcctttcaccaacatctcctcattcctccatccaccctaacaacccaagcatctggcaaccaccattctactctacactgctatgaggtaaactttttttatattatgcatgtgaatgagaccatgcagttatttgtgtttatgtgactgtcttagttcacttacatatcattcttcaggttcatccatgttgtcccaaatggcaagattttattctgttttatggctgaatagtattccattgtgtatttataccacatttcctttatccactcatccgtagatggacacttaaattgcttttgtttcttggctgttgtgaatagggctgcaataaacatggaagtgctaacatctctttgacacactgatgacactctctttggatacatgctcagtagttcatggattcatgtgattcatggattcatgtgatagttccattgttaatattttggagaacttccatactgttttccataatggctgtaacaacttacatcccaccaaccgtgcataaagtttccaatttctccacatccttgccaatacttgttatctcttttctttttaatgttagccattttaacatgtgtcaggcagtatctctgtggttttgatttgcattgtcctgatgactagaaaaggtgagcatttttttaatatgcctgttggccatttgtatgtctccttttgaaatatgtctattcaggtcttttgctcatctttaataggattatttgttttcttgctatgagttgttggagttactcatacattttggaaactgaccccttactagatgtatagattgtcagtgttttctgctatcctgtagattgtctcgccactctttgatcatttcctttgcggtacagaagctttttagttcaaagtaatcctattgtctgtttttccttttgttgcctttgcttttgaggtcctatttttaaaatgtcattgcccaaaacaatgtcatggagctttccccctatatctctatctagtagtttcatagctttgggtcttcattttaaagctttaaatcattttgagttgatttatatacatgctgagagataagggtggaaactcattttactcagatgaatatctagttattttcaacatcatttattgaagagagtgtactttctcaacattgtgtgttttcgggccttttgttgaatatcagttgactgtaaatgcacgaatttcattccgggctctgtattctgctccattcgtggatgtacccactggtactatgctgttatgcttactatagctttgtcatatgctttgacatcaagtagtgtgatgcctccagctttgttctttgtattccagactgcttcgactacctggaatcttttgcggttccatacacattttaggagtgtttcttttatttccaagaagaatgtcattggtattttcatagcagttgcattgaatctatagattgctttaggttacggacattttaacaatatttattcttcctgtccacgaacacatgatacacttcaattcgttcctgcctccttcaatttgcttcattaatggtttatagttttcggcgttgcaatccttcacctccttcgttaaatttattcctatttattttttgaaggtgttttaaatgggattgtttcttgatatctttttcagatagttccctattggtgtatagaaatgctactgattcctgtgtgttggttgtgtatcttgccactttcctgaatttgtttattagaccttgtaggtttttcatggtgtcttcagggttatttataagtaagagcttcccgtcttcaaacagggccaatctaaattcttccttttgaatttagatgccttttgtttcttcttgcctagtttctctgactagtacttccagaactatgtgcgatagaaagggcaaaagtgggcatttctgtcttgttttaggtcttagaggaaaaaagactgcaacatttccccattcagtatgatgttacctgtgggtttatcatatatgacctatattgtgttgaggtgcactcctcctatatctaagttgtggagtttttatcacgaagggatatggaattcggttaaatgcttttcctgcttaaattggaatgatcctatggcttttgtgcttcattctgttcatgtgatatagcacatttattgatttgtgtatgttgaaacttttttgtatcccaggaatgaatacctctggaacatgatgaatggtgtttttaatgtgctgtggaatttggtttactaacaccttcttaaagatttttgcaactgtgttcatcaggaattttggcatgtagttttctttgcttttttcttttttgtgtttcctagtctgggttttctaccagggtaacgcgggtgtgatagaatgcatttggaagcgttcctttcttatcatttttttggaatagcattaaaagtataactattaattcttcttctttatatataaattttggtagtattacgaagggaagccattctgtcttagactcttcatcgatgggagattttttattactgaatcactttccttacttgttaatggtctgttcagaatttccatttcttcatcattacatcttggtaggttgcatgtgtccaggaatgtatccatttcttctagcttgtcctgttgtaggtagatgattgttcataatagttcttatgatgcgttttattttggtgatgtcagttttggtttctcctttttcaactttgcttttatttatttgaattttctcccctttttcctttagtctagctaaggttttgttgatttggtttacctcttcaagaaaccaactgattgtttcattaatatttgtattgttcttctcatgtctatttgatttatttctgctctgccctttatgatttctgtcctcctacttttggattgcatttttttcttctttttttttctagttcctcaaagtgtggtgtggggttgtttatttaagatgtatcttttcttttgaggtaggctttattgatgtaaacttcacttttagaattgcttttgctgtatttcatgggtttttgtatgttgtgcctgcagtttcctttatctcaagaaatgttaacacttcgcttttaatttcctcattgacccattagttatttaagagcatgttgtttaatttccatccacttctaaagtttccaaagttcctaattttattgatttctaatactttaccgttgtggttagagaactgatttgatgttatttcaaattcctttaatttgctaagacctgttttatggcctgccccataatctatcctcgagaatgttccacatgcagttggaaagaatatgtgttttggagtatttggatggaatgttctgtaaatgactgttaggtccatttggtccagagtgcagataaatctcactttttgtggggtcagtgttctgtctggacaatctactcattgttgcaagttgggtgttgaagtcccctacagttattgcattgcaatctgtctcaccatttagaccttaatatttgcttcatatatttaggtgctgctatgttggatgcatatttttggaaatcattatatcctcttgatgaattgatcccttcatcgttatataatgatcttcttgttctttttaccgtttgtgatttaaagcctattttatttgaaattagtttagctgctccccttctcttttggtttccctttacatggaagaatatcttttttcatgccttcactttcagtttacgaatgtccattaaggagaagtggatctctcataggtttggttgttgttgttgttgttgttgttgttgttgttgtttaaatacattcagctactctgtgtattttagttgaatgtcatccatttctatcaagttaattattgataggcaaggatttactgttgtcatttagataattttttctacttattttataggtaatttcttcctttctcttttactgtctttcttgatgaataagagatttttctctattaatatgttttgtttccttgatattttaaaatgtgtcaattacatgatttttttctttgtggttagcatgaggcgtacaaaaacataatcacaacagtttatttattgataatataactttgatcacaaaacacaaacactctaccatttaactccacccccagattgagttctgtattttacactttacaactttttatattttatatcccttaatgaattattgtacgtattttatttttactagttccttttttaactgttacatgaaagatatacatgatctggacaccactgttaccttaatagagtattgtgaatgtgtgtggttacttttactagtgagttttatacctttagatatttttgcattacccattagcgtcccttatgtcagttggaagaactctccataggatttcttgtaagacagttgtggtggtgaggaagtttctcagctgtgatttctctgtaaaagtctttttctgcccttcacttcttggtacattattcttggttagtcatttttttccttgatctccttgaatgtatcatcacactctctcctggcctgttatgcttctgctgagaagtcttctggcaggcatattggaactgcattatatgtgatttgcttctttcctcttgctgctctcaggattttttctttatttttcatctttgagagtttgattttaatatgtcatgcgtaatcttatttggattgtatctgaatgcagaactttggtcgtccagtacctagacgtttataactttctctgggtttggatggatccccattattaatttttaaataatctttctacctctttttcactcctccctcttgaacatgaatgactcatactattgctctgctgataattgtcccagaaattcagtaagttttattttcattccatatccttccttttaattttgtctcctgtgactgtatatttttaatgaagctgtctccaagtttacagattcttcattttgctcgacaattttcctgtggatgttctctattgtatacttccttcattgtattttttgacttttgtatttgtttggttttttaaaattctttcaatatttctttcaatttactctgataaattctaatcatttctctgtagttgttttcaaggttcacagagcatgtggaaaatagatattttgaattatttattaaacaactcaaacattcctatctctctagggtcaattactggcaccttgttttgtcagtttggtgatgtcatgttttccttattgttcttgatctttgtggtaatgtgtttatatctgcgtattgaagaagtaggtatccatttcagtctttgcagtctagcttttaggggacatcctttagcagtaagcctgtccggaaactctatataggtctcttttggtccttatgcttatgaacactacagctattgaagcactagggggcctcctaatcccagggacacagcgacagatgctgcaatggcatgcattcccttagctgttgagactggtgccttgcaagactggaatccaaggctccactcattcacagaggactccctgttgctgtagaatattctgagcataaggccactggaatcactcggcagagatgtgggacaggtattgagtttgttttgctgtggctgtggcttcctgtctgttgccagggtgggtctagagactcggtccacaagtaccatctcagagtctggggccatgggccatgggcgtttgtcaagtggtggcatatagtgtggaaggcctgatattgggttcccaggcaatgtcctatgcttgctactctctctgtcctccgggtggatggtatctctctccatgctgtgctgttgaaagtcggggaaggagtgatgtgggtaatgtaaaactgtctttactaccctcttcaatgcatcttttcttattttcatgctataactgggtactgcggtctctcacctggtttccttctctcaagtgatggtattttcatacaaggatagtttttcacattgatgtttctgcaggaggacaatcactggagagtcccatttctccatcttgctcccctcctcctccatctgtttaatttttacatactataaatatgtccatcttgtccatgtggcttctgggttcaggaagtttccttaggctaattctaacacataatttacacgagtattcacttagtttttcttctgaaagtcattcatttatttatatctaaacgtacagtcagcctgtgtttactttccatgtataagactgagagaaggatccgcgtcttgtttcactactggctattcagttgccctaaacgttaattgtataatccactttgcccctatcgtattgaaatgccacttctgtcatacaacgcattattgcaaacatttcaatctgtccgtacctgctgttgtgttggtggtatttccaaggcataagaaacagagttgggagccatgaaacatgggcaaagctttagtctgcatatgtctgtgagttggcgtggagtcaaggaacagagaggtccgagggtgctgtggatcatccactgggatactgacggaagtggtggtagacacatggatgggaggctaatgcctcattccttcatgacagtaagtgaggggaaaataaacatcagattggtattgacagctggaaagacaccagttaagaaatgagaatagcagcaaactaggctatttttaaaaccatgaaaaattatttacaactcagtggctcaagtttccatcagaagtctttgatctgcaaattccaaccctaggagtttatcctatagttaagtcaagcaagtagtacaaattttaagacaaaagcgaaatgtctaattacgtggaattgggttagtaaattacggcacatccattaattgggattctctatgagtgtttctgtcctctcttgttatttgaaaaactttgtgttcatttaatgtgatactttactactgaataccatgctaatttgcttttaaaatgagtatttacatatgtatatatatttgtgcacagacaaaaacatcaggatgagtgttactgagaaaatgtagtccctggtggtctcttggtaatggaatatggattatggtgtaaccgccttttgctgtctgcatatctgttttttttttcccctacttttagtacaatgaacttgcattatttctgtaagttttaaggattataaaataaggactattacacttccaataaggaaaaaggtttgtatgcctctctattgtagataaagtaaagccctaatttgacttggtttattgaacctcccccagttgaggttattgttccaactttaacttgaacttctgtctcctagacctggatctggaatgttagggttttgctccctaggcttctaaattgtgttgtttttcctctctgccttcctgctcctctactcgtgtttacaagtttacacctctgccttctttcacaacccagcacaaatctgacttcccccaagcaatgccgctattttctccctgtctgaaatgttctccgtttaggtaagtcacagaaactatctttaaactagtcttatatcattcatcacaacctgctaagactacatatctttccattttaccgtcatttcactgtgaattcctttaggtgaatgacggtattttttaaatctgggaatctaatggtacaagggcattaaacttgggtatgcaattaatgttttgggatacatttcacaattcatgaagcacacacatgatttctaccatcatctcaagtctatggtccatttagcacgtgaactatattcaccagtgttaaggatggtttttgaaaatattttggaataccagtgttttaaccatgtaagttcctgtgtttaaatttgtattatttttgaagtaactctttcctaaatcttacaggtggatgttgtgcctcaccctcttaacgatgatggaccctcagactcaaaaatcagagttttaaatggatgtgttacttctataagtgaagatactgtttatattagtaacatcatttatttccctatggacattgtttctgaaggtatgacttacattttgtgatatatgatgtaattcttaattttttgagtggattttagtcctagaacaaattttacagtgtacttggcttcagccaatggctcttcaatattacaggtagacctttccaattgaaattatgtacaatataggggcaaataggaagtattttaaaatgtctgctgtcgtctattgtgcgttcatttgttcaatgccctcagtaatgcctggatatatttttcattcacataagaatttagtttctaatcatggaaacaatcctacaagtacacagagacactatttttaatacccttcaaagactatacttgcagggatcatttctgtagttggttactagagaagtttctgtgacagggcacagtaccaaattttaaaagaatgcacttcaaatcttcaaagttaggattggagatagtgctttgtggctgtgtgtgtgtgtgtgtgtgtgtgtgtgtgtgtgtgttgtggaattctgtttgtaatcagccgatatgttctaatatttcgcttataaccaaagatacactttttttttttgctatttttgtccattgcaacagtcatatagcttgggtatgaaaggggagattagctccacttccccaggcagcttgctagtttgtttccttggatgcaaaaacaggaccctgacctgaattttgttttcagatgttgactctatctgctttgtcgagaagagactatgagggaagggtggagtcaggaaattggtcaggaaaccgttgtaatattcctggtgagagatgatggagatgtgaatgaaagtggagaagtggaggacctgaggattgagttgactctggatatattttgaagttagagaagaacccaggaggtaatggattagatctttgatgtggaggaaagatgagtccaaggtacctccaaagtttttggtttgagcagtggtgagagtggagttgccagtttgtgatgcagacgactgaggcaaacaaaagttggtgaatatgaagaataccaacaactcagctttgcacacattagattggtgtaagcatatggataattgaccctgaggttggttagagctggaggcatatacattttggagttattggcccatagatatacagtaaacgcacacaaaagaaatgtatgcaaattaacagagacagacagagagacagaagtctaacactgtgtcttgtatcagtctacaatgctgggtcctaaggtgaataaatatttcactttgttgatattgctagttttctggagtcactgtggcaatttacggtctcagttgcagttgggatttccatttgctccagattctttcacgtacatttgttatcctgtgagtcacttttaacttatcgtaaacttctgtttcaacctcgatggtcttaacggtaacccttaaggcacagacttaagacaccgcatgttctcactcataggtgggaattgaacaatgagaacacttggacacagtaaggggaacatcacacacccgggcctgttgtggggtggggggagtggggagggaaagcattaggagatatacccaatgtaaatgacgagttaatgggtgcagcacatcaacatggcacatgtacacatatgtaacaaacctgcacgttgtgcacatgtaccctagaacttaaagtataataataataataataataataataataataataaaaagagttcatcagcggaacacaacactaggggaaattgattcattctgaaagtaacaacatttcctagtggtactgctaccactactaccaatcaacagttatttggtggttactatgcaccagtgatgattctgtgtgtatcaacgatatctattaagtgtcacagcagctcagtatcttgaaggctacttatcgtgcttctcattttataaatgaagaaaacgaggcacagagagattaaacatcttggctaaggttacaaactgagtgagtggcagtgtcaagattcaaatgcacatggccaggttcaaacttgtgctcttacctacatgtttgactgcctctcactaaggagttgtgaacacgaacagttgtttagtaaatcctgtgctgttccctcagattggctgtgatgcacagttcacactttgctccatttgactttgttaaatcagtagaggagagtcaatgcctaaggattataaacttcttcttgaacttaccgatttacagtgtgtctgtttaaatatgtgcaaaaatgactttaggtgttgcagaactgactttaaagtagtacactatcaaataacgtgtgcaattcaagatgacctagttaagagatcatgacactcacatttctccatggctgttttagattttgtgccttataagggcaactggttaaaagttgaatattccactgaaccaggcttcttaaacttcaaggcaagctctgtgaagcccactcgttgtattcatgcggaagcggtaatttctttcctgttgctcccatcatcggtttctgtgaacccttcctttcgtgataattttcgtgcccaggattctgttgggtgtaatgggaattccagaaaatatgaagaaatacattctttgccaacaaaggagccacttttcttactgaaaaggcaggacttcccaaaggaaataattagaaaattatgtagaacaagcatattaatcgattaagttctaaattgtgcattttactcaatacccaaattttattagaatcttccaacaacaggaggaagaaaaacaatctttgtgtcagaaaattgtagggaaagaatgaacggagtgcgttgtgggacttgagcttaacagtaaatgttgagaatgatttgggtattggagcctgaacatgaccagcaaattcagggcaatagagggtaatggacatattttggtaatatttagagctggatttctcatcaaagacccatgcctcatccctggagagcctgttttaattggtctgtggtggagtgtggacatgggtattcttacaaagcacccctggtgttagcaatgggccaaccaggttggaaatcaatgatttgcattgaagtgacctgcactcatgcaggacccagagtgaggaggtgcaaagctggttacagtgattatcgggctttctcataatcatttccattatttatactcacaggtccgcattactcacatacgtggaagaagtggggtgataaagaatactatctttttcaccttggattctgtgaaacttcctgatggatacgtacctcaagtagatgatatcgtcaatgtggtcatggtggagagcattcagttctgctttaagtggagagcggtttctatcaccccagtacaaaaatcatg

SEQ ID NO: 3760 - DNA, 14431 bp, human; identical to SEQ ID NO: 3759

SEQ ID NO: 3761 - DNA, 13501 bp, human
ttctgtggtgattatggcatgattgatgagtcgatctacttcagtagtgatgttgtgactggcaacgtgcctctaaaagttggacaaaaagttaatgtggttgtggaggaagataaaatactttatggattgagagctatcaaggtgaaatgtgcatgagtttgggagttgtgtcttatcccattgggctttctttctgcatctttcttttcttgtattaatccaacatctctactgtgatccgtagagtggatgtagactgcaatttgaagccccacccctctgaagctgtaggttcttgtgttctaatatttgtagtgatatctgctttaaaacataaaaattactcatctattcttctaatctttaaacagtatgggtaacaatattaattattggactctagacaatcctgcaacttcctttatcaggtaaaaaaaacgttttctattgtgtgcattcatagcagtagaattgctatgtgaaaccatgtgccttgtaaacatattaaaaagagcttcatggaggtatagttcacaaaccacagaactctcttaagggtacaattcaataacatttggcagatttacggagtcctgagaacatcacctgagtccagatgtttacccattcagtggctactatgaaattattctttagctgtactgtactaattgattctctcggcaataggaggtgagactgcctctctgcccctataggcaaggacgacaatattctcgatctgaaatctttgcaaatatgagaaggggaaagcagtctcatcgttcacttggaattattaaggatcttaatgagattacagcaggtttcctttcttagacctacttatacattaggaaaatttaccgctatctctatggtaggaaaattagatttgtaataggaaagtttgtatgtgacgtccttgtagtatttcctctgataccatcttttttctttgctttatgtctttcattcttttacagccttattgagatataagtcacgtgattcaccatgcaattctcccatctacagggtacaatccagtggtttttagatttttcacagggttaggcaacaatcaccacaaacaactttagaacattttcatcactgtaaaaggaagctccataaccattcatagtcttcccctttctccccgatcccccactgtcccctccccctacaacatccagccccaggaaatcacttatccattttctgtttgtatatatttgcccattctggacagataaaaaaggttccttctatataactgtaatgatatgtcctttcaccaacatctcctcattcctccatccaccctaacaacccaagcatctggcagccaccattctactctacactgctatgaggtcaaatttttaaattctgcatgtgaatgagaccatgcagttatttgtgtttatgtgactggcttatttcacttacatatcgttcttcaggttcatccatgttatcccaaatggcaagattttgttctgttttatggctgaatagtattccattgtgtatttacaccacatttcctttatccactcatccatagatggacacttagattgcttttgtttcttggctgttgtgaatagggttgcaataaacatggaagtgctgacatctctttgacacactgatgacactctctttggatacatgctcagtagagggattcatggattcatgtgatagttccattgttaaaattttggcgaccctccatactgtgttccataatggctgtaacaatttacatcccaccaaccatgcataaaggttccaatttctccacatccttgtcaacacttgttatctcttgtctttttaatgttagccactcttacatgtgttaggcagtatctctgtggttttgatttgcattgccctgatgattagagaaggtgaggatttttttatgctcattgtccatttgtatgtctcattttgagaaatgtctattcaggtcttttgctcatttttaataggattattttttttcttgctattgagttggagttactcatacattttataaactgaccccttactagatgtatagattgtcaatgtttttcctatcctgtagattgtctctccactctttgatcatttcctttgtggtgcagaacctttttagttcaatgtaatcccatttgtgtgtttttccttttgttgtctttactttggaggtcctatttttaaaattgttgcccagaacaatgtcatggagcttttctccctatgtatccttctagtagtttcatagctttgggtcttccttttaaagctttaaatcattttgagttgatttacatacatgctgagagataagggtggaaattcatttttctcagatgaatatccagttattttcaacatcatttattgaagaggctgtactttctcaagattgtgtgttcctgggccttttgtcgaaaatcagttgactgtaaaagcacggatttcattccagtctgtgtattctgctccattggttgaagtatatgcttttatactggtaccaagctgttatgcttactgtagctttgtcatatgttttgacatcaagtagtatggtgcctccagctttgttctttgtattccagactgcttcaggtatctggaatctttcacggttccatacaaattttagtagtgcttcatctatttccaagaagaatgtcattggtatttttttagcagttgtattggatctgtagattgctttaggttatggacactttaacaatatttattctttctgtccatgaacacatgatatatttccattcattcctgcctcattcaatttcctttgtcaatggtttattgttttcagtgttgcaatccttcaccttcttggttaaatttattcctattctattttttgaattttctgtaaatgggattgtttcttgatatctttctcggatagttcattattggtgtatagaaacgctactgattcttgcatgttggttgtgtgtcatgccactttcctgaatttgtttattagacctagtagctgtttggtggtgtcttcagggttatttatatgtaagaacttccagtctgcaaacagggccaatctaaattcttccttttgaatttagatgccttttgtttcttcttgtctaatttctctggccagcacttccagaactatgtgcgatagaatgggcaaaagtgggctttctgtcttgttctaggtcttacaggaaaagcctgcaacatttccccattcagtatgacattacctgtgggtttatcatatacaacctttattgtgttgaggtgcactcatcctatacctaatttgtggagcttttatcaagtagggatgtggaatttggttaaatgcttttactgcttaaattggaatgatcctatggcttttgtgcttcattctgttcatgcgatatgtcacatttattgatttgtgtatgttgaaacttccttacatcccagggatgaatccctctagatcacggtgaatgatgtttttaatgtgctgttgaatttggtttactaatactttcttaaagattttcgcaactatgttcatcaggaattttggcacttcttttttttcagttttctcttctttgtgtttctttgtctgggttttctagcagggtaatatgatgtgatagaatgcatttggatgtgttcctttcttgtctgtttttttgaaagagttttaaaagtatagctattaattcttcttctttatatagaaattttggtagtattaggaagggaagccattctctcttagacttttcattgatgggggatttttttttattactgaatcaccttccttacttgttaattgtctgaacagattttccatttcttcactattacatctcggtaggctgtatgtgtccaggaatgtatccatttcttctagcttgtcctatttgtaggcagatgattgttacaatagtccttatgatccgttttattttggtgatgtcagttgtactatctcctttttcatctttgattttatttacttgaatattctcccttttttcttttagtctagctaaaattttgttgatttggtttacctcttcaagaaaacaactgattgtttcattgatatttgtattgttcttctcatgtctatttgattgatttctgctcttacgtttatgatttctgtcctcctactttggattgcatttttttctttttttttctagttattcaaggtggagtgtgaggttgtttatttaagatgtatcttttcttttgaggtaggctttattgatgtaaacttcacttttagaattgcttttgctgtatttcatgggtttttgtatgttgtgccttcagtttccttcatctcaagaaatgttaacacttcgcttttaatttcctcattgacccattagttatttaagagcatgttgtttaatttccatccacttctaaagtttccaaagttcctaattttattcacttctagtattttactattgtggttagagaagtgatttgatattgtttcaaactcctttaatttcctaagaccttttttatgacctgtgggcagcaagccacccaggtgccgaggcaagagaccgagcacgagctgttccagtataataaaatataaaacaagaatagttatgccagatatagatcttagatatgattatatatgaatatcattaatcattagtttgtagcaattactctttattccaatattataataatcctcgctctataaccataacctaggaaaaaccaggccatacacagataggagctgagaggacacagtgagaagtgaccagaagacaagagtgtgagccttctgttatgcccagacagggccaccagagggctccttggtctagtggtaacgccagcgtctgggaagacgcccgttgccaggcggaccgtggtctagtggtagcctcagtgtcaaggaaaaacaccggctacttagcggaccgggaaagggagtctccctttcccccggggagtttagagaagactgtactcctccacctgttgtggagggcctgacagtagttgggctcaactgcagttatccggaggcctaaccgtctccctgcgatgctgtgcttcagtggtcacactcctagtccgccttcatgttccatcctgtacacctggctctgccttctagatagcagtagcaaaattagtgaaagtactaaaagtctctaataagcagaaataatggtgtaagttgtttctctctttgtctcctctctctctctctgcctcggccgccaggcagggaagggccccctgtccagtggacacgtgacccacgtggccttacctatgattggagatggctcactctccttatcttgcccctttgtcttgtatccaataaatatcagtgcagcctggcatttggggccactaccggtctccgcaacttggtggtagtggtctcccgggcccagctgccttttcttttatctctttgtcttgtgtctttatttctacactctctcgtctccacacacggggagagacccaccgaccctgtggagctggaccctacaatgaccttccacataatctatcctccagtatgttccacatgcagttggaaagaatacgtgttttgcagtatttggacggaatgttctgtaatgactgttaggtccatttggtctggagtgcagataaacccgactttttggggggtcaatgttctttcaggacaatctgttcattgctgcaagttgggtattgaagtcccctaatattattgcattgcactctatctcaccatttagaccttgatattggcttcatatatttaggtgctgctatgttgggtgcatatttttggaaatcattatatccttttcatgaattgaccccttcaccattatataatgaccttcttggtctctttttacagtttgtgatttaaaccctattttatttgaagtcagtttagctgctcctgttctcttttggtttccctttacatggaagaatatcttttttcatgtcttcactttcagtttacgaatgtccttaaaggagaagtgggtctctcataggtttggttgctgttgttgtttaaatccattcagctactctgtgtattttagttgaagaatgtcatccatttctatcaagttaattattgataggtaaggatatactgttgtcatttagataacatttttctatctatttggtaggtaatttcttcctttcttcctcttttactgttttccttgatggataagagatttttctctattagtatgttttgttttctttatttgttttaatgtgtctattacaggattttttctttgtggtaagcatgaggcttacaaaaacataatcacggcagtttattttactgataacataactttgatcacaaaatacaaacactgtaccatttaactccacccccagattttgagttctctattttacactttacaacttattacattttatatccttcaacaaattattgcaattattttatttttactagttcagttctctatctgttacatgaaagatataagtgatctggaaaccaccattaccttattagagtattctgaatttgtgtagttacgtttactggtgagttttataccttcagatgtttttgcgttactcattagcgtcccttatgtcagttggaagaactctccctagcatttcttgtaagacagttgtggtgatgaggaagtttctcagctgtgatttctctgtaaaagtctttatctccccttcacttctgggtacattattcttggttagagattttttttccttgagttccttacatatactatactactctttcctggcctattccgcttctgctgagaagtcttctggtaggcatattagaagtgccttgtatacgattcgcttctttcctcttgctgctttcaggatcctctcattctctttcaactttgacagtttgatgttaatatgtcgtggggtaatcttatttggattgcatctgaatgcagaactttggtcgtccagtacccagatgtttgtaactttctgtgggtttagttggctctccattattattttttaaataatctttctaccactttttcaatctctcctccctcttgaatgtgagagattcatactattgctctgctgataattgtcccagaaattcagtaagtttttattttcatttcgtgtccttcctttttcttttgtctcctctgactgtatattttcaatgaagctgtctccaagtttacagattctttcttttgctcaatcaattgtcctctggatgttctctattgtgtatttccttcattgtgttttttgatttcaggatttgtttggatttttaaattccttcaatctttctctcaaattcctctgttaaattctgaatcatttctctgtaattgttttcaaggttcacagagcatgctgaaaatagatattttgaattatttattaaacaactcatacattcctatctctctagggtcaattactggcaccttgttttgtcagtttggtgatgtcatgttttccttattgttcttcatctttgtgatcatgtgtttatatctgggtattgatgaagtaggtattcattttagtctttacagtctagcttttgggggacatcctttggcactaagcctgtccagaaactctatataggtctcttttggtccttatgcttgtgaacgctacagctattgaagcactagggagcttcctaatcacagggacacagcaacagatgccgcaatggcatgcaatcccttagctattgaggctggtgccttgcgagactggaatccaaggctccactcattcactgaggactcactgttgctgtagattattctgagcataagtccactggaataactcagcagagacttgggccagatattgggtttgttttgctatggctgcagcttcctgtcgggtgccaggatgagtctagagactctgtccacaagtaccattttggagtcaggggccatgggcgtctgtcaagtgatggcgtatatgtgtgacaggcctgatattaggttcccaggcaatgtcctatgcttgctactctctctctcctccgggtggatggtatctctctccatgctgtgctgttgaaggttggggaaggggtggtatgggtaatgtaaaactgtctttactaccctcttcaatgcatcttttcttattttcatgctataactgggtaccgtggtctctcacctggtttccttctctgaagtgatggtattttcatacaaggatagtttttcacattgatgtttctacaggaggacaatcactggagagtcccatttctccatcttgctcccctcctcctccatctgtttaatttttacctactataaatatgtccatcttgtccatgtgacttctgggctcaggaagtttccttaggctaattctaacacacaatttacactagtattcacttagcttttcttctgaaagtcattcatttatttacatctaaagatacagtcagcctgggtttgctttccgtgtgtaggactgagagaaggatgggtgtcttgtttcactactggctatttagttgccctgaacattaattggataatccacttagcccccattttgttgaaatgccacttctgtcgtacaacacattattgcaaacatttgaatatgtctgtacctgctattgtgttggtggtatttgcaaggcataagagacagagttgggagccacgaaacatgggcaaagctttagtctgcatatgtctgtgagttggcgtggagtcaaggaacagagaggtccgagggtgctgtggatcatccactgcgatactgacggaagtggtgatagatatgtggatgggaggctaatgcttcattccttcatgacagtaagtgaggggaaaataaacatcaggttggtattgacagttggaaagacaccagttgagaaatgggaatagcagcaaagtaggctatttttaaaaccatgaaaaatgctttataactcagtggctcaagtttccattagaagtctctgatcagcaaattccaaccctaggagtttatcctatagttaagtcaggcaagtagtccaaatgctatgacacaagtgaaatgtccaattatgtgaaattgggttagtaaattacggcacatccattaattgggattccctatgactctttccgtcctctcttgttatttaaaaacttttgtgctcatttaatgtgatattttaatactaaatacaatgctaatttactcttagaacaggcatacatatatggcacagacaaaaacataagaatcagtgttactgccaaaatgtagtccctggtgatctcttagtaatggaatatggattatggggtaaccgccttttgctgtctgcttatctgtttttttccttacttttagtacaatgaacttgcattatttttgtaagttttaaggattataaaagaaggactattacacttccaataaggaaaaaggtttgtatgcctctctattgtagataaagtaaagccctaatttgacttggttattgaaactcccccagttgaggttattgtttcaactttatctcatgcttctctctcctaggcctggatctcggatgttagggttttgctccctaggctcctaaattctgttgtatttcctctctgtctccctgctcctctacccctgtttacaatgttacacctctatcttctttcacaacccagcactagtctgacttcccccaagcaatgctcctattttctccgtgtctgaaatgttctccatctagatgattcacagaaaccatctttgaactagttttttatctttcatcacaatctgcttatgactacatatctttccactttactatcatttcactgtgaatttctgcaggcgaaggaaggttttttttaatcttggaatctaatggtacaaggacattaaacttgggtatgcaattaatgttttgggatacatttcacaattcttgaagcacgcacatgacttttactgtcatctcaagtcaatggtccatttatcaagtgaactacattctccagtgtttaggatggctgttgaaaatattttcaaatacaagtgttttaatcatgtaagttctcgtgtttaaatttgtattgtttttgaagtaactctttcctaagtcttacaggtggatgttgtgcctcgccatctttatggtgctggaccctcagactcaggaaccagagttttaattggatgtgttacttctatatgtgaagacattatttatattagtaactgcatttatttcttcatagacattgtttctgaaggtacgatttacattttgagatatatgatgtaattcttaattttttgagaggattttaatcctagaacaactcttacagtgtacttggcttcagtcaatggctcttcaatgttagaggtagacctttccagttgaaaatatgtacaatataggggcaaataggcagtattataaaatgtctgctgtcgtctattgtgtgttcatttgttcaatgccctcagtaatgcctggatatatttttcattcacataagaatttaatttctaatcatggaaacaatcctacaagtacacagagacactatttttaatacccttcaaagactatacttgcagggatcatttctgtagttggttactagagaagtttcttgtctgtagttggttattagagatatgtacctaattttaaaagatctgtacctaattttaaaatacacttcaaatgcttcacatgtgagattggagatagcgccttttggctctgtgtgtgtgtgtgtgtgtgtgtgtgttgttgaattctctttgtaatcagcagatgtgatctaatatttagcttatacccaaagatacacttttttgtgttatttttgtctattgcagctgccatatagcttgggtaaaaaaggggagattagctccgcttccccaggcagcttactagtttgttttcttgggtgcaaaagcaggattctgacctgaattttgtttaaagatgttgactctgctttgtcgagaagggactatgaggggaagggtggagtcaggaaaacgttgtaatattcctggtgagagatgatggagatgtgaatgaaaatggagaagtggagaacctgaggattgagttgactctggatatattttgaagttagagaagaacccaggaggtaatggattagatctttgatgtggagaaaagatgagtccaaggtacctccaaagtttttggtttgagcagtggtgagggtggagttgccagttgtgatatagacgactgaggcaaacaaaagttggtgaatacggagaataccaacaactcagctttacacacgttagattggtgtaagcatatggataattgaccctgaggttggttagagctggaggcatatacattttggagttattggcccatagatatacagtaaacccacacaaaagaaatgtatgtaaattaacagagacagagacagagagagagagaaagagagaagagttctaaccctgtgtcttgtatcagtctacaatgctgggtcctaaggtgaataaatgtttcactttgttgatattgctagttttctggagtcattgtggcaacttagtgtctcagttgcagttgggatttccatttgctccacattctttcatgtacctttgttatcctgtgactcacttttaacttactgtaaacttctgtttgaaactcagtggtcttaactgtaacctgtaaggcacatacttaagagttcatcagcggaacacaacaccaggggaaattgattcattctgaaagtaacaacatttcctagtggtactgctaccactactaccaatcaacagatattttgtggttgctatgcgccagcgatgattctgtgcgtatcgcacatatcaactaattctcacagcagctgtgtatcatgaaggcgacttatcgtgcttctcattttatagatgaagaaaacgaggcacagagaagttaagcaccttggctaaggttgcaaactgagtgagtggcagtgtcaagattcgaacgcacatggccaggttcaaacttgtgctcttacctacacgtttgactgcctctcactaaggagttggaacacaaacagttgtttagtaaaacatgtgctgctccatcagattggctgtgatgcactgttcacactttgctccatttaaatttgttaaatcagtagaggagaatcaatgcctaaggattaaaactttttgaacttagagatttacagtgtgtctgtttaaatatgcacaaaatggactttagatttagcagaactgactttaaagtagtacactatcaaataacatgtgaaattaaacctgacctagttaagagatcatgacactcacatttctccatggctgttttagattttgtgccttataaaggtaactggttaaaagttgaatattccactgaaccaggcttctcaaacttcaaggcaagctctgtgaagtccacccattgcattcatgcggaagcggtaattactttcctgttgctcccaccataagtttctgcgaacccttcctttggtggtaactttcgtgcccaggattctgttgggtgtaatgggaattccagaaaatatgaagaaatacattctttgccaacaaaggagccacttttcttattgaaaaggcagaattttccaaaggaaataattagaaaattatatagaacaagcacatgattaagttctaaattgtgcattttactcgatacccaaatgttattagaatcttccaaggacaggaggaagaaaaacaatctttgtgccagaaaactatagggaaagaatgaacggagtgtgttgtgggacttgagctgaccagtagatgctaagaatgatttggttattaaagcctgaatatgcacaggcaattcaaggcaacagagggtaatggacatattttggtaatatttagagcaggatttctcatcagagacccaggcctcattcccagagagtctgatttaattggtctgaggtggagcgtggacatgggtatccttacaaagcacccctggtgttagcaatgggccaaccaggttggaaatcaatgatttgcatcgaagtgacctgcactcatgcaggacccagggtgaggaggtgcaaagctggttacagtgcttattgggcttttccataatcatttccattatttatactcacaggtctgcattactagcgtacatggaagaaatggggtgatagattatactatttttttcaccttggattctgtgaaacttcctgatggatacgtacctcaagtagatgatatcgtcaatgtggtcatggtggagagcattcagttctgctttatttggagagcgatttctatcaccccagtgcataaatcgtaa

SEQ ID NO: 3762 - DNA, 13501 bp, human; identical to SEQ ID NO: 3761

SEQ ID NO: 3763 - DNA, 555 bp, human
gcagacaatgttttgcttgagagaagctactttctaggcacttcaacattcattcaagagagctgcctcacaagtgccctgaatgcgggaaaggattccctcataggtccaaccgttatcggcaccagccagttcacgtgtgggagacccctgtgaatgcacagtgcataacaagcgaataataagtcgcacctcacagcacctgtgaagacgttgtgataaggaaatgtatgagtgccttgagtgcaggaaaggtgtttctcctagatcaagtctgacaggacacccgaatgctttcacaggtgaaaaatctcaaggttgtcacagttgtggggaaagctttagtcagtcgacagctcttttttgcacccgagaacacacgctgaggggataccatttatatgtgatacttgcgggacaagctacagacagagatcaagtcttgttattcgcttaagaatctatacgtgggagaagccatacaaatgtaggcactgctctaaaagcttcataaagagagcagaccatatgatgcaccaagctgcacactttaga

SEQ ID NO: 3764 - DNA, 95145 bp, human
gatacaatggtgtcgttcgggaaacgcagccctaacgttggtcctaagctgacaaattggtctgtggacgccaaacttccgtgctaggactttctgcgtgtggaccgggggcctagtcctgcgtgggtccaacacagacaggagaaagctgcctgcttttgtgcctcccggaggtcctggtagaagcgaaacggggacaggagctgcagcgtcccaagcccagtgaggcgaagctactggagacagctctgccgggtccaaagttgggctcaccggctggaacttgaaaccggagcacgccggactcctgctgaagccatcatctctctctcctggccccgggcgccttggccggcgggcacaactggtttcggggccaaggtggtctggaagcctgactgtggcgtctggcctgggctcccgcgagcggaaaaggttcccctcctgtgagagggaaactatggaagttcctacgcccggagccagaactcctgctgctcccgcccgacccaaggtctagcttggcggcctcccacctgtgcttctgagggttctgcttccaagaggctgctggtgcccgggacaccagcagtttcgccatgggtgtttcgccatgggagtttcgccatgggtgactttggcctgagatgcgctccatggagcagattctggagttgctggtgttggaggagttcctgactatcctgtcccaggacatccacagcagggtgcagaagctgcaacgggcgagctgtgaagaagctgtaactcttttaaagtatatgtatgacttttaaaagagagagcttgtgaaactgagggaataggtgagtgagagagaggttttatctgccatcttcctcaaggaggcccagcctcccctttattcatagggttctgggtctggtgggtccagaggactgagacatctcgctgtcttaattccccattcagattttcttgattgccctgagtagaccttacacgggccagtgattttttgttgttgttgttgttgttgtcttctctggaaccttcatcctccagatttccccccagtgcagtgaagagtgtgctattgcttttggtttccacggggaggcagtgtcgctgtcatagtgtccgctctggaggtagatcaaagggggctttcaactcctggctctgctccctactagctgtgcgactttgggcaagtgacttttgcttggctgggcttcactttctgcactggtcaaatgcagaaagggtaatagacccttctggggttgtttggaggattaaagggagagcagtatgtccgtaataatcgcactgctggcacacagctagtgcttgaaactgtgagctgctgttaggttaggggcagcagtctggtctcctctgcagagatgggtctcagttaattgtgaacttaaacagtttggcactgaggctttggggtcattgccccagggccacccaagtaagcttgtctaattgagaggaacaggagcagctggagaatgtgggggaggaaccgaagacctatgggggacatgtgtgtactgaaatgggctttctccccacaccctccacacaagcacatacacacattcactctgggtcatggcatcataaaaaccttgagtttaaaccatccctttctcttgttgggtccaaatggacagactctggttttctattgaagatttacacgcagattcctgtcataatttttcttttctatcgagccctgtcatgatgataagtgatagcaggttggttcctagatcatacaccatggacctagcacagaagtgttttcagaagagccttttccttacaaaacagcatgaaagtcattgagccaatggatactgagatttcaaactggagccaatggatacttagaggagccctgaagtgtagagtagttgctacttcttgttcactaggtctaattagcatgtcatcagtgtaacagactagtgtgttgtcttgtgaaagagaaaggtgataagatccctgtgaactaaactatgatgtagggcttgaaaattgatatacaatacgcctgaggtaggatggcgaaggtgtattcctggtcttaccagctgaaagtaaattgcttctggtggtctttactaacagttattgagaaaaaaagcattttcaaggtcaagaggtacatactaggttccaggggatatgttaatttgctcaagaaatgaaaccacatctggaacagcagctgcaattggagtcatcacctggcttagtttacaatgacccactaccatcttccaagatccatctgccttctgcataggccaaacaggtgagttaaatggggatgtctgcatatttgaagtcactgatggtattactaatctcttgcaatctctctaggagtatggtattgctcttggtttgctattttcctaggtaaagacagttctagtggcttccacttgcgttttcctaccacattagtcctcactccacagatcagggaaatagtatgaggattctgtcagttgctgagtatttttcttccaattatacattctggaactggggaaataaccataggataagtttagagacccggaggacccattgtgagacaaagctgaactaaaactccatcaatcccctgaccaccataaactgttaactctgactggtgaactgcagtgacattttgaggcttttggaatcagtgctagttcagaagcaatatacagtaatcgctgaaaagtttgattgtttcattttccctactgcacattcacccctaaagccatagatctctttggggaaagctgcagaaaattagcagtatatatttttggcagtggagtggagtggagtccttctttattcatagggttctgggtctgtaaattgactcaaatctgggaattgatcgaagggctaggactattttggtgattcaggttagacttctgtgcactcaatctagaactcatccacttatatatatcaaggaagaatttagtagactgccatctgtttctcttcaagggacaccatgaccaactaatcaatgccatatgtccctgtgagtcagactattcttattgctgcattgaatctgctgcccattacagtaactatgcacactttgtctttgtcaattaagtgcccccacttggcccctgccaccccacaatccagctatcctcattacatttaattataccggttcagtggcagtagtttcctctagaatttctgacctataaagaagagcaattacaaaactttttggggttgcaggggctcctctcacaaatctgtttctcagtcacgagacgtatgttttttggaccctccaacatgggtgagcagatcaatccactttaacgtttcatgggctgggcacagtggcttacgcctgtactcctgggcagaacaagtagaatccagtgacacccctcccccataaacacacactcacagagtccccggacactgtgcctgctctaagatttggattcctagcaatatcaaggtacttgttcttctgaattcacttataatttctattctctattagtccctttagacccttcctcaaagattaaaatttcaggggcactggcatcaacattttagcttatcagctgtcacaggctttaaaaattcagaaaggagggtcttgtgctcagagattatcattaagcattactacttataattttggggatttggaatcgaggaatatatccaaaatggggagattgtctaaaaaattaagatgcattgatttgatgaactattatgtagagattaaaaatgatacccataaaatatgaccaaaagctaatcattggattgtggtggagggtgtacaggtgtttactgaacagtttttccaacttttccatatgtaggaaaatcctcatagaaaaaagcttgggaaagtctagaaaacataaaacaagacctaagtatgacataatttctacattggagcacacatgaaaagaaagaataacgctttagtttgttttcatgtatgaagtgcataaagtgaatcacaactgtaaaagcatttgcactaattctgaatttgtctctcttcattgggaccatctccacattcttcctatcactgtttaagtactgtggtgcccaaagttgtgcacagctctttcagtgactgctgtgtatggagagaagttcagagcacaatttcttagagctagacttgtgtttaagtatacatttgctgaacctcaaatctttcggagagatatagatgctgatatctgacccataggagggagtagggctcttctagagctgggcaaggtggagcgagggagggggctgggcacagggtaaatatgtactgtcaggcaggctgtacactgcacaactccaggatatattgcatgtgaatgaatctactttaattgcagagtgcacaatatgtgtaaatgtatgcagcgaccctggagggaggcttgggaaagaagtggggagtattgagacaggaaccatgaaaggttgggaattccggagcataatggcatgctgccccacatcctactggtagctctgggagtgagacctgccctcagtgccccacaccaacaagaggcagcaacaggagttcagaaatgacagcctggtatttaggaaagagaggtcctgccacagtgctgtcagattccctatgggtcatttgtagcatgaatgagttccagctgcaggcccagaaagagaatccacagaggcactgagaagactggtcagcaagacaaggaccaggacttgaaagagaatggttcagagtatgtagctgtcctgactagaggccatgatggaaaccatcaataccaccatctgtgtgccaaaggccaggaagagtcagtcttatctgttgaagatagaggggaaaatggcaaacactcaaagaccaagggagatgagggagcaaaagggacaggcccatcctccttgctgcagtcatctgtagccagacaatttcttggggaggaagacgaggggaagaagagtgagagtcagaagaggagttgaaggagaaggaagtgaggattgggtagggagagagggagagaagggagaggaggacaagaaggagaaaagcaaggagaagaagtaaaggaggaagaatagcaggagggaggtgaagagaagggggcatgaggaggggatgaagaaagaggaaaagggggaaggattaggagggagagtagggaagggcacatgagagggacagggcagccttcataaggatattggactttaaatctacacaactgaaatcaagaacaaaataagcaattaattgcctaaaagtgattatattttaaaccagaaggaattgagtcaccttaaagtggcaaggtttggtagtttcttctatcagtagaaataagagtttatgagcatgttgagatgagttataaagagagtcacatttctgatcagctcagttgttacttcaaattacagatctactagaaagtgtcaacatctgcagagtttccaagtattgccaaaatgcttacatgtacattaggaaatttctctagctgaacttcatgaaacagcagttttacaataccttatcagctattatatggatgaaagttctccatgctaaaacaaaattaagaaaacctgagttaaagaaaagaaatatgtacttgtaatcgcatgctttcttggaatctttggtactgatgggtaccatctgcttccatcctctgacaccccctcaggtatacagtgccctcaggctgccccagctgtctagagtcctctctaccccagattgcggagacaattctgagtctacctgtcttgtgcagaagccaggagacagaagacagtgcagaacaggaaggggaaggaatgttctctgagagaggaacaggtctgttgagtgcacctttccacagatgcacccaacccccaactggaataactgttgcttcctcctctgctcattgtgtctctgatccctccccatcctgcgagctctgtctcctgctgcatcagtgaccttcctcctccttgcatctcatccctctctcacatgacagtagatccttcacctctcagggcttctcaacccccaaaatcctcaaattgcatcatctttcctctctgcttacctcacacaccaaattgacatgagatgcaccctgtccttgctccctctccttcttgacccttccctgcctcctttgccctgagtctagagctgacgccctcatcctactggcctgctttccaatgacataagggaacatctcggtagtgaatgccacttcttcttagcagttttccttcacatctcacctctcagaagcatttgacgactgcttggagaattctctttgcatttaggattccaatatttacctcctctgacaccatttacctaatgcactcctccattcctgccacctacatgtgggtgtcttcaagactctgtcctgagcaaaaagaaggtacaattgaaagttttcacgtgattccagttttataacaggaaaaatgggtaggtatgtagagaactgagtagaaggaaatatataaaaatgtttacaaatattttaaaaagtaaaaaatgaataaaagtaaaaatttgagtggttctctctggataattgacattatggcagtatagttcactctttattctctgctttatgccattatgaaattatgaaactaaaaggcctctgcagtaagaaaccagctttgtaatcagaaagaatgcacttattttcaaataaaattaaaaacacaggttacaaaaacaaagtaataacagtgtaatgactgtaagttgagagagaaaaaattatatacattgtatatatgtgtgtgtatacaaagtaaggacaagaagaaaataaagcaaaatatgaaaagcattttgtttagatagcaagaaaaaagttaattttccttatcttcattttcaacatacctttaatgaatatctgtttacctgcccccacacgcagataagttccatgtcattctaggtgctgtggggttaagggccctcaggctacagataacacacacctagttccaatcgtgcctctgcaacttactagctgtgtgtccttgggaaagaacttcaaggacttctttgcaggtatctgattagtggaggtccctaacaacttaatgacattggccaatgattgaatgtaaagcacagaaatcacacttgaagaatagtctcactgtcaagggatccccgaacaaaggctcctgtggtttacaaacctgggaataaggagaggggaaggtctggagtgaaaaagttctgagtactgagccagcatggagaaaggtgtcttgaagatttcttttcctctctccataaggaagttcaggcagaggcaccagggctaaaggccccggataagtgggctaggagtagggctagggctaggaatgcagatataggtaagaggatggctgcctgggtaggggactgagcccttgactgcagctccctttggacagtgcagtgcattggctgtggaccacctctgatgtaaggagggcagcctttcacccagatcatgagggctgcctaaaaagtcactcatacgtttttggccaggagccagactcctcagatatggttagatatttcattccattttcctttgaacatgttcgtgcatattatgtaccacagtctttgtctatttgggctgctataacaaaatacctttgactggataatttataaatagcagaaatttattgctcacagctctggaggttgggagtccaaaatcaaggcaccagcagatttggtctctagagaggcttcactccttgcttcatagatggtgccttcttgctgcatcttcacatggcacaaatgggtaggggactcactcaggcctcttaaaaggacactaatcccattcctgagggtacagccctcatgaattaatctcttctcaaaggctccacttcttaatactatcacattattaggttccaacatatgaattatgtggggacaggaatattcagacagcaaccacagtaacaaaaaggttactttttcttaatgaagaaaacataaggatagtatttaatgatgcgagtttaggtgggaagcaaaaacaaaaaaaggataagttggtgattaccataaaattcaggatagtggtaacctttaagagggagggagaatattgtgattaagaggggccaggtgtgagatttcaaagttgctggcaagttgtatttatttatttggatggcagttccaggttttacttgcggtggatcattgagctgtgtatacctgtgaagtactggtttatccatacacacagacatgcatatagcacaattatatatgagtatatgtatgtgggtgctcaggacttggaggtgaagtctttatataccatgccagggcaggtaaagcacaagctcagcttttgatctgttttcttctcccaacactcagaacacaactcactcatcctgccaaggagagtaaaaggcttcatcatttccttggatttaccttgaatgttgatcctaagtcaccatagctgtgaggtagggacagtgtcctggagactaaattggctagaggggcagaaggggagtgagaaggcaacttcagggaggcattaggtaagtcctggtggtcgagctagagcaagccaggagagcagtgcctcccagagaaggggcattcaggagctgctccccgtgatgcactggaatagggaaaggggatagtcagtactctccatcgaacttagaagaagatcccaaaccttctcagatataacaaggtcctaggagaagttggccctgcctacttctcccagtctacctcctctcaaacttcaacctctcatcactgccccagccattctgccctcctgttctttaatccccatgaggtcctttactcacacacattcttttctcagactgggaagtaaaaagaagtaggtccttgcagcagttgggactagagggtttgtagagttgcttggggtcaaaacagaggttaggggtgaagaggatttggaaggtgctgccactgctaagaggcccaggagtagcagcatacagggaaggtaaagaggtaaagattctggacctccaatcttctctgggccatgtgctccctcataactgtggtcctgggggtaaatgtgaggttaaaaagaaagtatttcaggcactggattccctggcactaagaagaaatagtattagcatgcacatgtataataaatatacatgacacactgggcgatgatcagagaccctgcactggaatcatgcagctgtgtgttatgatcatcgcctagagcacaggcccctccatacacagcagggagccccttcatcttttttccttcaagctggcactagcttgaagtggagtgagagagagtagggcagcccatagaaaagatggagggagagggggtccaccccttcctggtttcattcctacttcttgttcctgttccttttcctacccctagaaggccgagcagtggtgggcattgtgctgctttctttgagagcctttgggaatgatcaaggatctccctgcatatttggcattggttcttcaggcacaggacaacggatgttggtcaagctccacaggaagtgaacttatcagactaggactgtaagcccctagacaaaccaaaggaaaccagagcctggaggcatcctaaggctgatgagtgtggacatgactggtcctctggagcaggcccagggaagggtcactctctaccccaacctggcctgggggaatggcatcatagattgcttggggtagaaagtgacccctcccactattataccaaaaaatcatttacagattttctcttttcctttccgccaaaatagcaattgggtggttttcaggttaaagtcttcaagacaatatgcctctcccatggaacatatccatggttccattaaattagaaactgacaatgaccaattgtttcctgtccattctaagctgttcaggttgcagaactgatagctgagaaggggtgttgaataagtaagtaaactggattattaagggggaattttagtttgctgcttcatagcgatgaaaagatgattatttctggaactgaggggattcactggggtacctcctagtactcctgtgtccagttctgatgttcgttgtaaaagtgctgcaattccataattatatcacctctaaagactgagattttttagactgattttttttggggggaattaaaactttggttgccccaccaggtaaagatccaccaatattttgagattttggcagaatttgttttgcgggaaggtaggtgggatgatctattctttgtccatcccatgatattgtgtaggaaaatgtctcatcagccttaaggttacaatttacaatttagatttcaagtgggattatgataaaaagtgacctcaccctatgataatataagggctaatgggactttgtgtggtaccctgtgctaggcaaagggttccttcatctgctcaaagcaacagtgggtgctggttgtgggaaaagtggtggattattttttgttattctcagtttgtttaatcagatatatcctacttccttctctatactgctctgttcctcaggtacttgacacataaaggctatatcacctggccttccttgccctctgactagtggggccaatgagaggcagcaggcatatgtatttggccaataagaggcagcaggcagaaattgaggtgtggaaggagagagtatttccatgacacagaataaaacactccaatcagcctccggtcctgaggttcacctgcaccaagaatttctctgttagggttacacataacctcctctaagatcacttaagaatattcttcttaggagaatcccagccaaattttctttctctctctctctctgcctctctctctctctctctgccagtcactccccttttggattttttacttgtgattctgatttctggagcaacaaatcaagccctctcagtgaacacttagagactacttaatttccccagtaagtttgaggtgaagggtactttccttctgtaaacttagcatactatacaacctccatgaagtggggcttctctggtctccagcctacccagattctcccatgtgtgtacatactctcacatgggtgaatagtgagagttcattccactgtttgtgattaccttatttaccaattctctgtggatggacaggtaactgcctgtgagatgatgagtagttgatatcagtttttctaggaagtcagccaagtctgagactagatagagtaccagttgaacatcctgctacactagtttgaatctttactatctttgtatgtaacaaacttgtcttacttagtccaattgggctgctataacaaaacaccataaactgggtaacataataaaaagaaagtctattgctcccagttctggaggctgggcagtccaagatcaagatgccagcagattcagttcctggagagggctcacatccgggtttatataacagtgcttcctcacatggcagaagggatgaatgagctcctttgggcctattttataaaggcactaatcctattcatgagggctccaccctcatgacccaatcacctcccaaaggccccacctcctaatactatcaccttaggatttcaacatatgaagtggaggggtggggaacaagccttcagagcatagcataagcactactggacccttctatgctacttgttttctcactcaatatgatggtgagatttatccatgtgtaactatgcatcctaatttctgtctcttcagttgtgtggccatggggtataggaggttggctgttatcggcctctgctcctgtgggttttactccttcttggcctacctgctgctctttcagtctccattccccaccttttctcctcctcgcagccactgtttgatgctggactgcaggaaaatagtcaccgatgcaggagtgtccaggcagtgttcccaccaacagtgcacccaggaggcccttctaccttgtagtctctaacccctccccatttcatcctacagccagctgcatcctctgaagagaggctggtggctattttttggcaatattgaatcagagcagggacagagaaggcgacagggacagagaggagggtgaaaaggacatggaagggttaaattttctacctaacacaaatctggaagaaacctggctaaggggagagacagtaacagcgccttagatgtaggtggaggtggagagacaggaagaggccttggggagtgctggacaggttgtgaggacccagagaatttgggaggagaggaagagggcacagaaggactgcttgcaggcttattttgcagctcacaggaaaggacaagagaaatgcttggaatttgcaatggctttaatggttgaccttatgttaatttcatcttactcctaacttaagcttgcccatatccaccatggctctgacctctttgcaatccctgtcccctcttcagcttgagctctcacttctcagtgaccaattgcctacataattctcatttcacttgtctcagagcgaatacctgtatttcccagtcctttagcttttttttcctggaagccatgtcacagtcttgttatcctctggtttagttccacttcagtcaaatgaattctcttcaattggctgtggcctaaacagatttatttcagatggcacaaataagtgcacctggggattctacttctttggggacaatgagaagaacaactgcttttagaaggatctgaaagtatgctgttccctatattaaaatgccttgtgctctaattttttaatattaaatagaaccaaaaatccacaatgctgtagtttctaaatggtgctctcatgagcatcagaataaaaaggtatcctaaacctcccacccaactcatgggttcattattctcaaatatcttttcatctgggtaagcaattaggttttagaggagaactggatggatatctcttcaaaatcgttagggagaggagtcttgcatccttgcatggcctggtactaacctaagtactcccttgctttgaaaaaaaaagaaagatttatggtggaagaaatctgatctgcagcatgacctgtatctcccctgtgtctgagtgctcctgcacagaatgtttagaatgaatagaatcccctgtccagtgtaactcaagaaagccatatcagcataaaaacatatcaaaccaaaataaatgaaaacacagcttctatttcaatagctgaagctagggaagaattttattctaatactttttaaaaaaaattattttccaagattctgtgtaggcatgtgcttgtaagtcacgtgattttttttggcaaaggccagctccaccctggcattgctcgtgtcagcatccacaaccactttgtcagatccacatcatttctgtgcctccccagttgtctaccgagtaaaaaactcagcacattgttgggggacatgttggactttaagtattcatctgccttcctcctgatatttggtgcaggtgtgctgggactgacttcagagagtcctttgtccgtgactggtagactccacgttgcctcagaaagacagcacaaccaagaaagcctggtaaaaatgatgaaatcaagataaccaagtggacccaggggtcttttcctcactgtccactatcacatccctatcacatcacccccacacacgcacacccatacccacacagacacatactaacacactctgctaccagcagcagtcataagagattgctttgggccatgatctgatttaaaatgccaacgatactatttctttcattctgtcatacacacgggtctgtatctagaatctgctctgttttattgaggcaattttcatccctgttttaatttctaaatctattatgtaggttttcatgtcttgtaggccaagctccctatcaaggttattcccatatgtgttcttgtccttttaattgaataatcagctcattttgtttcatgtcaaattcatatggaggttcatgactgtgcttgcactgagttcacagattaaaatggtggcagaaatgatatagtaattaatttttcaatctagaaataatggtataatagtgtcaaacaggaaacatataaaaatgtttcatgaataattctcagtatttaaaaaaatcatattcaggtatatctgatggccagtgtgaactggatatattattcctattatttcataatttattcttagaggagcatacaatatcttcttttatgtgtttagcttgtgtctaccttacatttttgtcaaactgggtgatttccttggttgacagaggcaatttttctgaattcctattgttaatagattgttatatcaataatgtgaaataaaaagcagccattgaaaaagatgatggggttctctatttaaaggcatgacagcactttgggaggccgagacaggcagatagcctgggctcaggcgtttgagaacaccctggaaaaaatggtgaaaccccatctctactaaaatacaaaaaattagctgggcatggtgacatgtgcctgtagtcccaggtactcgggaggctgatgcatcacttgagcctaagaggcagcggttgcagtgagccaagatcataccactgcactccagcttgggctacagagtaagactccgtctcaataaataaataaataaataatttttaaaaaggcatgaaaaatatctctaaaaagtggtaattgaagaaagaaacttgcaaaacattatgcattttatcatcctatttttgtttcttcatggagccatatataaaagtaaatgcagaaaacaaggtctagaagaatttacagcatagtgatgatggaagttctggtatagaaatgtaagttggaggactgtaagaaaggagttgggactatcagttgtataagtgtcatttttgagtgtatttccacaaaaaagcatgagaatatgtgtgcaagccaattctgtcagtggtatttaaatgaaacaagattcttcagaggtacagatttgagacatggacaggcaacactaaggcaagttgacctacagtcattgtctcacctatttcttccaaaggaattgttacacaaggagcgtggtcagagggaagtcatccaaaaccaaaaacccacaaaaacatagacaatgaacctgtcaatggagttcaaggaaagagaacagacgtagccagggaaaattgtcaaccctgtctgtgactttaagaggttctccttgcattgggaaagtgaagaggtgaagacatctattgtctagtcccttaggcttccttggcatcctctgttttaccagtaatacagtaatgagaagaataacaacaccagcaatacgaacattactcaccctcctcagctgagcactgtctgcttgccaggcacttctctgagggcttgacatgcagaaactcatctagcctcataacaccttgaggtgggtgcaactctcattcccatttatctagggcaggagacaggcacaggaaaatcatggaattggcacaaggtcacatagctagtatgtggcagtaccaggatgtgaacccaattagtttgggttcagaactaatttgtttggaacactaaacatggcctcagggtctttacatggttctacctggggtagaagaaaacctggaggactaagcctttcctgccactcaaacaacagagtttgtgacttgggtcacaaacgtcccactttcaggcacttgtacctcaatttcctcccttcttatgtgagactgagtggggagccagtgtggacaaaagccacatctactcataatagtcattttagttcctcagggaaacagcactataaaaaacacaaagctctgtccccaccattatccctctgtcagcctggaaaattcatgtcctgcctctggacaatacccatatgggtcacactttaatggtaacaatatagttattctagatcagagacttggaagggaatatggcttgaaacatatgggtactctcagtcaaatttctgcaattaaacaccccatttacatgaattgtgtattataaaagtgataattacagtcatgaccaaagctgggtgtagagactgagagagaaaagggaatactaccttgtactgagttctcttgtagctttcactgggtgattggatcttgaagtcagaattgctgatcattgcccagtggacctgtggaaatgcaatgaatactgttaacagattttggtaactcctcccacagaagttaccaaaatattttaacagtgttcttggcctgttaacagattttgcatgagccagggaatagctctgaggccaagataactgagtgtctagggaacagatattacaaagtaatatctaccccctctgccagcacctcccacttactcactgtattcagccctgaaccaggagtaaccctggtggtagtggctagtgtttagttcttgtcattgcaaatggtaacagggttctcagctgcattgtgagtcatcatgactcctgttggcacttaaccaatcatgtcctgggactcagagaaacaatgtaggagaaagagaaattaatttttcctctctcttcttaaccctctctcccagaccaattgctactcctttgggaactgtggctgctcagtggtctgggagataaaacatctagatacaaccagataatgtagcatctttacttgccatcaacaaactaattgaactcatgaactccacccctgctgtataatggtagggtggggactgtcatttgtccaaattagtaaaacatcattacatacagacatggctgagaacacaggctcaagagacaggtggtctgatttttaatccaagctctgtgggattttgggcaagtccctaaacctctgtgatcttcaggttccccttttgtatggtaaagataacaatagcaccatcattcttgggaatttctgaggattatatgagatgatgtgttcggaattggtgggttcttggtctcactgacttcaagaatgaagccgcggactctcgcggtgagtgttatagctcttaaggtggcgcgtctggagtttgttccttctgatgttcggatgtgttcggagtctcttccttctggtgggttcgtggtctcgcgggctcaggagtgaagctgcagaccttcgcggtgagtgttacagctcttaaggcagcgcatctggagttgttcgttcctcccggtgggctcatggtcttgctggcttcaggagtgaagctgcagatcttcgcggtgagtgttacagctcataaaagcagtgtggacccaaagagtgagcagtagcaagatttattgcaaagagcggaagaacaaagcttccgcagtgtggaaggggacccaagtgggttgcccctgctggctcaggcagcctgcatttattctcttatctggccccacccacatcctgctgattggtagagccgagtggtctgttttgacagggcgctgattggtgcgtttacaatccctgagctagacacaaaggttctccacatctccactagattaactagatactgagtgtcaacacaaaggttctccaaggccccaccagagtagctagatacagagtgtcgattggtgcactcacaaaccctgagctagacacagggtgctgattggtgtgtttacaaaccttgagctagatacagagtacccattggtgtatttacaatccctgagctagacataaaggttctccaaggccccaccagagcagctagttacagagtgtcgattcgtgcactcacaaaccctgagctagacacagggtgctgattggtgtgtttacaaaccttgagctagatacagaatgccgattggtgtatttacaatccctgagctagacataaaggttctccaaggccccaccagagtagctagatacagagtgtcgattggtgcattcacaaaccctgagctagacacagggtgctgattggtgtatttacaatccctgagctagacataaaggttctccacgtccccaccagactcaggagcccagctggtttcacccagtggatcctgcaccggggctgcaggtggagctgcctgccagtcccacgcgatgcgctcgcactcctcagcccttgggtggtcgatgggactgggcgccgtggagcagggggtggcgcctctcagggaggctcaggccgcacaggagcccatggagggggtgggaggctcaggcatggcgggctgcaggtctcgagccctgccctgtgggaaggcagctaaggccgggtgagaaatcgagtgcatcgccggtgggctggcgctgctgggggacccagtacaccctccacagccgctggcccgggtgctacgtccctcattgcccggggccggcagggccggccggctgctccgagtgcggggcccgccaagcccatgcccacccggagctcagctggcctgcaagcccgctcgcagccctggttcctgctcacacctctccctccacgcctccctgcaagctgagggagccggctctggccttggccagcccagaaaggggctcccacagtgcagcggtgggctgaagggctcctcaagtgccaccaaagtgggagcccaggcagaggaggcgccgagagcaagcgagggctgtgaggactgccagcgtgctgtcacctctcaatgatattactaaagcactcagaacagtggctggcatgcactggctctgagcactctctgcatgccagccactgtactgagtgctttagtaatatcatctcatttaatcctcctcccttagcatttatcatgtggtcacctcagccaacctctgatttaagcagtcaccattggatatacatttccttgaaagtgtgtctcatcagtagggttgtttcccctgccttcttcccatttccaaagaagacatcttagagtaaggcaaagctcatggtcctcacagtagcagaaggggcagggctcctgagtcttaagctggtctctacaccatggccgatggtcaggtccttggctatggaattgcttgttttcactcaggaaaggacattccatttttgtccctgagatttctgctagcatctgctgttgagaacctcagctgggctaacacagcatgtaccgtattctcagagacctaagacaactacgcttgcagccatgcatgacctcaattctggttctcctaatgttagagcgtgggcatctgggcctgaagccctgctgccggtgatactaatggtgctcaggtgagtcatgaccttaagtcacttgcaacactgtgagatccaatagcctaccgacacactgaccttcagcctctgactacagtgttactggtgtcacagaggtgtatgtgtcctgaggcaagaaactatatttttattagtgcactaagaagcactgatgtaatgtccaattcaaacaagagttagtatactaacagcagcatcctctgttttaaagtataattgtatactgcacataattgttgcagcatttattattaatttaacaggtatccacacataataagacaatgtctctccattactttggaaatcaactttttactagttcaaatgttttccactttacctggcctggattaagaacatagtcactaacataaggtaaatgtgtatccaagttccattgctgacacttataaattatttttagatcaattgggttcacttctctaagcttcattttctcatctgtaaactggggtcataatcattcctacttcaaagtttgtcaagaaaatgtgtcatcaagtatcttacctccatttttcatcttttactgtgacggattttaatcagtgcctcgggttgcctgccctcctctccccagaaagcctcggtatgtgagtaataaacctcttaaaaaccttctttgggtgtgcgtgtgtgtgtgtgtgtgtgtgtgtgtgtgtgtgtgctgcaacaagtattggtacagtgagcatgctttctaaacaatgtccactatcacagagtatctttgatctcttggtttggcttcctcactggctcagctgctgactgaaaggatgcactttgagctgccttctgctagaaagcttgctctttgagctatgtttctttgctctgcatttattgaatcctaccaagcttcagtttaactaacctaatatggaaatttcaacagttaactttggggatagaattatgggattggggtcatccttaaaatgaccctgggtaatgtgtctggttccaaatgtatctgtgtgtctcagattacattgaattccagaataagccatgactgtcactgggctcaggggaacgaatcttaccctgtgactactgtctgtaagtctcaaccaggcattggccccattctgtagaactcaatggaaagaataatgccctgtgcaatctatgtgcccatgaggtggtcactcatatggaggaagagcagttaccatgtggcaggctgacttcttgctcctaaaagcaaaagcctcactaggaccctacaaaatgcttttgttgtcactgcagcctatgactttgtaacaacagaacccctgattatgttattggaaaatgctaatgatattttcatgtgccctgttgcacaatcaaggggtccattcaaacccgacttaagcccaggatccttaaacccagtaaagcaatcattgccataaggaaggctgctaactctgataataataacttgagactatctggaagaagaaaccaataaatatgagcagggtagggaagacctcccaaagtgtatttagcatttccttaaaaaacctgaatacaagggtgaagaaacaaaattgacccaattggaaggcaagcatttactaaaatactatatacaacagaaaaacaaaagggtgctgatttgtttttatacctctggattcagaattaattttaacacctgctaaaatacaccagttggtaaaccttcatgtccttaatcagtactggggtccaaagtacagctatatctggggatcccactacatttaaacaaagtaccccctatactcttagggcagttatcaaacataaaatagaagatacacaagtatgccttaccttaaacaacagaactgttacattgcctaattttctatggccgtagtccccattgccctatctcatagtgggcatggatactcagactcaaatgagtaaaaagttaaaattaagtgtttggcacaatcagcttgagttttaaaaggaccccatagaccctgcgcacactacctcatctccaccagttgaaattatgcaggcaaatataaattaaaacaggtcctttaagtattgaaacccattatctgtatctatatgtcaatatctatatctatcctatctgtctatctatctgtctatctacctatctatctctctataaatacatttggagagaaagagagaaagtggtaattatctcccttgtatctccatttaacagctcaatttgaccttttcttaaacttggaaaaaataaatggcacttcatggcatatttcctcaactttgatgtcaaggttgaaaggccttgattaaggcctttgtattagttttctgttgctgctctaacagataaccatgaacttaagtagcttaaaatgacacaaatatattaacattgtgagtgtcagaattctaaaatgggttgacagaattatgttccttttggcagctgcgggggtccgtcctgcagaccctgactcaacaatggatgaataaagtacactgacacacaggtattctgctttgccggtccagctgagtgtccaggccacttagtagcagccgaggtcctgaccagctggtgagactcgcatttattcagcaaagattaattgacaaaggcttgagtcaacaccactagagggtaattgacattgtggacttcccgagtagaaagcaattaagcacctgcagtaaatcaaaggttagtcttaggaccacatgagtaaacaagttagttagataaactactctacattcctttgtatttgcaccctgagctctctggctcctgcatagagactctggctgccttcagccagatctattaccgaagttatgcaaactctcaggccttccaagagcatttgtggctattataactaaaatttttcccaccagcctgattgaacccccacaggtagctctagggaagaatatattcccttgccttttccagcttttacatacttctcacattcactggttgctggttcccatcgcgtcaacctctgcttctgcagtcacatctcattccccaaatctgacacaaaagccattagacatgagctcctttatcaacatcctgacatcttccagctttctctgcctactcttctgtaacaatggagagatgtctaagccctttcccaaatccctccactgtgcacatggccttcatgaagattttgcctttatggggacttcactcctgcataaacatccaacactaattgcttctcttcctacatcaacaatgtttcctctttctaattaatcaaaagaaacaattctggaatctatttaaaaatataaaattatataaataaaccttgctataatttgaatgtgtcccctccaaaattcatgggttggaaacttaatccccagtacagcagtgctgggtggtgtggcctttgggaggtgattaggtcaagagagttccatcttcatggatgcatggatggattaatgctgttattaaaagggcttgcaggagtggattcacccactttcacttttctgccatatgaggacacagtgttcatcctctctagcccttctaccttataccatgtgaggatgcagcaagaaggccctcaccagaccaggtgtcagtgccttgatcttggactttccagcctccagaactgtgagaaaatacatttctgttctttataattaccgagtctgtgataatctgttatagcagcacaaaatggactaagataaccccccccaaccttgcttccccttaagtctcatttctttcctctgtagcaacttcaaaaactgacaagacgagcataaagagagatcatttccatttatggagatgcaaaaatcctgaagaaaaataaccaaacaaatcccataatgcattggaagaattgtacatcgtaacaaatggagattattcccataaagtaagaatagcataattttaggaaaatgacccatatttttctccatgttaagagctcacagggaaaaaaagtgaagattttgaggatgctaaaacacagttggaaaccatcattcatcattttaaaaagttacctaatatggataaacatttatttgccaaaaccatcaaaaatatttcaaagcaattgtcagtatcatgtatatacaataaaacagtaaccagacaaccagataagggctataagcagtttttcttgtatttcaagatgcttacttttttacattttaacatttctgagatcaagaagataatgataagatatatatactttaaatgtatattattaaattaatggtatgccttaagaattaaggatattctgctctaaaggccaattagtatggattgggaacatatattttattttctagattctaagatctttttttttttttttgagatggagtcttactctgttgcccaggctggagtgaagtggcacgatcttggctcactgcaacttctgcctcccaggttcaagtggctctcctgcctcagcttttcaagtagctgggattacaggtgcatgccaccatgcccagctaatttttgtacttttagtagagacagggtttcaccatgttagccaggctggtctcaaactcctgacctcgtggcctgcctgccttggcctcccaaagtgctgggattacaggcatgagccacctcacccagccaagatcctcttttaaggttctgaaattatatcatttttgttatatatgtcaaaaatctgacaaatgtctgtttggaaattgcaaagataatttttaaaactaagaaacagtaggtagaatattaaaatatttagagaatgccaaaaagattctcacactggcttatctattttgactctcatccttcaaaactaaacactatggtataatgaaaaacaccactgactaagagacaaaagttctacttcaggtttgaccaagaattaactgtgtgcccattacttccatttcaggtcctcatgacttctgaactgatcttttgcagaaccatattggccccccaactttgccttatccttagacatttcagtaaatttccctaatcacctccacaatcattcaaaatgtatttgtggcctcatgtaatggccaaaaaagaccactcctcataggaagatgttagattacccactacatttcttacctttattacaaaggagagagtttctaccctggcctggaagcctctatgcccctgctgccaatattttgtcctcaatgcaccagatgacatacttcagagctctgctgtggtacacttgataaagcacattgcagaaccacacacttctttgataatgcttatatttgttgcatgtaatacaaagtgggaacttctacaacaaaataattaattagaagaacataagtactttacagaatccaagaaaccaaagcagcaagcatgcttcgcaaggacagaaacaagggtagctcaagagaactcaatagtaggtattctaaataatgttctctatacagaaatggcagtaatgaaacttagaggaaaaacactgagttttggggtctagttccaaactccaaattatcaggaaaaatacctgattggctcatctagggtgaggtgacaagtatcaaaccaagtagcaatggccatgggactcagtcacacagaaaatagaagaatgtgtgtacagttggaaggtctcagagaaaaggagtctgttggacagaatgaccagtctgtgactactgccatttttcatgaccatatatcaacccacattacagatgtaacttagtgagagaaaacatctccctgttttccttcatatattatgaaatatttactttttctagtattttgtctatcttacgtcaaagatttaaatatctttgacctcctgtactaaataccacgccacatcagttttagttgcctttcttttttccttaggctagttttttggtataccatttctaaaccaatggtaggaacattttaaggcatcttttgtctggaatatgttttagcatgtacagcatgaaagttttatatgtttattaatttttgtttataattgttaatgaatattaattttgttaatgaatatatattaaaccaattaataaacagtcacaaagctgcaaaccgttttaataattattaaagttttaattttttaatggattttggtcatctaagttccgaaatgaaatacaccaaacttgttcttactttgccaaattgtcctactgtttctcagaatcaacatttttagacattatgtagaaacactctttaacctagttgtgtcaggcttagtagagaaaggaaaagaaagaaagttggagctggaagaggaaagttggtaaatgtggtcagtagtgcattttgtgtgaccaggcaagttctgcagaacctcttctgaacaccttcacctgtgtaaaatcccagaggcattagttaatctccaaccactatggcaggatatgcatctgagagcaaagaggcaaatggcaagcagagatcacaaaggtgcaagagctagagtagtgatagaaccagtgccaggacgatctaaattcccttgcattgtcaatacgcaaaaaaaaaaaaaaaatatatatatatatatatcaagccattgctcaccttggctcttagacacaagtgagcataggctaccacacccagggctaaggtgagtgctgaggtgtgagtggtgtgtgcactccccacctaccgacttaggctgctgtcactgaaggtgacactgcacccagtagcagctatgctgttactgcccacccaagcatcctgccagtggtctgatgattgctcttcccctgcctctcataggcagcacctgtacatatcatcaagaggcccaaggacaagccatcctggccaagctttgtccctcctcatcctaccttcagacagagcacatagtccaggagccaggggattaccaagcccagtccactaacattggcacctgaatactcctcccaggggcctgaggttgttcttacccacccagctgcctctaccacaggtgacacctacctgtgggccagtttccaggccactacagccaccactgcccgtaccagcatgaaccacttgggaagcagagcatcatcccaccaccaccactgccatcaccctcaccacactgactgcccaggatcctgagaacccactcacttgcctgatccatatatgcctctactggcatccaagtaagctacctggaggcccaagcattggcatgcctggacctgctaacaatggtgccagtgtacgccaccctgggacccaaggacaggcatgcttagcccactgctgccaccagtggggtccaaagactggcatacttggtgtaccagtcccccgcaaaactgtttcacagcctccaccaataacttcaccataagccagcaaggaaaccttagataccactgacactgtttatagccaaagaaatcatacagagactacactacttcatgcacccagaataacagccaaagtgccctactcaaccaatactatagatagatcttcaggaaaaagccctcctctaacaaagcaaattcaaaaaattgaaagaagtgactgatacaccagataggcaagtatcaatgtaaggacgcaggaaacacgaaaaagcaaggaaacatgacacctccaaaaggaacaaaataattatccaaaaccagatttcaatcaaaaagaaattcattaaatcctggaaaaataattcaaattatcaattctaaagaagttcagtgagatagaagaaaattctaaaaaatgataaaaagaaatcaggaaaacaatttaggacatgaatgagaaagaaatatctatcattaaaaaaaattctggaactgaagactacattgaactgcaaaatgcacttgaaaaactccaacaatagactagatcaagcagaagaaagaatctaagatcttgaagaaaggtttttagaaataacctggacaaaaataaaaaagaatgaacaaagcctttgtgatatatgggacaccataaagtaaccaaatatacaaattattggtgtcccaaaaggcaaagagagaacaaaagattttgaaaacctatttaatgaaataatagatgaaaaatttccaggtctaccaagaggtttggacattcacatacaggaagcccagggatcctcaaacatacaatgcaaaaagatcttccccatggtacattatatttacaatgtctaaagtcaatgacaaataattctaaaaaagcatctagttacctataaaggaacccttatgagactaacagcagatttccccacagatatattataggccagagagaatgaaatcatatattcaacgtgctaaaaggaaaaaaaatctgctagccaaggataccatttttggcaaaattatatttcataaatggaggagaaataaagtctttcccagatgagcaaaagctgggggaattcatcatcactagactgcccctacaagaaatgctcaagggagtcataaacctagaagcaaaaggacaacatttaccaccatgaaaacaaaatgttaagtattaagctgaatggtaatgcaaacatacagatgagaaagaaaaagtgctcaactgataccactacaggtaatttccaaaccacagtgacaaacgataagggaaaaaaaggaacagagattatacaaaataaccagaaaacaatgaataacatgacagaacaaaacctcacatattaatggtaaccttgaatataaaaggattaatttctccacttaaaaatatggactgggtaaaagggtaaaaaaaacatgatctaactacgtgctgcctatgataaatgcactttacatatagacatgtatgactgaaagtaaaggggtggaaaagtatattccacactaatggaaaccaaaagccagcaggagtagctatgcttatgtcagatgaaagatactttaagccaaaaatagtaaagacaaagaaagtcattatataatgataaagggatcaaaccagcaagaagaaataccaattctaaatatatatgcaaccaacactggagcacccagattcataaagcaaatattactagatctaaagatttagactctaatacagtaattatggaggacttcaacacccactctcagcgttagacaggtcatctagacaaagaagaagtgacattggatttaaactcaactttaagccaaatggacctaacagacgtttatagaacatttcatccaactactgcagaatgcacattcttttcatcagcacatggaacattctccaggatagagtatatgttaggccacgaccaaaaaaaggctcaacaaattataaaaattggaatcataccaagtaacttctcagaccacaatggaataaaactagaaatcaatattaagaggaactttggaaacaatacaaattcatggaaattaaagaacatgctcctgaacaaccactggctcaatgaagaaattaagatggaaatcaaaacattttttgaaacaaatgaaaataaaataaagcataacaacacctgtggaatacaacaaaagcagtggtaagagagaaatttataacaataaaggctacattgaaaaaatagatttcaaattatcaaacaatgcacctcaaggaactatcaaattaagaacagacccaaaattagaagtaaagaaacttaaactatcagagcagaattaagtggagactagaaacaatagaaaagaccaattaaatgaaaagttggttgataaacaaaattgataaaccactagctagaataatcaagaagagagaagacccaaataaataaaatcagaaatgaaaaaggaggcattacaattgataccacagaaatacaaaagatcatcatagtattatgaacacctatatgctcataaacgggaaaacctagagggaattggtaaattcctggaaacatacaacctgcccagcttgaatcaggaagagagaaagcctgaacagaccaataacaagtagtaacattaaatcactagtaaaaaatctcccaacaaagaaaagtctggggttggataggttcattgctgaattctaccaaatacgtaaagaagcaataccaatccttctcaaactattaagagaagggaattctccctaactcattctacaaggccagaattaccctgatacccaaaccagacaagggcatagtaaaaaagaaaactataagctaatatccctgatgagcatagacacaaatatcctcaacaaaatactagcaaactgaattcaacagcacatcaaaaaagataatacaccatgatcaagtgggagttataacaggaaatgtaaggatggtttaacatatacaaatcaataaatgtgatacatcatatgaacagaatggagaacaataactatattatcatcttgatagatgcagaaaaaaacatttgataagactcaacatccctttacgataaaaactcacaacaaactgtgcatggagggagcatatctcaaaacaataaacgctatatatgacaaaaccacaggtaagatcatacttcatggggaaaagttggaagcctttcctctaagaactggaacaagttaaggatgcccattttcatgactcgtattcaacacagcactggaagtccaagccagagcaatcatgcaagagaaagaaataaaacacacccaaatttgaaaagaggaagccaaactgttcctctttgcaggtgacatgatcttatatttagaaaaattaaaagactccaccaataaactcttagagctgataaacaaatgtgataaagttgcaggatacaaaatcaacatatgaaaatcagtactgtttctgtactccaataatgaaatagctgaaaaagaaagcaagaagacaataccacttccattagctacaaaaatataaaatacctaggaataaatttaaccagggagatgaaagatttctgcaaggaaaactacaaagcactacaaaacactgatgaaggaaattgaagaggacacaaacaaatggaaagacattccatgctcatggatcagaagaatttgtattgttaaaataaccatattgcccaaagcaatctactgattcaaaacgctaatgccatttttttcacagaaatagaaaaaattatcctaaaattcatatggaacaacaacaacaaaaaaagccagaatagccaaagcaaacctaaacacaaagaataaagctggaagcaacacactactggacttcaaaatacattacaagtctatggtaacaaatacaatatagaattagtataaaaatagccacttagaccaatgtatagagaactctgagataaattcatatatttacagcccactgattttcaacaaaggcaccaacaacatgcactgaggaaatgacaccctctttaataaatggtgctgggaaagttggatatccatatgtgcagtaaggaaattagacccctacctctaaccatatacaaaaatcaactcaagatggattaaagacttaagacccaaaactattaaactagtagaagaaaacatagggaaaaatcttcaggacattggcataagtgaagattttatggctaaggcttcaaaagcacagacaactaaagcaaaaagagacaaaaaggactatatcaaactaaaaatctgcatagcaaaggaaacaatccattgagtggagagataacctgctgaatgggtaaaaatgtgtgcaaactattcatctgataagggattaatattcagaatataccagaaactcaagtcaagaataataaaacaaataatcccattaaaaagtgggcaaatgccataaatggacaattctcaaaagaagacatacaaatggccaacaggtatacgaaaaaagtactcaacatcactaaatatcagggaaatgcaaatcaaaaccacgatgagataccatcttaccccagtttgaatggctactattaaaagacaaaaaaaaaaaaaagtcacagatgctggcaaggatgtggagaaaagagaactcatacacttttttgggaatggaaattagtacaaacacaatgaaaaacagtataaagatttctcaaaaaaactaaaaatatatctactatatgatctggcaatcccactactgagtgtctatccaaaggaaaagaaatctgtatgtcaaagggatacctgcactcgcatgtttatcacagcactatttacaatagcaaagatatggaatcaatctaggtgtccatcagtggatgagtggaaaaagaaaatgtagtgtatatacacccatggaatactatttggccataaaaaattccgcaatccatgttgcagcaacatggatggaattggaggtgattatgttaagtgaaatgagccaggtacagaaaggcaattatttcatgttctcactcatgtatgatagctaaaaacgttgatctcatagagggagagaatggaataatagataccagagtctgggaagggtgtgttggtaggaagtataaagagaagttggttaatgggtacaaacatacaggtagatggaagggataagttctaatgtttgataacaaagtaaggcgactatagttaacatcaaatgtactatggattccaaaatagctgggagagagaacttggtatgttcccaacagatagaaatgataaatacttgaagagatggacaccccaaatacccttacttgatcattacatagtccatgcttgtaacaaaataacacatgtatcccataaacaggtacaaaattatcaataaaaaatcaagccatgtcctgaatggacctaggggacattttgctaagtgaaatgagccaggcacagaaaaggcaaatacttcatgatctcccttctatgtggagtctaaaaagttgaacccatagaagcagagaagataatggtggctgccagggcctggaacagtgaggggagatgttggtcaaagaatacaaaatttcagttagaaaggagaaacaagttcaacagatctgttgttaaacatgttaactacagctagtaactaactgtattgtattcttgaaaactgataaaagagtagattttaagtgttctcaccatacacaaaaaaatgataagcatataatgtaatgataagcatataattagcttaatttagccatttcacaatgtatacacatttcaaagcatgatgttggacatgacacaatttttatttatcaatgaaaaatgaattaatttaaaagatcaggccatttcccactgtgggttagagtctacacccagctctccttcctgactgccttacagctgtcagctgctgattgcaccctcagagtctcagccttcttcaccatgctttgctggctcacttctcagttcattcactcttctcagcgattttgtctactgccatgtgttacaaggcctgaaattccatgtgctgccttggcataattgagcctcacagggcatcaaaggcctagccacgattttccctgctctcatcagatatgctccctaccaagtgggaaaagctcacccagctacatcccctatcagccagatcagctgcatatcccctggtattcaaccaaaaagactgattctctaccagctggtacagccactgtttgatcctgaactgcagcaaaatagtaaccaacagaggagtatccaggcagctttcccaccaagagtgcacccaagaggcccctctacctggatgtcctctaaaccctccccttccaacctacagtcagttgcatcctctgaggagaggcttgtggttctattttggcaatgctgaatcagagcagggaaagcaaagttgacagggacagggaggagagttaaatggacatagaggagttaaattttctatctaatacagatccagaagagacctggctaagggtagagagaataacagccccttagatgtaggtgggggaggggacacaggaaggggacttgggaaatgctggacaggttgtgagagcacagggaattgggaaggagaggtggaggggacagaaggactgcttgcaggcttattttgcagcttacgttaaaggacaagagaaatgcttggaatttgttatggttttaatggttccttttatgttaatttcatcttattcctaacttaagcttgcccatatccaccatggctctgacctctttgctctccctgtcccctcttcagctttagctctcacttctcagtcaccaattgtgcacatagttcccatttcaggtttcttggagtatctgacttgctcaggatatttcttagggacagaggtttttcaatgggaaccatctcatatgtcttgttggactattgggtggcttcacttcaggaaaattaattatctttgattggctgtggcctgaaggtttgtttgacatgacacaaaaaagccatcagggcattccactttcctggggacactgaatagagcagttgcccctggaaggctctgtggacatgacatctgcaatgatgaaacatgtcccaaacccccggcccagctgttggtctgctcttaaacgatgtcttttcattaggacaggcattaggttttagagagaaacaccagggtggtctcttcaaaatggctagggattagagtctttggtccttgaatgccaagtactacatcacttcgacttcgcagtgtttttcagattgatgggggagatctggtgtgcagcatgatctcactctctgctctgtgtctgagcacccctgcactgtgcgttaggatgaacaaaagccccttccagtgtaacccaagtaagccctgtcagcaaacacacatccaacccaaaggagtgaaatgacagactctgttttaatggctcaaacatgggaggagtttattgttctaattataattaatgtctcaaaattctgggcaggcctcagcacataagccacatgactttttgtccaaggccatgttcaccctggagttgctttatggcagcatccatagccactttgacaggtcagtgtcacttctgttcctgcccagttgtctgttgattaaaaagacctgcacatttttggtgggcttcttgcatttgaaggatttgcctgacttcttgatgttcagtgcaggctcactgggactggctttagggagttctttatccatgaagcagcagccccaaacaacctcagtaaaacagcacaaccaaggaagcctgaaaaagatgatgaattccatgtaatcaagtggatctggggacctcttccccactgccacacacccacacacactttgggccatcatctgatttgaaatgccaaccatatcatttattcaatctgtctcacacatggggctgtgtaggagcctgatgggacccgggacattaaggacacactgttgtatcaatctgatcatcacctgacacacacagacctgttagattgtactcaaagtgctagcttatagctcaagtgtcgacgtaattcttacattcgcattaattttaactcaattctatgttgctgttttgcagagctgccttcttttcacctctgagttttccctgtacttgggataggggctttcttctactgcattttgtgcagcaagttgagagagtaggtctctttggtaaatctatccataacaaaattcattattttacatctgtatttcttcattctacaacctacaggctgctataatttgtttcctcattccaaatctctttatgttactttagcttcaaataggatttgccttctttgaaaatcactggtgacgcaggtatggatcttactccaaacccttgtgtaagaaataaactggacattctcaggtgctacctagtttctgtttctaaggcccatccttctgagtttccatcctgggaacataatctcagttatttaaagattgtactcgcctctgataactgacccagtctcaccccaaaaagtgctgagtggtattatacttgaatctggcataatgccaaggctaggggtggatgccaactgtgttctctattttgacctcaagagagattaaaggacttgcccaagtgatagaaaggtgagattggaactgaaaaaagcctgtatctgaagcctgtgtttttacccactgctctatagtttctctgtatcagtttgaacaaatgactctcccataccttcccccccattaccaaacagggttgaggtttatcaggtagattagttaggttatggcacaaaaggatgctctatgatcttggtatatcagaatattttacctgtcagaccactcaggtttcttttgaagaaagacctggaccagagagtaaacagtgagaggaaacatgacttctttccttagcacactctctctttttccctgagtcccagggcctgattggttcagaaccaagtgaagtcacggttactatgattactcacgactgctctcagaacgtaatgccaacagtctgcaagattcaaatactgacaaccatcacctggcttccttctggttcagagcagaatagggtaagtggaagttgctgggagaggaagtaggtatatcttgtggctgggtgccatctacatgtctccttcctggatgggacattcagctatcctggcctcagagcttgtccctggcttgtgcaaaatcccttcattaaaatttatcctttgtgtagattacagcacccactgcatcttgccaggttccctgggtagtgatcagcgactttgtctgccatgttccaatcagggaattagtgttaggttgaatttcccatttgcttgtcaatctctgcatccagttttggtcatgactctgcaattactccctctataatacacagttcatgtaaatggagtgtttagttgcagaaatttaacactgcagttaaacactgctgtgtctcacacaactgtgtgaccccctcccaaagctcagagcagtggaactccacacttttattctgtggacctgggatgcaggtgggcttttaatgccttggaaaatcttatgctaaaactagactagtttgttgagacatatgcatatgtctcaagccatattccctttcaagtatctgatctagaataactacattgttaccattaaagtgtgacgcaggtgggtagtgtctatatgcaggacatggattttccaggctgtcagagggataacggtgaggacagggctttgtgatttttatagtggggttctcatgaggaactaaaatgactgttatgaggagatgtggcttgcctgcacactggctgcccactcaatcttatgtaagaactgaggaaattgaggttcctgtaaagcgacccaggtcacacactccctttcttgagtggcagggaaggaaggctcagtccttcaggttttttcctagcccccacagaaccatgtaaagaccctgaggctgtgttcagtgttctaaacaatttgcagtgggaagagaacttattggtattcagtattttattaacaaagaaagtggaaaactctttctcttaaggaactgacatcctagaaaaccatggcaatcacctaggaaataggccaggagaggttgattgatagatgttaaatgcataaaagcttttcatactaggccaggcacagtggctcacacctataatcccagctggattatagcctctggaaggctgaggtgggtggatcgcttgagcccaggagttcaagaccagtctgggtaacatacggagaccccatctctaaaataaaaataaatgaatacataaattaaaaatctgcatagtcttccttaaatagggaatatcatagaaataaaatgtcctatttacattggttgcaaatgttatgaaacacctagaaagatgaggacaaacacaaggaaaacacacatgcaactttttatgagcttccagtttgaatattcacataacattttaaaatactacattttttgaaaaggaagatcaatttttgcaatggcatcaattctcctctaaataaatcagtaaatccagtgcaatcccaatcataatttatagcacaattttgagtgtatgtgtaactggaagaacagatgcaattatactggaaaaaatgcgaaggattatgtaagagggggagcttgtcattctggactcaaaacttagtctgtagtattagcaaatgaaacaggaattgatagacatgttcatgggccaacaaagatattctagaaatacatttatgcatatgtgggactcaaagaaatgatatagctgacatttaaaatcacaaattgtcacaaagctttttataatcccgtgtgtgtgtgtgtgtgtgtgtgtgtgtgtgtgtgtgtgtgtgtgtgtatgtatctctgttgtcctgtcttcctgaagccatctgtggatctgtggagtcaagcagtcatggctcagggacactctgaagtcagtcccagcgcatctgcacagagcaccaggaggaaggcaaacaaatacttaagacccagtctggcctctaaatccatgctgagcattctgctcagcagacagcttgggaatcacagaaatgatgcgaatctgacagagttgctgtggacacagacgcaaaccataccagggtggaattggcctttgttaaaacactatgccattgacccatctctataccacagggagcgtagaaaatccaggaaaatggtgtggatcaataaatccttcccataatgcaactgttacaaatagaagctgttttctcactgcttttggttggatgtgccttttgttcacatggtttcttaacttctcacctgtctctgctacccgagaccacaacagatgaactctagctactcccctttgagagagtgtttactaacattgcagagtctgggggtgttggattcaagagaggccctgtttagagaaggtggaaggacggctgagtgggcacgtggagaagccctgcagccctaaatttctagagggaggtgactttaaaagcccacttagaggtcttggtttgtctcccttgaagtttgggggagggagtgggtagctgttataatcaaataaatttaaaatgagagtggcttgcagagtggggagggaattctcgcaagagatatacttcttcaattgagaaaaagagagagggagctaatgaggtaaccagaaattcctaggaaagaaagaatcgtcttttggctgttggtgcaaaataactttgagcctacaattctacttctagccagacattcaagtgtgagtgtaaattagcatacaaggtgttcaaatgtgggttccctaaaaatagaccctgaggcacacttatgagtagaaagtgcctatgtaggagggagtcccaggtagcactggtaggggtgttgtgagatttagaaggaatgcagccaattaagtggcaagaataatctagcaggttaccagtgtgggcaatttgagctaattcccagggggatcctatgggagactgtgtcgggcaatttgagctaattcccagggggatcctatgggagactgtgtcgaacccacacctgacattcatcccaagggtaggatgaaaagtcttgagggtatttagccaccaaataaccaaccatacttcttaaaggacttcccccaggggtgatataaatctctgtcacctccagttggccttgggtcaagtccagcatgctctaagggtgagacaaaaggcctccaaggcagagagtcatggcaattgccataagcaaccttgtagatgcaaaggtgagacatagctccgcagggccagagtctaaatatgtaagtcagtgtcagaatctttttggcactgtctattccttaaataagtcaatactcaccatttgtgaaaatcttcattgaactggagctacatttcctctctataggtagcatgttttaaatgttttatcaattatcaattttaattggaaactggttgtaggaactctgtcccagagagttgtgagatgcatggttagccgtcgaaggaacatttgcattgtagacatcaaaatcttccccctggggaaaagaaagcaggatttttgtagtgtgtcctgcttgcagatgtgccatgctgggtgttgggcacaggtctctccctgggatttcatggagatctttggctgcatttgtcagaaactctattcttaccattcaggctacaggggcccaagttgcagtgtctcacctcttgttgagaggttcctcagcacgtggaatacaaacctcctcctctccaggtctcccatagcagctggaactttattcatgttcctatcattatattctctatggaataggatgagttgctggttagcttgcttccacccacctatgcccatccaggcccacgctcagcacactgtccccatagtgggtgcccctatccccagggattcttggaaatgctgttctgggtggtgactccatttcagcactgacatagtcactggcagccagagatggccttctcaagcttatgttgggagtctagtaatgaatcctttttgttacagttcagatgggacttgcaatgcccagctccactggtgttgctgtttgtttttcttctatctccagtcttacaaatcagtgattattgatgaaatgctgagaagctacaacttctggctgctctctttgagcattatgttaggtgactggggcctcctgtttgttctgtttaaggagcccaactgcttgtcctctggattaactttaaaagagttgaattagaccaggcatagtgcctgtttacagcaatgcaggctataggggcttagaaagaggctatacttaagtatattcctgggaaacttctatacttgtatatccctgagtctacacacctaactgttgctggtgggcatctggggaccaaccattaatctgctccagcttcacagctggctagcccatcccttgtggggaaaagagagatcagattgttactgtgtctgtgtagaaagaagtagacataggagactccattttgttctgtattaagaaaaattcttctgccttgtgatgctgttaatctgtaaccttacccccaaacctgtgctccctgaaacatgtgctgtgtcaactcagggttaaatggattaagggctgtgcaagatgtgctttgttaaacaaatgcttgaaggcagcatgctccttaagagtcatcaccactccctaatctcaagtacccagggacacaaaacactgtggtaggccgcagggacctctgcctaggaaagccaggtattgtccaaggtttctccccatgtgatagtctgaaatatggcctcgtgggaagggaaagacctgaccgtcccccagcccgacacccatgaagggtctgtgctgaggaggattagtaaaagaggagggaacgcctctttgcagttgagacaagaggaaggcatctgtctcctgcctgtccctgggcaatggaatgtctcggtgtaaaacccgattgtatattccacctactgagataggggaaaaccgccttggggctggaggtgggacatgcgggcagcaatactgctctttaaggcattgagatgtttatgtgtatacatatctaaagcacagcacttaattctttaccttgtttatgatgcagagacctttgttcacgtgtttacctgctgaccttctctccactattatcctatgaccctgccacatcctcctccccgagaaacacccaataatgatgaataaatactaagggaactcagaggccggcgggatcctccgtgtgctgaacgctggtcccctgggccccttttttctttctctatactttgtctctgtgtctcttcttttccaagtctcttgttccacctaacaagaaacacccacaggtgtggaggggcaacccaccccttcactggctagcccatccctgacctatgcaaaactttgcaccacactatcacattatactccttcccttttgtgatttagatcacgactgactacggttactgttcaaatagagatcacaaggctaattgaatgcactctttgtggtaataagataccaaattataaacaaagcctaaggccatgccagtcaagggttaagtcccgctctgctacacttaaagaataaagtatgttctaattgccacagaacttttctttctctctagcagctaaacaagcactgccctagagataagcaatattgaaacaattgcagctcactcacttgctgacttactgacctccactcacctgttccacaagccataactacagcttttattggacaagagatggatttcaataactctctcctgataagagaccactgaacatgaactgattctggccagtttaaggctgcacactgaatgccttcatatccttgcttcacctttgatgtatagggcctaaatataatgtatttaaatgttaagtctctgccccaaagtgaacatgagatgcatgtaacatatgtgtttgcttaccacacatgcacatatccccgcttcatgaatagtcatagctcccagccactccagctccagccacgggtaaaatgggccaagttatagcttgagccattgcttcagagggtacaagccccaagccttgacagcttccacgtggtgttggacctgtgggtgtacagaagtcaagaattgaggtttgggaacctccacctaaatttcagaggatgtatggaaatacctggatatccaggcaaaagtctaattcaggagcagagccctcatggagaacctctgctagggcagtgcagaagggaaatgtggggttggagcccccatacagagtccccgctggggtactgcctagtggagctgtgagaagagggccaccatcctccagattccagaagggtagatccaccaacagcttgtaccgtgtgcctggaaaactgcaggcactcaaggccagccatgggagactacccctttcatcagcatgccctggatatgagacatggagttaaaggagattatttcagagctttaagatttaatgactactccaatgtgtttgggtcttgcatggggcctgtagtccctttgttttggccaatttctcccattaggaatggaagcatttatccaacgcctatatccccatggtatcttggaagtaatgcattttcttttgattttgtcttgtctcaggtgagactttggacttggacttttgagttaatgccggaatgaattaagactttgggggactattgggaaggcatgattgtgttttgaaatgtgaggacatgagatttcggaggggccaggagtggaatgatatggtttggctctgtgttcccacccaaatctcatcctgaattgtattccccacatgtcgagggagggacctgtaatccccatatgttgagtgagggaagcgattggatcatggagatggtttcccccatgctgttctcgtgatagtgagtgagttcttatgagatctgacagttttataaatggcagtttttcctgctttctcacttctctcttgccaccttgtgaataaggtgcctgcttccccttcacattctgtcatgatggtaagtttcctgaggcctccccagccatgtggaattgtgagtcaattaaacttctttcctttataaattacctagtctcaggtatttctttattgcagtgtgaaaacagactaatacgcctgttgaatatttatgcttggccaaccaagcatgcatatggttcagcataaagccctgcctcatccttccctccctcaaagcgcttgctttttgtttgcagccagaggctgcacttctctcctgcaggttgtcatcccctacttaagaaataaagttctcctttctaaatggataaattgtgtgatttttttttttttttttgagatggagtctcactctgtcgcccaggctggagtgcagtggtgcaatctcggctcactgcaacctccgcctcctgggttcaagtgatactcctgcctcagcctcccgagtagctgggactacaggcatgtgccaccacacccagctaattttttgtatttttagtagagatggggtttcaccacgttagccaggatgatctcaatctcctgaactcatgatccaccagcctcagcctcccaaagtgctaggattacaggcatgagccaccgcacgcagccaaattgtgtgatttttaagttgacacaatgaaggtccacttctgactttccccttttgcatagggtccatttggccctgagctgtcaatttccaagtgtgaatgctacctactttgtcccatcactttatgcctggaaaaaagtgcaggggcaaggacaaggggaagctttataacattcagttcatttccttcttctgcttctttgtataagaaagggccaacttttgatcattttttgttcagctgtgacattctgctgcaaaaagaagattgaacaccgaataccacattaatatggtattcctagatgacttatttgcagaaactgacctgtttatcctaaaattcatatggaaattcaagggacccagagtctaaaacaattttgaaaaaggagaacaaagatataagattcatattttgtaatttcaaaacttactacaaagcaacagtaatctagacagtgtggtatttgcataagactagacatttagatcaatagaatagaattgaaagttcagaaacaaagccatacaccttgagttaactgattttcaccaagggtgccaaaacaatttaatagggaaagaatagtctttcaacaaattatgctaggtcaactgaatatccatatgcaaaaaaaagaagttgtacctctatcttagatcatacacaaaaattaactcaaaatggatgaaagatctaaataaattaggggctaacattataaaacgtctaaaagaaaacacaggtgtaaatgtttgtgcccttggattaggtggctggtttttcagatgtgacataagaaactaaagaaaaaatagataaactggccattacaaaattaaaatcttttgtgcagcagaggacaccatcaagaatgttgaaagttaatccacagaatggaagaaaaatgtgcaaattatatgtctggcttgtgtctagaatatataaacaatgattacaactcaataataaaagacaaataacagttaaaaatgagcaaaggatctgaaaaaagtttctccaaagaaaatatacaaatgcctaataagcacatgaaaatatgctcaatatcattaattataagggaaatgcaaatcaaagcacaatgagatgtcaggatacactcactaagatggatataatttaaaaaggcatgtaataacaagtgttagcaagaatgtagagaaattagaaccctcacacagtactggggggaatgtaaaatggtgtagtccctttggaaaatagtctggcagctcctcaaatgtttaaacataaagttaacatatgatctagcaattacaccactacaaatgtatgtaaaataaataaaaatatatgtccacacaaaatttgtccacaaatgttcatagcagcattatacataatggtcaaaaattgaaaaaattcaaataccaattaactgatgaatggataaacaaaatgtcatatatccacacaatggtatattattcagcagtaaaaaagaatgaagtaatgacacatgttacaatatggatgaagcttgaaaccattatgcttaaggaaaaaagggagacacaaaagatcacatatcatatgattccatttatatgaaatatccaggacagggaaatgtatagagaagaaaaagtagatcagtggttgcctagggttggtgctgattgggaggtgggggatgacaggaaatgagaagttaaagctgcatggttcaatatttttttgcggggtgaggtaaatattctataattgattgccacattggttacacaactctttgagtatatttaaaaaacactgatatttagaatactttaaatgaatgaattatgtgatttgtgaattatatcataatttagctgtttaaaaaattctaattactagaaccagaaatcaaagtcatgtttaacaactcactattatgaggccttgattttgaaagctaccaattttagaattgaatctactctgaaactgttcagagtagattctacttgtttgattaatacttgttgcatctccttcggcatgaaatgaaacctttaaaattcagttgtaaaataaaaaaaaatcagtgaggttgtccaacctctgtctcacagcacatcatttaaatttagccatctgttgttgttcttcatcagtctctcctctttttttgaacaacttcctttgtaatcacaaatttgagagggggaaggtaacccttttcttcattctcatttatatcctatctttttctaagttggtttccagttttccatatttctcgaaaattgatctacatttttcctcctctaagctgctattggctgaatgtgtacacccaaaactcctaggtggaatctgtaatccccaatgtgatggtatttggaggtggggcctttggcaggtaatcaggtttagatggggtcattagtatggagcccccatgatgggattaatgcccttatggaaaaaaagaaaaaaagacatcagatctcagtctgtctctttgcatatacacacaatgaaaaggccttgtgaagacatgactaggaagaagacccttaccataaacccaacaacaatgctggcaccctgatgtcagacttccagtttccagaccatgagaaatgtttactggttaagccttcatcattttcagattcctttctgtaaagacgtcttaggtatttgctatagttgtttgttttactccatctcaactttgctcacttaaaaattacgcattcttggtttgtgggtttgactttggaaactctttttccttctttatcttgctcatcatgaccttattcaaaattacaatattctctttaagttgcttccacctataaagttgtttgcagctcaagatcacaccttgatttattgggtgaatcaaggttgaagtgtttaggggaaagaaaatgacttttatctgaccatcctcactggttagtgattcattgaaatgtaagcctggggattatacagaagtcacagtgccctgacttcctcttcattgagttataaaatgttatgttgaaaatgcctgacttgaagaatatagttttgaaagaaccattctgaagacgatgctctgatgaaccaaacatttttactaagtttatatatcatagataatgcactgtgtccttttacacacctttggggagcttcgattttgaatgatgattgactttaacttagtgtcatctgcatttatatatagaatcaaacaggtgctttttactttcctcctggacatgcagacatctctttggcttgtctgagtggtttttcacactggcttccaaaatatgtcagtttcatccccattgtaaaactaagctacacccagtttctcctgtttagattcacattggcaatttttgtccaaatggctcaacacttggtaaatactgaaaacttggagaatactgacaacccaagatattcagcttcttagaaagatgattctgtaaatatgaaataccttgcccagagaactatgctaagcactgcaggagataaagatggaagcaagatttctgtcctccagggaaagcataatgtagtagaaaaaggacaggatatgacaacaggatacctaaattcctggctaaaatctgccactggtaatctatgtgaccctgaacatgaagtagtaggtgaagtcatgtcatgtcataccatttcaaattatttatatgtcaaagagaagtataaatgggacctatctcaaaaggttaaaatctacctaacaagaataaaacaagataatggttggggagcacatgtctgataactagaatatggttttgaaaatgtaagggactgttgtttctgatctagcgagaggcttgaccaggatcaaattgccttttactcaaggaggcttttgataagtctagtgactacagctggagctctctctggctgggactcaggaaggcccagaacacagctctgcccacaagagtgctgaactggttctgactttgtgagccactcttccgtggcccctagacctttgaggtggcatctcttactgggtgaggctcctggtagaatgggctgccagccgccaggaagccagcaggaacaatctggatgcacaatacgtggcaaatcagggataggagaccttggcaccaggagtctgtaagctacatggctcccagggaagagccatttgaggggctcctctaggcttccagcagggctagagactcggtagcattaactctttcttgcatccaggacctaactggagcaggaggctggttcttctgggatggaaaggacccccgggacagttcctaacttggctaggctgagacttcgcaggtagagggagggggatagctgggcgtagctgtcacaaagccaccggaaatgcatctttcattttctggttgattccggttcaggtccacagaactcgaccctggaagagagagtcggggtcaggtcttcgggaggtggagggatcgaatgagggaactgatattccaagactccccacatcttggagcttcactcgccaggcatcccgcgctttcctgacgtcgcttcccctagtggtgcagcagcggagagctttgctacccagagcagcagggaggcgtggccacagaggcagaggcgtagtcgagccgaggaagaggaaagtggcctccggggaagccagagctgactgaaggtaaccgagaagctgattttctctttagattcgttttagcgatcccctgagaaataccggccgctcctgccagttgcagcctttggggctgctgcgtagcagggaatgagggtgggggatgtgatacagtatttttcagtgggcagtggcgccactgacaggcggcaggtcgcctggagagctggtgggagttgtccacagcgaggccgcctggccgcaggctcctacagccacttcttacctatggaagcaacttctttctaccggatgtacaaatataacccagggatactagtgaagcacactcaaaggttgcccacgttcagagttcttgtgggcatccctgtggttgatctataagttgtagtgaatcagggatggggatttggggcagtaatgtctaccaccacactcagcgaaacttcctgatttttgatggcttatgaacataacaccaaagaaagggtcatttcaacattaaagacaatggcttctgctgacaaaaaaatgtaagaagtgttcctgtacctcctgagcctgaatggtcagcaaggagccaaccatttttttgaatacctgtggcatccttgaaagaattttgttactgtttctgctggatcacctcagggaaaatcagttttgaggacatgttaagtcaggagaaaggttaccattactaagacccttcccatctataaagaaccttaatcatcaccatctctctttcttttttgtttttaaccacctgacatttgtatatatgtaaaggaagaccatctgtaaatttttccagttaaagtaaacaaaaaatttaatacgcaagtacaaacctgtgcagtgccctttataagtctttcgaagaagtactacaccctgccacatcaaatgttgatgatctgcttgcttagcgggagggcatttgcttactttttctctaattactttacttctactctgatcttgctgtctcagttctcctaccagcattgatacagtataaaagggaatattaagagttccatttagtaaaaggcttcaatctaaatgagatgaagggatatagaaactgtttttcctctgactaaagaaaaatgattgggatgatctgttaaagtttcgagaaactcaaataggccctatttgccaatataggacaggaaacccacagattaagtattggataatctcaaagctccttttggccaattggtgccagttttctcacccaccaatctttcctcaactgttaaaaaaaaaaacaggaaatacattgattgacatttgtcttctcttagctgtgctttgtttcaaagttgaaaaacaaagaaaaggagagaaacttacctcctgagtaatctaatcatgaatgttctaattcttggcagttgattttaaagaagaagccagacaggaacttttctcttcattttcctctaacaataaatagcaagtaaatatgtgtcatgtgattttcttcttgacatgtacttttcttctgctctccctcagtgctcttgggaagaacaattcattgatttggtaccaacctgatgcaccctgatttgtcaaaggtggtaccaggtgggtgtcagtgtcacatacaagagtaaaactgttcctagagcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgaggtaagaagaaagattgcctacatgtacaatgaagtaggataaaagtggatatatcagaatggaggagttatcagagaattagacagattaagtcgctcttctgttgctcctttaggacagctagcaaggatctgaaatgacatacatgcatcaatagtccacaggtttcaagatttctggcagagcctttccttgtcttagagaaaataaatgcattttgtcttctctagggccagggtgaattgatggtggtgggcctagtctggcatgggcaaggacaagagttgagttcttagaaaaagagaaataaagggcaagaaagagttgggaaaggggagaagatccacaagatgggcagcacttacagagaccaaaggagagagaggttagcaaacagaagtatgaatcaagcggctctggggagactgcaaagaaagagaacaaaatggaaagaaaaaaaggaaacaaggatatggaaagacgacaattgccaacagagaagtggagggaatcaggatgctaaggggtagtatcttctatagcagaaacacacatctctgggctgggaggaaagagcctccattgccctcacttagtggcttgtcattggcccttctggtgagtgggaaaccaaggtttgtccttggaagatggcagcacactttcttttttcaggagcctaccttgaaaaatccagggcaggccatatttttggtgtcttattactaccaaatcatgtgaagagagattagagcccaactcttctccccatttattcttccatccatctccattccctgtgaaattctttcctggaggattggaaactggctaacaggaaagtttatttcactcaattccttttcttttacagaaaaccaaaagataaaaattcactaaaacaaggatccaagtcaagaaagtaaaccagtgaaagttccccagcaggggaacaggctgcctacccaactctgctagtggcttgagccagggctctgtgcatctgggtgggggccactgggttggggggcggggatctgcagtagtcacagctttttctattttatcctaattatcccagattttgagtatagttctttatgagaacatagtggcacaatacctcttcattctttttattacttctctaatgtcatgcattccccaaatctgggctctgctcttgttcctccctccactaccaccccaaaaccaaaagtaagttctgtgctaatgaggatggggattatttctaggtcacagcccatgagctgggaaaggaggcagtgctcttgggaggaacagcagtggccccaggcttcaagtggaagccagcagagccccaaccaatgggtgtgttccagaaagaatattggaatacataccgggtactacaagaacagctgggctggaacactcacaaagaaacccagcctgtatatgaaagaggtgaggagcttcatcataattgtcttctcctgggagctgtggtagtaattagttcacctagaatgtcctgggaattttccaggtggccagccatgctagcagctatgatgtctcccaggtgggagtacagtgggttgatggtggttgaaggtgggggtcagcctgggggacagaaatatccaaaccacagaaccctgctattcacactatagactctactcctttgaaacttgagaggagagaagaagatggaacagggacaggtggggccacctccctctcataagttgtaggaaaaattggggacagacatgggctatcagtggcagaatgtgataaaaattgtgcactaggaaaaagtaataaaagacaaaagtctcccacattacctactgtacactggaggacctgagcctttcatttccaaaccttcaattcttgcccagcttatggtatgagaggaaaaatgaatagatttcctttgattaatttcttttatgaaatctaaagagttcatgaactggggaactggttgtatgagtggtagatatttggttcttatttacaatgagatggccacttcttggcaccacacacacacttgtcaatgtgacccatctttactgaaggcatcctgatgttctttattttagaaatcagcttgggatgtttgtaaataggaaacagaaattttccctggctattttctacccacagctgtgcatgatcaacagatgttagccctttctgagcagaaaagaatcaaacactggaagatggcatctaaactcatcctgcctgagtccctggtgagctgttatttctggcttttttcaggtgacttgactgtggccttgcctctgcttgtccctattgcctaggactcatagtgtccagcaggtgctttgaggcattttagccccagttattctctaggcaactaggcttggcacagtgggaactgggcacctcccaggtgatttactgatcctctttgctccttcctttctgccttctcacttttttcccctaaatcttgtactgttcacatcttcagcacctggcctaccatgtaattcagaaatgggtggtaggacagcttctgaagtggcaagtactaaactatagcccattctcttctttagagtttgttgacatttgaagatgtggctgtgtatttttctgaggaagagtggcaattattgaatcctcttgagaagactctctacaatgatgtaatgcaggatatctatgagactgtcatctctctaggtaaagattcttccttcccattgtgtagaagttaagtaatatattatgtcctctgtttatggaaaatgcacccctgtgagagagtcccactgttccaacagctgattgattctcaacttgatgatgtatgggaaataaagggattatcaggatcccctggagagctttttgtaaatacctgtctcacttctgcattctaaatggaattattttgactgtgaaagattttactttttttatctttcatccaaacacacccttctctaaaaaacataaaagcatgcacatcaatggcattattccacagaaaaattaataactaatctgtaaatcaacaacaataacaatgcaaacaaaagtttaaatgatatgtggaaagatttacaggtaggcatatggctcttagtttagaaaataataattcaagtcaatatcaataaaagttaaggaaaagtttctaatttccaaacatttttatacaatttttttccaactacaatattttatagatcttttgtgagaagaatattagcgtaatcctaagaaagataacattcaagtgatcctatgcaggtcaggttgccttgttaaaatgagttagaattcacataattccaatagtattattgcctcttgaaatttaaatgtagagcatatccatcatattcaaaatgagttccacaacttacatttattttgatctagttggaaataaaccctaaatttaggaatggtaaaaaaatatatttaacaaagacatgggattgatctaaattttacttcacaggtaagagaaaattacaattcagtatgaggacacttcataagttttaccaatgcccccatttataattaggccaactgtatcttgagtgtatatgaatgtttgaataaatacatactaacatatacaaaccaattcacaccacacgactcttcaaagatgttgcttgaaatggcttattctctggtttgggataagcggtgtaacacagtcacttaattttctcttaatcattttttcccttttgtttatcatgattcacttagtatgtttcatgtgggtcattgatatatttttgcaacaaaaatccagtagcagtaagcagaaatgttaacttaaaggactactaggcaatcaaagtttaaattatcacatgaaaatagagcagatcacacgtaaaggtcttctgccatgggatatattgttccatgactgaaaattgtgatgtggttcctagaacatagctcttgctctaaggtgatacatattaatgtgtagctccagtccttacaaattaagtctgtattttactggtttgagaaggtgaatttctgtgtgtgtgtgtgtgtgtgtgtgtgtgtgtgtgtgtgtctgtgtgtgtgtgtgtcagagtctcactctgtcacccaggctggagtgcagtggtgcaatcttggctcactgcaaccttcacctcccaggctcaagcaattttcctgcctcagcatcccgagtagctgggactacaggtgtgtggcaccatgtctggctaatttttgtatttttgttggagacatggtttcaccatgttggctaggctggtctcaaactcctgacttcaagtgatcccctgccttggcctcccaaagtgctgagattacaggcatgagccaccacgcctggcctgagaaggtgaatttcttgccacaaacaaatgcaaaatgcctctgcaatagcgggtgaagcccactcccaagggcttaaagagttcaactttgaaatagggcagcatgggctgcctctgcatttcttcatagcaagtctatatgcaagccactgagcagcaccactgatgggaatccaaaggaaaacggctatagcacggtgaaaatccaccatggtaacataaagtgatttctcaattaaatattttgctatatcaaagagaagtaggcaaaggcacatggtagtaaatctagtcagaatgtctgcaggtccccattacctcaaatatcagtgaactcagggaccaaccaaggtttacactgattattttgatatatataaaaaacaaaacaaaacagaaaaccttaacgttttcaagcatttatggcacagacatagggaagtacaaatatcgtagcttatatcttcaaaaagctgggcaatttaaagtgctgctacagtgaatcagagtcacaattttaacttcattcttatatttgatacatttttgtgtgtagagtacagggtgtgcaaattaagcaatttcaataaatattagaaaagtcaattattttgcaaatataaagtgagtgaaatcagctaataatgcaatacaataagacttgtgttaaacagagctttttccccatgaatactttttactctttcctttgaacatctcgatacttaaatacatttccttttattggcttgcagaaattaagcaaaaagtgaactattacctagctacaagatactaaatagtataagagtttggagctgtccagttgtaataaatagaaaataacaaatatagtgaaatatgctgcaagttaatgctcaaaaatgcagccttctgagttacaaagtacacaatcctactagtcttctgaagttgtcattagttcatggaaaatgtaaaaaagagcagaaactccatttagcttttacctttccagcagctccagtgctaaagttatagaatcatgtatgtttgcccaagaccaactgcacattggcgctagtcacatattctattttatccagagttcaatcaacaagtctttatttgcacttctttttacattcaggaaacaataagcctacccaggcagccttctgttgatagttgccttcttctgttgggtgtggggatataagccaccctgctatgttattttttttttctggggtcctaaaccagtttgtctttttcttaccatttttagaattttctttttgttatctcatatcacttaatgggtttgtttttgtgcctatcagggaggatcaaggagaaatgggtctatgccattttgtccagactggaccagaaatcacttgttcctgtatttcttttaaagcaatcatcattgacttttctctccatttatgtagctttctttcactgggacacagatggctgattattctgtttattctaacagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatcactcagaaatggccaatgtttgcttttttgaaatggatgtcttcagatattttttccaccaagagaccgttctaagcctgtttccaaatttataaaatgaggattataattcctacttcttagggctactgtgaggattaaatgcacacatgtgagcatgtctgacacaatgattggccacatttggtgtttcctaaacatttggaactttcttcattcttccttcacctagttatttagaaaagaaaataagctttgtctacttgcccagcttttaagcattcttcattaatgagttttccatcatttctagctggtttttaggcccactaatgatggtcagaatggtagccttctggcatgacattcatttggttctagaggtgctcctctctagtcagcctgaaacaatacactgatgtcccaattcagctagctatactgctcatgagtaacaaaaccaaaatatactacaaaccctcaacttgagattcctgaaaatggaggggaggtgatggctaggggtggaatttttgtggacagtatttatgctactaggtgcatcctcaagccaataaagtagaaatgaaagaggaaagaggtgactgcacataatggcgactaaaaagaatgaaagtgctaagccaaaaggaggaagtgacctgggaggaaaggatctcatattcccaaaggcttggagactatgactgcctcaccacccctcctcctagaatgatctgagattgtgcccttgaaactaaaatgggaaattcaaattcctgcaggggactccattctctttgtgtgaatccatgtttgctagcatcctggatagctgctatcataccaccattcaaataaatttattcatgtagcttttataaagaagggaggttaactaaaaaattcaaggatgtactaggtcaatggacccagcagttatactcatgagaatcagcaaagtcccccagaacaagtcagcaaaagagcactccactttcctaaagctgcttacccctgttataatacctgttaccttcaaagcttatcgtgcaggtcctcatctacactggcatcattatcagcagggtttgagagcagggaacatgggttctatttgagagattaattatttaaggcaagtggcaggaagtgactgcctttagatgggtctgagcagaaacagagaactgggatttgttattccaagttcagatactccaccatcatttgaatacaagggccccaggaaaaagcacattctcatccctgaggttgtggaacaggatctagaaatcagtgctcctggctgactcattagtgcccagtctgcccttcagccctctgacacagtctcctagggccacattccccgtgcatcctgactactcatgtcatcccttgccaactcagaaaaagaggagaaatgtatgtccatggagatatgggaagtaaggaaataaatggcagaatgagataaagggaagagatgtcattctattgcataactgcccaccaccttctcagtacatggctaatagacatgagctccattgcctttctgaggacacaagagaaaggcagcatacaaaagctcaggaactggagaaatggacagattattcattcatgggacagagtgaagaggcagaatgctccaattcttgatcccacagacagagatggaactgaagaactgaaccaagtgtgagggggtatgaactcgttttccagtctctgtgctcccagagaagatgagctgagcagagaaagataagaaagggtctaggagagcagagtttagcaggctttttccacttgtgtgcatttgtgaggactgagattggaagtcagggactcagggagccgaatgccattgcttgctgtggatgagacacaagagcatgtgagtgggtcaagcctaccctgtgccagactcaggtctccaccttttccctcccagcaaacaatgacatggtttctacccatgggcctttttgggttccttctagctccttctccactcccaagaaacctcttcctcctttattgccttgttctgtctgccacaggccaatcctgctcctgccactttgccacttccattctttcagggaaggagaggaggaggggcccaaagacagggtgtagtgagtgttattgtgttccactattcccagaggaatgggcacaataactgagagtggaaaggcagagttggggagagaagaataaacaaaacggaatcatggcctagtcttctgtcaagtaatttaaaggctctccttgctacttcccctttaatccttgaaaaacactaaatggcaggtaggtgggcatggtgatgaccatgttggggaggaagctgttcctcatttaaaggagggggctacctacaaacttctgttcttagctcaacagcaaagccctcccattctcattcttgttttctttgccttcctcttctccctccatgctccctgatccttcctaccattgtgggttcatgcatgagacactggtagagaagaagggacaggaagccagggaaactctcaaggaccatcaatcatgagatataaagggagaggtcaggagccatgtttgagagcagtagagggataatatcactcttagatctggacaacccagggaaagaagagagggaaggaggccaggtcagctttgagaagcagttctgctccagggctgggagttagggaggaagtagggaggaggacctatgcaatgccaagaaagatttcccttgtccctctttaggctctgtgtatctcagtgtgagacttgggatgattagttgaccataaatgtatgattttggtggctggtaagatggccaaataggaacagctctggtctgcagcttccagtgagatcaatgcagaaggtgggtgatttctgcatttccaactgaggtacccagctcatctcattgggactggttagacagtgggtgcagctcatggagggtgagcagaagcaaggtggggttcaccttacccgggaagtacaaggggttgggagaactccctcccctagccacgggaagccctgagggactgtgccctgagggatggtgcattccagcccagatactacacttttcccatggtattcacaacccacagaccaggggattccctcaggtgcctatgccaccagggccctgggtttcaaccacaaaactgggcagctatttgggcagacactgagctagctgcaggagtttttgtcataacccagtggcacctggagaaccagcaagacagaacttttcactccctggaaagggggctgaagccagggagccaagtggactagctcattggatccaaccccacggagcccagcaagctaagatccacgggtttgaaattctcgctgccagcacagcagtctgaagtcgacctggtacgctcgagcttgatggggggaggggcatccaccattactgaggcttgagtaggtggttttctcctcacagtataaacaaagccaccaggaagttcaaactcggcagagcccaccacagctcaacaaagctacgctagccaaactgcctctctagattcctcctctctgggcagggcatctctgaaagaaaggcagcagccccagtcaggggcttatagataaaactcccaactccctgggacagagcacctgggggaagaggtggctgtgggcacagcttcagcagccttaagcgttcctgcctacagtctctgaagagagcaacggatctcacagcacagtgctcgagccctgctaagggacagactgcctcctcaagtgggtccctgatccccatgcctcatgactgggagacatctcccagcaggggtcaacagacacctcataaaggagagctccagctggcatctggcaggtgcccctctgggacaaagcttctagaggaaggaagaggcagcagtctttgctgttctgcagcctctgctggtgatacacaggcaaacagggtctggattggacctccagcaaactccagcagacctgaagcagaagggcctgactgttagaaggaaaactaacaaacagaaaggaatagtatcaacatcaacaaaaaggacgtccacacaaaaaccccatctgaagatcaccaacatcaaagaccaaaggtagataaatccatgaagatgaggaaaaaacagcacaaaaaggctgaaaattccaaaaaccgtaatgcctcttttcctcaaaaggaccacaactcctcgccagcaagagaacaaaactggacggagaatgagtttgacaaattgacagcagtaggcttcagaaggtgggtaacaacaaactcctctgagctaaaggagcatgttctaacccaatgcaaggaagctaagaacgttgaaaaaaggtgagagaaattgcaaactagaataatcagtttagagcagaacacaaatgacctgaaggagctgaaaaacacagcacgagaacttcatgaagcatacacaagtatcaatagctaaatcgatcaagcagaagaaaggatatcagagattgaagatcattttaatgaaataaagcatgaagacaagattagagaaaaaagaatgaaaaggaacaaagcctccaagaaatatgggactatgtgaaaagaccaaacctacatttcactggtgtacctgaaagtgacaaggagaatggaaccaagttggaaaacactcttcaggatattatccaggagaacttccccaaccttgcaagacaggccaacattcaaattcaggaaatacagagaaaaccacaaagatattccatgagaagagcaacccaaagacacataattgtcagattcaccaaagttgaaatgaaggaaaaaatgttaagggcagccagagagaaaggtcggactacccacaaagggaagcccatcagactaacagcggatctcttggcagaaaccctacaagccagaagagagtgggggccaatattcaacattcttaaaggaaagaattttcaacccagaagttcatatccagacaaactaagcttaataagcaaaggagaaataaaatcctttacagacaagcaaatgctgagagattttgtcaccaccaggcctacctcacaagagttcctgaaggaagcattaaatatggaaaggaaaaaccggtaccagccactgcaaaaacatacaaaattgtaaagaccatcgacactatgaagaaactgcatcaagtaatgggcaaaataaccagctggcatcataatgacaggatcaaattcacacataaaaatattaaccttaaatgtaaatgggctaaatgtcccaattaaaagacagagagtggcaaattggataaagagtcaagatccatcactgtactgtattcaggagacccatctcacgtgcaaagacacacataggctcaagataaagggatggagaaatatttaccaagtaaatggaaacaaacaaacaaacagaaagggttgcaatcctagtctctgataaaacagactttaaaccaagaaagatcaaaaaagacaaagaagggcgttacatgatggtaaagggatcaatgcaacaagaagagataactatcctaaacatatatgcacccaatacaggaggacccagattcataaagcaagttcttagagacttacaaagagatgtagactcccacacaataatattgggagactttaacaccccactgtcaatattagacagatcaccaagacagaaaattaacaagcatattcaggacttgaactcagctctggaccaagcagacctaatagacatctacagaactctccacctcaaataaacagaatatacattcttctcaacaccacatcccacttattctaaaattgacgacacaattggaagtaaaatactcctcagtaaacgcgaaataatggaaatcataacagtctctcagaccacagtgcaatcaaattagaactcaggattaagaaactcactcaaaacctcacaactacatggaaattgaacaacctgctcctgaatgactagtgagtaaataacaaaattaaggtagaaataaataagttctttgaaaccaatgagaacaaagatacaatgtaccagaatctctgggacacagctaaagcagtgtttagagggaaatttatagcactaaatacccacaggagaaagcaggaaagatcaaaaattgacaccctaacatcacaattaaaagaactagagaagcaagagcaaacaaattcaacagctagcagaagacaagaaataactaagatcagagccaaactgaaggagatagagacatgaaaaacccttcaaaaaatcaatgaatccaggagctgtttttttgaaaagattaacaaaatagatagactgctagccagactgataaagaagaagagagaaaaatcaaatagacacaataaaaaatgataaaggggatatcaccactgatcccacagaaatacaaactaccatcagagaatactataaatacctctatggaaataaacaacaaaatctagaagaaatggataaattgctggacacatacaccctcccaagactacacaaggcagaagtcgaatccctgaatagaccaataacaagttctgaaatttaggcagtaattaatagcctaccaaccaaaaaagcccaggaccagacagattcacagccgaattctaccagaggtacaaataagagctggtacccttccttctgaaactattccaaacaatagaaaaagagggactcctccctaactcattttatgaggtcagcatcatcctgataccaaaacctgagacacacacacacacaaaagaaaatttcaggccaatatccctgataaacatcaatgaaaaaatcctcaataaaatactggcaaaccgaatccagcagcacatcaaaaagcttatccaccaccttcaagtcagcttcatccctgggatgcaaggctggttcaacatatgcaaaccaataaacataatccatcacttaaacagtacaaatgacaaaaaccacatgattatctcaatagatgcagaaaaggccttcaataaaattcaacactcctttgtgctaaaaagtctcaataaacttaagtattgatggaacatatctcaaaataataagggctatttatgacaaacccacagccaatatcatactgaatgggcaaaagctgggagcattccctttgaaaaccaccaaaagacaaggatgccctctctcaccactcctattcaacatagtattggaagttctggccacggcaatcatgcaagagaaagaaataaagggtattcaaatagaaagagaggaagtcaaattgtctctgtttgcagatgatatgattgtatattttaaaaaccccatcctctcagcccaaaatctccttaagctgataagcaacttcagcaaagtctcaggatacaaaatcaatgtgcaaaaatcacaagcattcctatacaccaataatagacagatgagccaaatcacgagtgaactcccattcacaattgctacaaagagaataaaatacctaggaatccaacttacaagggatgtgaaggacctcttcaaggagaactagaaaccactggtcaaggaaataagagaggacacaaacaaatggaaaatcattccatgctcatggataggaagaatcaatattgtgaaaatggccatactgcccaaagtaatttatagattcagtgctatcctcatcaagctaccattgactttcttcacagaattagaaaaaaaactactttaaattttataagaaaccaaaaaaagagcccgtttagccaaacaatcctaagcaaaaagaacaaagctggaggcatcatgctacatgacttcaaactatactacaaggctacagtaaccaaaacagcatggtactggtaccaaaacagatatatagaccaatgtaacagaacagaggcctcagaaataacaccacacatctacaaccatctgatcattgacaaacatgacaacaacaagcaatggggaaaggattccttatttaataaatggtgttgggaaaactggctagccacatgcagaaaactgaaactggatcccttccttacaccttatacaaaaattaactcaagatggattaaagacttaaatgtaagacctaaaaccataaataccccagaggaaaacctaggcaatatgattcaggacataggcatgggcaaatacttcatggctaaaatgccaaaagcaatggcaacaaaagccaaaattgacaaatgtgatctaattaaactaaagagcttctgcacagcaaaagaaactatcatcagagtgaaccggcatcctatagaatgggagaaaatttttacaatctatccgtctgataaggggctaatatacagaatctacaatgtacttaaacaaatttacaagaaaaaaagaaaacctcatcaaaaagtgggtgaaggatatgaacagacacttctcaaaagaagacatttatgcggccaacaaactattaaaaaaaagttcatcatcactggtcattagagaaatgcaaatcaaaaccaccatgagatatctcacacaagttagaatggcagccattaaaaagacaggaaacaacagatgttggagaggatatggagaaataggaatgcttttacactgttggtgggagtgtaaattagttcaaccattgtggaagacagtgtggtgattcctcaaggatctagaaccagaaataccatttgacccagcaatcgcattactgggtatatacctgaaggattataaatcattctactataaagacacatgcacaagtatgtttattgcagcactgttcacaatagcaaagacttggaaccaacccaaatgctatcattgttagactggataaagaaaaagtgacacatatacaccacggaatactatgcagtcataaaaaaggatgagttcatgtcctttgcagagacatggatgaagctggaaaccatcattctcagcaaactaacacaggaacagaaaaccaaacactgcatgttctcactcataagtgggagttgaacaatgagaatacatggacataggagtggggggaacatcgcacactggggcctgtctgggggtgggggcctaggggagggatagcattaggagaagtacctaatgtagatgatgggttgatgggtgcagccaaccaccatggcacgtgtatacctatgtaacaaacctgcacatagtgcacatgtatcccagaacttaaagtataatttaaaaaagaaagaaatataactaatcatatgatccaacagtcccactactgggtatttgttcaaaggaaatgaaatcaatatgtcgaagtgcagcttatatttgctgctgcactattctcaatagccatgatatgaaatcaacctaagtgttcatgagtagatgaataaagaaaatgtggtatataaaaaaagtatgattttatttctgggctctcaattttgttctatttgtctatatgcctacccttatgccagtacaacactgtttttaattattataggtttgcagtaatttcaaaataaggaagtgggagtcctccaatattgttcctctttttcaagattgttttgggtattggatgtgtcttgtaattccattcatttaaccaatttgcacagagagagagagaagccagagtctgaatggtaagaaatttttacccttttgctgtcttgccagatttttgggttccctctccctgagcagccctagtgaccctgcttgactgtatgcaaaccattgccatggattaagaatattttcaaagagcttacaaatttttgagaaatcaggcagagagagaaatatgactcaaattctgtttacgaaagtatactcaacacatttaaagtatcaggaagcctaaaatcccaaaagttagtgtaaggttaaaaagctggtgtgttctatcaattcctgtggtcccaacaaagttagcctaggaatttcagataaatggaacaaaagatgacttgctagaaatgcataggaaacaaaatatcgattcacagaaccaaatgaaagccttccactagaaactaataaatatattatatatacatatgtaaaatatatatatagttttatatgtgcatacacaagcaacgccagaggaaaataaacagcaaatgaataaaaattagaaacaaaaacaaataaacaggaaaccagccctaaattttttctactcaatctaccttggaggctacagtcttatgcagggacccaaaaaaaccacacaatgaatgttttattcctgatagacaaaataataactttaagttcaccaatatcatcatacatcctgtgcaatcaagagatttactctaggcaaacaaccaataagtactccagtgccagcactatacatgcaaaacagtaaacatagtgtgaagcaattgaaagcatgcatgtgataaatttggctccacactaaatccagcttcatgcttaactatagtttaaaaatttgccaaactgctgatgcctttctttacaatacttattttgcattaatcaagactaagagctttaactatgaaaatgttaattcgccaattctctttcaggttttaaagaatattttattatcttaactttttctacatcttttccccctatttactggttccttactacattgtttcatggctaaccttttcaaatctgtaatttgaactaacttttaggtaacttatgaattagacaaaattacttttttctcactattagcacaacactttctggcacattttgtaagcagaattatgtgttacctagagttcttatccttggtaacctaaaactgtagtgaaaccctaaaaagcaagaaaccccaaactgtcagatatgggcatttatagataagaacaatacatgattttagaaacatatttcaccatatcacagccctttctttattggaaatgacccagatattaagtgagcatcaaaaataattttaagtttttaatttacacgtttgcctaaaatatttatcccattcactgtacacaattctttcacttttaacagtttatctagattacttctgtatactgagatattagacactatcttttaaagttagctatttccttgttaaccatacttttaataaacagcgagcatcatttaggtgctcatgtaaacctaagtaagagcctcaaagttaaatacatgggtatttttgtcaataactcagaggatttagctaacattaaattactctcatttttcataaaaaaaggcatgctaaccaagaacattttgctttggctgggtttatagttttattaccttctatgccaaaccctgacacctcaaaatatctagcagagacaaatataaaatccagacaaaaatgtatgctgacaattctgaaggcatttccatttttattttaccaataattttaaaaccagcatgtttagtaaagttacacttaagtcatgtgaacttgaaaattgcgtagacttagttacttaatttctgagtgctcttttacttacaagacaatttggtggacacaacatatagctataagtgtacatacaaataaacatatcaaggcatgcatatacacacacaaagaaagattcaatagcttttaccttggaaccctagccacgagatagcaatacaagctcactggttttactttgtttgcctcaataggtaatccaatgaaggctgtgaaccaaaattttgggtaaagcagtttccatggcagtttgatttttaaaggccaaccttcttcagactccaaagaacactggcaccaaacagcaccaaaggagaacatcacatactaattaggcctgaccctgtttagaagagcagcaccaaagcctggatacatgcaattccattccattttcccattcaacagcaaactccagattccaaacagtatgggggccaaacagtattgcaactgcaagagaaaattctaaggagggcttagtattatgccccagagcctttgcccaggggatccctcttggagaggttgaggtccagaagatcccctggggcattccttttttggggtccactcttagagtgtcagacttctttgaccttaggtgggcactggtgctgctttgcatgtcttccctccagaggcaatggcctactattagctttcctttggttcctgtgtgtaatccctgacttttagcatccttatgatttgataaggccatgctttcccatgctttctgttccactagagtgataaccatgaactgtaataataggaactggaggctcggtgggcttcttttgtcctaagtcagttaagtaggattagggaagaatttagcataagaaaagaaggtttaggttacctgaaacatgtgtgagttcgccctgagctgcgagtttgccctgagctgttccacaattagggatcagagaccacaaccaaaaaagatagaaaagactccttcagagtggccccagccagaacccggcagttgcctccatgtttaggcgctgcccatcaagagtcctgagttggaaaggaaaagagagagagagggagatattcccctgtatggagcagaaaggaaaaggtgaaaaataaatcccaaactttaggcttacctcctggctggctcaccaaagtatgttataatggagggtgtccaggttcttggcatcttgaatgaagaattggacggaacacacaaacaaaccaaggaaagaatgaagcatcaaaagcagagatgtattgaaaatgaaagtacactccacagggtgggagtgggcctgaggataggggctcaagagccagattacaacattttctggggtttaaataccttctagaggttcccattggttacttggtatacaccctacataaatgaagagaataaagtaaagttacaaagtcatttactaggtgtacgccctatgtaaatggagaggatatttcctgtcatagctgaagtgtttccatttgatgtagttctaggaagtcagcgtgaattggccttatgttctcttcctccagactctattctcctgcctcacttctctagtgcttttactacctttacctgcagttctttccccaaatttattgtgttctgcacttttaatttttaagtaaatctaatttacacttgaggcattttcatcccgcaactgagataagcctaaaatgctgttctgggttactgttcagtctctgctttgtatatttgaaagtaatgagaacacaactaataaaactcaaatgacttcgacacacagtgttttcccccactaaaaacatggttgcatacagttgaaattatgaaagctaaatattcttgtccttgaaactcctctactgactctgttagagtaggcagatagctggatatgagcaggagggggagaccctgagataaaaaggagatctggaaaatctcacaccccagagaccagcagaaaccgacatgctagatatgagcagagaagaggggtaatacctatgcaggaagtaatgccccttaagacacccagtaatcactcactatgcagttagcaggtcagaatgtggctagttacatgctggtaagaagagaaagagggcaaaggagaaattcttaagagatatgcagatgccataagtacagatttagttttatacaacattctggatgtggtggtaataagcaatgcagccattcagcttgttcccatgtcagccagatcagctgcactttctctggtcctcaaccaaatgagattcagttctctgccagactgaagcgattaaaaacaaaacaacaacaaaaaacaatcatgtctttccataggaacaagaaggtaggcatgccatcaccatgtgagtaaaaagtgtacctcccataggacttactggttcactttgctcctaagtgcaacccagttgtggtcttctgtgttgtgctatgtcctcctcccagggtggtgagtatatgagaccaacaaactgctgccaatctgatctcttcagtgatgggtaatatgtgttcagccatctggagttatttagagtatggaatccttccttcaacaatggggtgaataggaggtgaccagaacatgctgtgactcccattttgtctttcgtgaaagaatgctgagatcattatatccagcattcatctttgcagagtcactggctttgcaagacattaatagaagtcacttctggttcaggagactaggaagagagggcattggcttactttcattcatttctagaaatctgcaaatgagaggcactattttaatacctccttaatatttatcaaacacccattatgtgtctagcatgcattcatcatgaatggctttttaaatttcccacaaaagagtacacatatattcacgacatagatttgccttcatccatattagtcatgctatgagagccacaattcttggacttacaaacaagctccctaataccgttgtttcttcaaaacattactttgtccagtaactctttttatggcaactgaagatggtacatgagctcaggtctgtgaaatctaccagtcttaccatgacccagaaacacctggcctcatacagtgctagagcggcctggtgaaaactcagttgtagcattatagaggaaacagaagcctgcaaggttgaagggctgttctataggatataactcaagttctgtactcacaagcaacctatggagccattctgcaaagccaggatgggatagagagtgacctctcccactcttatatccaaaaaatgattcacagattttctcttttccttctccccaaaataggaattggatggtttggaggttaaaatattcgaggcaagatgcctctcccatggaacatattcacggttccattatcttggaaaccgacactgactccttgtcccctgcccattttcaggtctttgggtaacaagagtgggagttgagaaggggtcactgtcctgaatgggtgagggatccagatgaccatggggagtttggcttgttgcttcctaatgtggggaagagaactagttctggacccaaagggatttagtatggcaccacctagcactcccatgtccagctgtaatattccatgaaaaactgatgcaattccataatggtatcacttccaaggattcctatctttcagcaacaaattcttaggttatttcaccgggtacacatccaccaacatttccaggtgctggcagagtataaggaaatggttttacagggagggaggtaagataaatattttttatttttatttttaatttttgtgggtacataatatatatgtatataggtatgtataaatatgtgtatatatatatatatatatatatatatgagatattttggtagaggcctgcaatgtataataattacatcatgaacaattgggtatccatctcctcaagaatttattctttgtgttataaacaatccagttatactattttagttattttaaaatgtacaattaaattattatcaactatgatccccctgttgtgctatcaaatactaggtcttatttagctttctatttttttttgtacccattaaccatccccacctccctcactgctccctcactgtatttcctagcctctggcaaccatccttctattctctatatccatgagttcaattgttttgatttttagaccatatacataaatgagaacatgtgatgttcatctttttgtgcctggcttactttgcttaacataatgacctccgcttttatccaggttgttgcaaatgaaagaatctcattctttttatgactgaatagtaatccattgtgtttatgtaccacattttctttatccattcttctgttgatggacacttaggttgcttccaaatcttagttattgtgaccagtgcggcaataaacatgggagtgccgatatctctttgatatactaattttatttgctgtatatactcagcagtggaattgttggatcctgtggtagctctatttttagtattttgagtatccttcaaactgtgttctatggcagtcgtagtaatttatattaccaccaaagatgtagaagtgttccctcttctccagatcttcaccagcatttgttattgcctcacttctggaaaaataacacgttagctgtggtgagatgatatccaaatgtagttttgattggtatttctctgatgatcaatgatgttgaggaccttttcatatgtctctttgtcatttgtatgttttaagaaatgtctattcagatcttttgtccatttttaactggattatttgattttttcctgtagagatttttgtgctccttatatgttctggttaattcatcctttgccagatgggcactttgcaaaaattttgtcctactctgtgagttgtctcttccctttgttggttgtttcttttgctgtgcagaaggtttttcacttgatatgatcccatttgtccatttttgctttggttgtctgtgcttgtgggttgttactcaagacatttttgcccagaccaacgtcctggagatttcccccaatgttttcttgtttgtagtttcaagtttgaggtcttaagtttaagtctttaattcatttttattttacttttgtatatggtgagagatagggggtctagtttcattcttcagtttatggatatccaggtttccgagcaccatttattgaacagactgtcttttccccagtgtatgttcttggcacctttgtcaaaaatgagctcactgtaggtgttgtggattttcttctgtgttccctgttctgttacattggtctatgtgtctgtgtttatgccggtaccatgctgttttgattcctatagctctgtattataatctgaagtcaggtaatgtgattcctgtagttttcttctttttgctcaggacagctttggctcttctgggtcttttgtggttccataaacattttaggattttttttttctatttttgtgaagaatgtcattggtgttttaatagggattgcattgaatctgtaggctgccttgggtagtatggacattttaatgatattattcttccaatccatgaacatggaatatctttctattattttgtgttgtcttcaattgctttcatcactgtgttatacttttcataatagacatgcttcacttatttggttaattcttaggtatttaattttatttctgagtattgtaaatgggactaattattgacttcttcatattgttcactgttggcatatagaaaggctactgatttttgtatattgattttgtaatgtgcaactttcataaatttatcagtcctaatacttatttggtggagtttttagttttttccaaatataagatcatattatctgcaaacaagtatgatttgacttcttcccttgcaattttaatgccctttatttctttctcttgtctgactgccctaggtaagactttcattattatgttgaataacagtggtgacattgggcatccttgccatgtttcagattttagaggaaaggctttcaatttttccccattcagcatactagatgtgggtttgtcctacatggcttttattatgctgaagtatgttccttctatatccagcttttgaggatttttaccatgaagaaatatggactttatgaaatgcacttttaacatcaatcaaaaggatcatatgtttttgtccttcattctgttgatgtgatgtatcacgttgattgatttgtatatgttgaatcatccttgaatccctgggataaatcccacttgttcatgatgagtgatctttttaatgtattgttgaattctgattgctggtatttggatgaggatttctgcattaatactcatcagatatattggtctgtaggttttttttttttttggtgtatctttgtctagttttggtatcagggtaatactggtcttgcagaatgagtttggatgtgttcccttcactacttttcagaacagttttgagtagaagagatattaattcttctttaaatgtttgatagaattcagcactgaaatattgtgtcctggatttttctttgctgggacacttttcctgacagctttttgctccttacttgttgttgatctgctcaggttttggatttcttccttgtttaatctttgtaggttggatatgtctagcagtttattcatttcttctagatttttcaatgtattggcaaatagttgttcatagtagccattaatgattttttgaatttctgtggtatcagttgtaatctctcccttttcatctctgattttatttatttgggtcttctccatttttttcttagccagtctggctaaaggtttgccaattttgtttatcttttaaaaaaactgagcttttgtttcattggtcttttgtattgttttcttcatttttcacattcgtttatttatgctctgctttttattatttctgttattataattttgggttcagtttgctcttgcttttctagttctttaagatgcatcattaggttacttatttgaagtttttcttcttttttgatataggcacttatagctataaacttccctcttggtactgattttgctatatcccatatgttttggtatgttgggcttccattatcattttttcaagaaatttttcaatttccttctttattctttcattgacccactggtcattcatgggtatgctgtttaatttccatgtgttggtataatttcaaaaattcatcttcttgttgatttctagttttattccattgtggtcagaaaagatgcttgatattttttcaatgtttatgattgttttaagacttgttttgtgacctacccttgagaatgatccatgtgtcgaggaaaagattgtattctgcagccattggatgaaatgttctgtaaatatctattaagtccatttgttctatagtgcagattaactttgatgtttctttgttgattttcagtctgggagatctgtctaatgctgaagttgggatgttgaagtctccagctataattgtattggggtctatatatttctttatctctaataatatttgccttacatatctgggtgctccagtgttggatgcatatatatttacaatccttatatgctcttgctgaattgacccctttatcattacataaggaccttccttgtctctttttatagggttttccctgaaacctcttttgtccaatacaagtgtggctactcttgttctttttgggcttcaactggcgtggaatatctttttacatctttttattttcagtctgtgtgtatatttatgagtgaagtatgtttcttgcaggcaacagatgattgggtcttgttttttcattcattcagctactctatgtcttttgattgaagagtttagccaatttacattcattgttattattgataaataggaacttacttctgcaattttgttatttgttttctggttgttttgtggtcttctcttccttctttctttccttcctgtcttcctcttagtgaaggtgattttctctggtgtatgttttaatttcttgcattttatttttgtgtatgtgttatatgttttttgatttgaggttaccatgaggctcaaaaatactatcttataacccattattttgaactgatgagaacttaatactgattgcataaacaagcaagcatgcaaaaagaaaactaataataattcaacactttaacttcatccctctgctttttaagtttttattgtttcttgttatgtcttattctactgtccctgtcttgaaaagttgttgcagttattattttctttcattcatcatttagtctttctacttatgtcaactgtagtttacataacacaattacggtgctatagtagtctatgtttttctgtgagcttactaataccagtgagttttgtacctgctgatgttttcttcttgctcattaccatcattttctttcagattgaagaactctgtttagtatttcctgtagtagaggcctggtgtttatgaagtctctcagcttttgtttgtctgggaaggtctttatttcttcttcatgcttaaaggacagttttgcctatgtgcttttattctagggtaaaactttatttcctttaccactttaaatatgtcatgccactgtctcctggcctataaggtttccatcgaaaagtctgcttccagatgtattggcactccattgtacgttatttgtttcttttctcttgctgtgtataggatcccttctttatatttgacctctgagagcttgattattaaatgctttgaggtagtcttctttaggttaaacctgcttggtgttctatagccttcttgtacttggatgttgacattcttctctacctttgagaaattctctgatattacccctttgaatgaactttctacccctgtctctctttctacatcctctttaaggccaataactctttttttttttttttgagacagagtttcactcttgttgcccaggctagagtgtaatggcgtgaactcagctcactgcaacctctgcctcccgggttcaagcgattcctctgcctcagcctcccgagtagctaggattacaggcacatgccaccacacctggctaatttttgtatttttagtagagatggggtttcaccattttggccaggctggtctcgaacttctgaccccgtgatctgcccgccttggcctcccaaagtgctgggattacaggcgtgagacactgctcccggcctaaggccaataactcttagatttgttcttttgaggctattttctagatcctgtaggcattcttcactgttttttattattttttcttttgtctcctctgattatgtattttcaaacatcctgtcttcagattcactaattatttcttctgcttgataaattctgctattaagagactgatgcattcttcatgatgtcatttgcatttttcaactctagaatttctgcttcattcttttttaattatttcaatcttttgtgaaatttatctgctagaattctgaattccttctctgtgttattttgaatttatttttctcaaaacagctaatgtttaattctttgtctgaaatgccacatatctctgtttctcatgaattggtccctgctgccttatttagttcatttgtttaggtcttgtttttctggatggtgttgatgcttgtagatgttcatctgtgtctaggcattgcaaagttaggtattcattgtagtctatgcagactgggcttgtttgtgcttgtccttctggggaaggcatttattatggtttggctctgtggccgcacccacacgtcatgttgaattgtaatagccacatgttaaaggaggggccttgtgggaggtgattggatcatgggggcggattttgcccctgctcttctcgtgatagtgagttctcatgagatctgatggtttaaaaatgtgtggcactccctcctttgctgtctgtctctcctgctccaccatgtgcttgcttccccttctgctatgagtgtaagtttcctgaggcctccaagtcacgtttccagttaagcctgaagaactgtgagtcaattaatcctcttttcttcataaattgcccagtctcaggtagctctttatagcagtgtgaaaatgaactaacacaccattctaaggaatttgaagggatgaagactcatagaggcaccaccttggtggtcttagataagatctctgagggggcgttccaagatggccaaataggaacagcttcggtctgcagctcccagcgtgatcgactcagaagatgcgtgatttctacatttccaactgaggtacctgtttcatctcactgggactggttggacagtgggtgcagcccacagagggcgagctgaagcagggcggggtgtcgcctcacccaggaagcacaaggggtcaggggatttccttttcctagccaagggaagctgtgacagactatctggaaaaacgggacactccctgcccaaatactgtacttttcccaaggtcttagcaactggcagacaaggtgattctctcctgtgcctggcttggcgggtcccacacccacggagccttgcttactgctagcccagcagtctgagttcgatctgcgaaacagcaacctggctaggggaggggcgtccgccattgctgaggcttgagtaggtaaacaaagtggcaggggcagctcaaactgggacgagcccactgcagctcaacaaggcctactacctctagactccacctctgtgggtagggcttagctgaacaaaaggcagcagacaacttctgcagacttaaacatccttgtctgacagctctgaggagagcagtgttctcccagcacagtgtttgagctctgagaatggacagactatgtcctcaagtgggttgctgacccctgtgtagcccaactgggagacacctcccagtaggggccgacagacacctcgtgtaggcgtctacccctctgggatgaagcttccaaaggaaggatcaggcagcaatatttgctgttctgaaatatttgctgttcttcagcctccgctggtgatacccaggcaaacagggtctggagtggaactccagcaaactccaacagacctgcagctgaggggcctgactgttagaaggaaaactaacaaacagaaaggaaaagcaacaacattaacaaaaaggtcatctacaccaaaatcccatctgtaggtcaccaacatcaaagaccaaatgtagataaaaccacaaagatggggagaaagcagagcagaaaagttgaaaattctaaaactcagagcacctcttctcctccaaaggatggcagctcctcgccaacaacagaacaaagctggatggagaatgatttgatgagttgacaaaggtaggcttgggaaggtcagtaataacaaacttctccaagctaaaggaggatgtttgagtccatcgcaaggaagctaaaaaccttgaaaaaagattagacgaatggctaactagaataaacagtgtagagaagaccttaaatgacctgatggagctgaaaaccatggcatgagaacttcgtgatttatgcacaagcttcaataccaattcgatcaagtggaagaaagggtatcagtgattgaaaaagaaattaatgaaacaaagcaagaagacaaggttagagaaaaaaaagtaaaaagaaacaaacaaagcctccaagaaatatgggactatgtgaaaagaccaaatctacgtttgataggtgtacctgaaagtgatggggagaatggaatcaagttggaaaacactcttcaggatattatcaaggagaacttcctcaacccagcaaggcaggccaacattcaaattcaggaaatacagagaacaccacaaagatactccaggagaagagcaaccccaagacacataattgtcagattaaccaaggttgaaatgaaggaaaaagtgttaagggcagccagagagaaaggtcgggttgcccacaaagggaagcccatcagactaacagtggatctctcggaagaaaccctacaagccagaagagagtggaggccaacatttaacattcctaaagaaaagaattttcaatccagaatttcatatccagccaaactaagcttcataagtgaaggagaaataaaatcctttacagacaagcaaatactgagagattttgtcaccaccaggcctgccttacaagagctcctgaaggaagcactatacatgaaaacaaccagtaccagtcactgcaaaaacatgccaaattgtaaagaccatcgatgctatgaagaaactgcatcaattaacgggcaaaataaccagcgaacatcatagtgacaggatcaaattcacacttaacaatattaaccttaaaggtaaataagctaaatgccccaattaaaagacacagactggcaaattggataaagagtcaagacccatcagtgtgctgtattcagcagacccatctcacgtgcagagacgcacataggctcaaaataaagggatggagaaagatctaccaagcaaatggaaaacaaaaaaaagcaggggttgcaaccctactctctgataaaacagactttaaaccaacaaagatcaaaagagacaaagaaggccattacataatggtaaagggatcaattcaacaagaagagctaactatcctaaatatgtatgaacccaatacaggagcacccagattcataaagcaagtccttagagacctgcaaagagacttagctcccacacaataataatgggacactttaacaccccactgtcaatattagacagatcaacaagacagaaggttaacaaggatatccaggacctgaactcagctctgcaacaagcaaacctgatagccatctacagaactctccaccctaaatcaacagaatatacattcttctcagcaccacatcacacttactctaaaattgaccacataggtggaagtaaagcactgctcagcaaatgtaaaagaacagaaatcacaacaaactgtctctcagaccacagtgcaatcaaattagaactcagaattcagaaactgactcaaaaccacacaactacatggaaactgaacaacttgctcctgaatgactactgggtaaataacgaagtgaaggcggaaataaagatgttctttgaaaccaatgagaacaaagacacaacataccagaatctgtgagacacatttaaagcagtgtgtagagggaaatttatagcactaaatgcccacaggagaaagcaggaaagataaaatcgacaccctaacatcacaattaaaagaactagagaagcaacagcaaacaaattcaaatgctagcagaaggcaagaaataactaagatcagagcagaactgaaggagatagagacacaaaaaacccttcaaaaaaatcaatgaatccaggagctggttttttgaaaagattgacaaaattgatagaccgctagcaagactaataaagaagaaaagagagaagaatcaaatatacacaataaaatataatgataaaggggatatcaccaccgatcccacagaaatacaaactactatcagagaatattataaacagctctatgcaaataaactagaaaatctagaagaaatggatgaattcctggacacatacaccctcccaagaccaaaccaggaagaagttgagtctctgaatagaccaataacaggctctgaaattgagacaataattaatagcctaccaaccaaaaaaaggccaggaccagacggattcacagccgaattctaccagaggtacaaagaggagctggtaccattccttctgaaactattccaatcaatagaaaaagaggaaatcctccctaactcattttatgaggccaacatcaccctgataccaaagcctggcagagacacaacaaaaaaagaaaattttagaccaatatccctgatgaacatctatgcgaaaatcctcaataaaatactagcaaactgaatccagcagcacatcaagaagcttctctgtcatgatcaagtgggcttcatccctgggatgcaaggctggttcaacatatgcaaatcaataaatgtaattcatcacataaactgaaccaacaacaaaaagcacatgattatctcaagagatgcagaaaaggcctttgacaaaattcaacagcccttcatgctaaaaactctcaataaactaggtactgatggaacgtatctcaaaataataagagctatttatgacaaacccacagccaatatcatactgaatggacaaaaactggaagcattccctttgaaaaccggcacaagacaagtatgccctttctcaccactcctattcaacatagcgttggaagttctggccaggacaatcaggcaagagaaggaaataaagggtattcaattaggaaatgaggaagtcaaattgtccctgtttgcagatgacatgattgtatatttagaaaaccccatcgtctcagtccaaaatctccttaagctgataagcaacttcagcaaaatcttaggatacaaaatcaatgtgcaaaactcacaagcattcctatacaccattaagacaaacagagagccaaatcatgaatgaacccccattcacaattgctacaaagagaataaaatgcctaggaatacaacttacaagggatgtgaaggacctcttcaaggagaactagaaaccactggtgaaggaaataaaagaggacacaaacaaatggaagaacattccatgctcatggataggaagaatcaatatcgtgaaaatggtcatactgcccaaagtaatttatagattcaatgccatccccatcaagctaccaatgactttcttcacagaattggaaaaaattactttaaagttcatatggaagcaaaaaagagcctgcattgccaagacaatcctaagccaagagagcaaagctggaggcatcacactacctgacttcaaagtgtactacagggctacagtacccaaaacagcatggtactggtaccaaaacagagatatagaccaatggaacagaacagagccctcagaaataacgccacacatttacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatgggttaaagacttaaatattagacctaaaaccgtaaaaacccttgaaggaaacctaggcaataccattcaggacataggcatgggcaaggacttcatgactaaaacatcgaaagcaatggcaacaaaagccaaaatatacaaatgggatttaattaaactaaagagcttctgtgcagcaaagaaactaccatcagagtgaacaggcaacctacagaatgggagaaaatttttgcaatctactcatctgacaaagggctaatatccagaatctacaaagaactcaaagaaatttgcaagaaaaaaacaaacaaccccatcaaaacgtgggcaaaggatatgaatagacacttctcaaaagaagacatctatgcagccaacagggacatgaaaaaaagctcctcatcattggtcatcagagaaatgcaaatcaaaaccaccatgagataccatctcacaccagttagaatggcaatcgttaaaaagtcaggaaacaacagatgctgtagaggatgtggagaaataggaacacttttacacgttgatgggagtgtaaattggttcaaccattgtgggagacagtgtggcgattcctcaaggatctagaactagaattaccatttgacccagtaatcacattactgggtatatacccaaaggattataaatcatgctactataaagacacatgcacacgtatgtttattgcagcactattcacaatagcaaagacttggaaccagtccaaatgtccatcaatgatagactggattatacaccatggaatactatgcattcataaaaaatgatgagttcatgtcctttgtagggacatggatgaagctggaaaccatcattctcagcaaagtatcacaaggacagaaaaccaaacactgcatgttctcactcataggtggtaattgaacaatgagatcacttggacacagggcagggaacatcacacaccagggcctgttgggtggtggggggctccgggaggaatagcgttaggagaaatacctaatgtgaatgatgagttgatgggtgcagcaaaccagcatggcacatgtataaaaccagcatgttgtgcacatatattctagaatttaaagtataataataatgatgataataataataataaaagatctctaagaattccttggattgccatgcggagacctcccctcctccagaaacagatgccatgcaaatggagtatggtgctctgtgctgaacacctggcactggcttgtggtgatgcaagtcctctgtggctaccaccactgggactgtactgggcctgacgtgaagccatcacagcagtgggccttgcccaaggtcattcccttcaaggcagggagttcccccaggttctgggtatgtccagagatgcagtctgggagccagggattagagtaaaataccttcgcaatttaccttttgttttgttcgactgcagctaagctggcgctccaactacgatacagttttcccactcttccctcccctttgcaaaagtataggagtctctccctgtggccaccatcaccactggtccatggggagttctgtcaggccatcactgatgttcacttaaagcccaagggctcttccatcagcttgtagtgaatgctaccaggcctggggctcactctgcagggcagtgggctcccgtatggcccagggcgggtccagaaatgctaagagctgaggcctggactcgaggaccccaacagcctgcttcttgctctactgcactggctgagctggtacttagggtctaatacaaagtcccctttacttttctctgttcttgtttcaaatggaaggagtccttcaccatagctgggaggacgctgggtcatccctgaagtcagcacgcctcagagcccaaggcccatggcttactccctgcatctcgctgggtgttattcagtgcccaagggctctttagtcagcaggtgataggtcctgccaggactgggtcctttccttcaaggcaatgggctcccttctggcctagtgtgcatctagaaatgtcgcccaggagctagggcctggaaaaggagccttacaactctgcccagtgccctattctactgtgattcagctggtatcaaagatgcaacataatgtcccctttaatgtgttagtccatttttatactgctataaaggactacctttattcactctcctctccttaagcagaagtaaggggacgttttaattgctatgagctgcactaccaggggttggaggagggatggcacaagggctccgctagtcatgtcagctgctgtctccctaggtcacgtgccacctgagttcactggttgtaagcccagtccagcactaggatttccttagaaactgcagtcgttgtgtcctagactgccttttaagtttacacaggactctagagcgcttttgcccacagtggcgaggcttgagaagaagctcaagtttcaactgatgggaagggtgattcttctggcgagggctggtccaaatgcacccccccacacacacacctgtgtgtgggcactggctgcaccctgcatggatttgttttcagctgtgatagggcagcattgagttcaaggtaaagtcccccacttgctgcactctccctccccaaagtgcacagactctccacgctggtggatggaggaggggtagcattggtggttccagactacctctcttgccctgtgcaatgcctctttcagtgatatgaagttaaaaccaggtgatgtgattgctcacctaattcttggttcttgtggcagtgttttttgtgtgcagatagtcgttaaaatctggtgttccagtgaagggagatgggatgagtggtgtaggtttctattctgccatcttcatctatcccctgccaaggtgactttcccttcacccagtcaatgtgaatgtgtaggaaactttcttgtaaccattagagttacaacttaggttccacatggtattataatcaaattgacctcatctgttatgataagatggctcacaacactgtgtatgctaccatgtgttgggcaagggttttattcctctgattaaagcaacagtggtggaacagtaatggaagtagaaaaaagtggtgaattgatttgattcttctcagtttgtccaactagatatatgcttctctgcagggctgtgtgttccagaaggctgataccatggaagacatcaccttggcttcctggctgtctggttagtgatttgagcaatgagaggcagcagctagaaatgaaagagtagaagaagagagtgtctcctgacactgtgtgcatggtctccagtcagcctctgattcctgtgagtcagctgcatccagattcccacccccttccccgtcccgagaaggttacatttggccgccactaagatctcctgagaaaaatctcttcagaggaattttggccaaatcttctctccctctcctacagccactttcctcctgaatttcttccttgtgagtgtcacttctggaaacaaaagtcaagttctctaggtgaacactgagtagccccaaccttccagtgaatttgaagtgtaggaagttttcctcgtttaaactcggcacagcctccaatccctgggaagcatgcctctctggtctccaacccacccagacttccagtgtgagtagacacctgtaggtgagtgagtggtcagaggtcacatgattgtgattaccttctttaccaggcctccattgttaggcaactccttgcaagatgggaaatagttggtaccaattgttttggggcactagtcaagtcggaaagtggacagagttccacttgaatgtgctgctgctctagtttggataactttactgtctatgtatatacccaagtactgcttggcacagttgggtttctctttggtacataattctgtgctacttgttttctcactcagtatgatggtgagatttatccacacataactctgtatcctaaattctgtctcttctgttgtgtggccatggagtgtaggaggttggctgttattggcctctgctcctgtgggtttggctccttcttgccctacctgctgccctttcagcctccattccccacctattctccacctcacagccactgtttgatgctgggctgcaggtaaatagtcaccgacatagcagtgtccaggcagcgttcctcccaacggtgcacccaggaggcccctctacctggcagcctctaacccctcctctccatcctacagccagctgcgtcctctgaggagaggctggtggctcttttttggcgatgctgcatcagtgcagggacagagaaggtgacagggacaaagaggacagtgaaaaggacatagagcagtttaacttcgtaccacataaaaaatctggaagagacctggctaagggaagagagagtaacagccccttagatgtaggcgggggaggggacacaggaaggggccttggggaatgctggacaggttgtgagaacacagggaattggggaggaggggaagaggggacagaggactgcttgcaggggcttattttgcagctcacgtgaaaggacaagagaaatgcttggaatctgtgatggctttaatggttcaccttatgtaaatttcatcttactcctcacttaggcttgcccatgtttgccacggctctgacctctttgctctccctgtcccctcttcagctttaactctcacttgtcagtgaccaattgcccacatagttcccatttcaggtttctcagaatgagtatctgacttgctcagcacattccttggggacagagcttcttcaatgggagccatctcatgtgtgttgttgtcctaccaggtggcttcatttcagtcaaatgaattatctttggctgtggcctgagcaggtttgtttgacatgacacaaaaaagtgaccagagcattctatactttcctggggacaaagggcagagcggttgcctctggaaggctctgtggatatgacattggcagtattaaaacatatcccaaacccccaggccaactgttggtctgctcttaaacaatgtcttttcactaggacaagcattgggttttagaggggaacaccagggcagtctcttcaaaatggctagggagaagagtctttggtccttaaatgccaagtactacatcactttgactttgcagtgtttttcagattgatggtgggagagatctggtgtgcagcatgatctcaccctctcccctgggtctaagcacccctgcacagcgtgttaggatgaacagaagccccttccagtgtaacccaagaacaccctgtcagcaaacacacatccaacctcaaggagtgaaatgacagactctgttttaatgactcaaacatgggaggagtttattgttctaattatatttaatttctcaaaaatatgggcaggcttcagcacgtaagccacatgactttttgtccaaggccatgtccaccctagagttgctttatgacagcatccacacccatcttgacaggtcgatgtcacttctgtgcctgcccagttgtctgttgattaaaaagatcagcacattttcggtgggcttcttgcgtttgaaggatttgtctgacttcttgatgttcagtgcgggctccctgggactgcctttagggacttctttatccatgatgtgttgactccacccaacctcagtaaaacagcacaaccgaggaagtctgaaaaagatgatgtattctaggtaatcaagtgtacccggcaacctcttcctcactggcacaaaaccacacacacacacacacacacacacacacccccatacacacacacactgctaccagcagtagtcacaggagattgctttgggtcatcatctgatttgaagcaccaaccatattgtttcttctatctgtcttacacatggggctgtgcagcagcctgatgggacccgggacattaaagacacactattgcatccctctaatcattacctgacacacacaggcttgttagattgtactcaaaacactacctcatagctcaaatgtcattgtaattcttatatccacactaattttaactcaattctatgttgctctttttcagagctgcctcttctcacctctgagttttccctgtacctgggatatgggcttccttctgaactccattattcatgttatgcagagtaattctctttggtaaatctatccatgacaaagttcagtactttacatttgcatttcttcattctacaacttgcaggctgctataatttgtttcctcattccaaatctctttatgtgactttagcttcaaataggatttgcctcctttgaaaatcactggtgaagcaggtatgaatcttactccaaacccctgtgtaagagataaactggacattctcaagtactaccgagtttctgtttctaaggtccatcctgctgattttccatcctgggaacgtaatcacagtggcttaaagattgtactcacctctgatgcctggccctgcctcatccccaaaaacccagttctgcatttcatttgaatctagcacagtgccaaggctaggggtggatgctcactgtgttctctattttgacctcccaagagagactaaaagacttgcccaagtgacagagaggtgagattggaactgagaaagcctgtatctgaagcttctgcttttacccactgctctgtagtgtctctgtatcagtttgaacaaatgactctttgataacctccccccattaccaaacagggttggggtttatcaggtaggttagttagttaatggcacaaaaggatgctctatgatcttggtatatcaggatattttacctgtgagaccactcaggtttcttctgaagaaagatctgggccagagggtaaacagtaacagcttggcactccctctctttccttgagtcccagggcctgattggttcagcaccaagtgaagtcatagtcactatggtgactcacaattgtcctcagaacctagtgccaacagtctgcaagattcaaacactggccaccatgcctggcttccttctggttcaagcctgaataaggtgagtggaagttgctgggagaggaggtgggtatatcctgtggctgggtgccatctgcatgtctccttcctagacagaaccctcaactaccctggcctcagagcttgttcctggcttgtataaaatccattaaaatttctcctttctgtaaataaacagcacccattgcatcttgccttgtcccctgggtagtgatcagcaactttgtccgccatgttccaatccaggaattagttccaggtcaaacttcctacctgcttctcaatcttgcatccatctttggtcatgactctgcaagtactcctcctataatacacaattcatgtaaatggagtgtttagttgcagaaattgaacactgcaattaaacattgctgtgtctcccacacttatctaaaccctcccaaagctcagtgcagtggagcccctcccaaagctcaatgcagtgcagcttcacacctttattctgtggacctgggatgcaggtgggcttttaatgctttggaaaatcttatgctaaaactggaccagttccttgagacatactcatatgtctcaagccatattcccttccaagtctctgatctagaataactacattgttgccattaaagtgtgacccatgtgggtattgtctagatgctggacatggattttccaggctgtcagagggataacggtgaggacagcgctttgtgttttttgtagtgtggttctcatgaggaactaaaatgactattatgagatgtggcttgcctccacactggctgcccactcagtcttatgtaagaacggaggaaattgacgttactgtaaagtgacccaggtcgcacactccctttcttgagtggcagggaaggaaggctcactcctccaggttttctcctagcccccgtagaaccatgctttacatggttctgaacaccctgaggccgtgttcagtgttctaaacaatttggagagggaagagaacatattggtgtattttattaacaaagaaagtggaaaactgtctttcttttaaggaattgacatcctagaaatccaagtcaatcacctaggaaatagaccaggagaggctgattgagagaagttaaatgcataaaaactttgcatactaggtcaggcacagtggctctcacctataatcccagcactttggaaggctgaggggagtggatcgcttgagcccaggagttcaagacctccagttggccttgggtcatatccagcatgttccaactgtaaggcaaaaagcccctaaggcagagagtcatggtgattgccataagcagccctgtagatgcaaggatgagatgtagctctgcagggccagagtctaaatacataagtcagtgtcagaatctttttggcactgtctgttccttaaataggtcaatactcaccgtttgtgaaaattttcattgaactggagctacatttcctttctatacatagcatgtttaaaaaaaattttttttttaaagcgacccaggtcacacactccctttcttgagtggcagggaaggaacgctcagtcccgcaggttttctcctggccacatagaaccgtgtaaagaccctgaggccatattcattgtcctaaacaatttggagagggaagataacttatcggtgtattttgttaacaaagaaagtggaaaactatctttctcttaaggaactgacatcctagaaatccaaggcaatcacctaggaaataggtcaggagaggctgattgatagaagttaaatgcgtaaaaactttgcatactaggtgaggcacagtggctctcgcctataatcccagcactttggaaggctgagcggggtggagcgcttgagcccaggagttcaagaccagcctgggcaacataaggagaccccatctctacaataaaaataaatgaatacataaataaattaaaaatttgcacagtcttccaataaatagggaatatcatagatttaagctatcccatttacattggttgcaaacgttatgaaacacctagaaaaataatgaaggtaaatacaaggaaaacacacatgccactttttatgagccttcagtttgaatagtcacataatattttaaaatactacatttttcttaagaggaagatcaattttttcaatggcatcaattcgcctctaaataaatcagtatatccagtacaatcctaatgatagtttatagcagaattttgagtgtgtgtgtaactggaagatcggatgaaattatattccaaaaaaatgtgaaggattatgcaagaggggtggcttgtcattctggactcaaaacttactctgtagtattggtgaatgagacaagaattgatagacatgtccatggaccaacgaagagattctagaaatatactcatgcatatgtgaaactcaaagaaatttaaaaatcacaagttgccacaaagctgacttttatgattgtgtgtgtgtgtgtgcacatgcacgcatgtgtgttagggaggagaagtgcagagaggcttctggggctacttgatgcttctccttcaggtaattctagattctatcaactttcacaggtccctcttctgtgctgtcttcctgaagccatctgtggagtcaagcagtcatggctcagggacactctgaagtaggtcccagcacatctgcatggagcatcaggaggaaggtggatgaatacttaagacccagcctggcctctaaatcggtgctgagcgttttactcagtagacagcttgggaatcatagaaacgatgcggatctgacagagtggctgtggacactgaagcaagccataccagggtggacctggcctttgccgacacgccacacaatcaacccacctctgccccctggggaggatggaaaatccaagaaaatggtgtggatcaataaatccttcccctgatgcaaccattacaagtggaagctgtgttctc

SEQ ID NO: 3765 - DNA, 3814 bp, human
gtgcgggatcgtggaggtggggccgaggcagcggccgcctgagccccgctcggccttgggaacacgggggcggggcggccgcggctctgggcgacccgctgggtgcactagtgctcgggtcccaccgccctgaggctcgcgctcgagcgggtcagtcggtcggcggggcctgcgcggggcccgggcccatggcggcgtcggcggctctgtctgcagcggcggctgcggcggccctgtctggcctggcggtgcggctgtcgcgctcagctgcggcccgaggctcgtacggcgccttctgcaaggggctcacgcgcacgctgctcaccttcttcgacctggcctggcggctgcgcatgaacttcccctacttctacatcgtggcctcggtgatgcttaacgtccgcctgcaggtgcggatcgagtgagcgccggcggcggcggcggcgaaggcccggctgaaggggcgcccgtgtccccgcccgcccccggccgggtcgccggcatgaaggaaagctgggccgcggcggggggcggaggcggggcggctcggacccctggactctagacctacgccgccagggcacgacggcccagccctggccccggctgcggtctcagcccgggggccctggatcgcgcagaaacgcactgaatgggcccctgccatcgggctccagaaactacctgggctcggccgacctgttgcctcatattggccaaagagggggaaaccagaaggagggaattctgctgcggcgacttgactttccaggcccggagcagaaaggtaggaggcgacaggttggaatgggagaggggcggtggctctgcccttcagatgtcagggcgtgttggcggtcagggggaagtatggaaggcaccggggcaaaccagccagaagagctgtggagcccaggtggggaaaggaaaggcagccgcaggctctcccctcctccccagtcatgattgcaggatagggtgaggggcggccccctcccgcccacgccccagtgcctgcctccctttctgcagaggcccccagggtgtcccctgaaccctgaggaatggagggtaatgggctgggggcggccccggaaggccctagaggagcaacgatgcccccacccttctcttccccaccagtcggtgggcatagggaggacggttctcttctaggttgagccccatatctgttctcagccctcagccctgggtctctctgcagctcctgcacagcccttggcaaaactgcctcctgccctgtctttggggccagaggactggtctctgcctgctcctgctgtcccttatgttcccctacccctacatgagggcaccccccaagctctgcatttggagacagggaagagtgggagagacgcattcctaccgtcccctcccctagtcttgctcttctgccatgtcagcccatgctccctaaggcccctagctagcaaggccctcccagggccagagtcccatcctccagccccagacggcctctagaagcctactgtgtactgaagtgatctgggaaaaggagacctgcctgagcacacagcagctctcagcctggggtgggcagagcagatggaggaggggcttgcagaggaggccattcccgggggaagcaaggacgtgtctggtggccaggcaactgaggtccccatctctttctttctctttcaggcattggcatttgtaggcggtgacccgccccttctctggccttgccaagagtcacatccctgcccaggggcacctctggccctggaacttgcctgggcagaggcagcgtgaagggcctgaacaagaggagaagaagggccttcctagtagaggcacagcatggacaaaggctcacaggggtgggggtgcccagtgatcgagtcctggcttgggaaggaaggtctgagttccctgggaactgaaatctgctagcagcactgtgagagaggtgtatttccccctcctaatgacagaggaaactgaggcttcagggaggggtggatttgcccttgacatgcagataggaggaggaggaactgcgtgtgcccctgggcctgcaggcccccacacccctccccagtcttcttcaagacctggcatggtgggaggagggagggggaagtggagaggggagcatagggctcctggggcaccaagggagagaggggcccaggggtagggaatctaggaatgtcgctttccttggagcagtacggaaagtcacagggaagatcaggaggacggacagctgagatgggagacaggagagatgagccccaggacccctggggagccaagctgtcccccacatcctagcctctcaccccacctggagcttcaccaagggctcctcagcagtgaagtggcacaagcctcccagtttggtgggcaagtgggggtgatcttggtgttgtggctcctggagacacgacataaccaggagggtgaagggataaacctggggtgggctggggctgagacccatggcatgaccccaattctctctcctcaagctcgaccccccatccccaggatcacacaggagaatctcatcctcacggcttggattgctcctgggggccccctggtgtgctgctaactggtgtacaatgctcaggagcagcccagaggggagccgggaagggaccctcgcccttaccatctatccccatttccgcatctcttgcactggtaccccgggcgccacgttctcagttcctgggactgaaaactgcagcagtctggccagctccagggacagagtggcccagccacctactatgtaccctcctcagctgcccactggactcaggtcctgaatgaagctgtccgcctgcctcatgccagaagcggctggacagtggctgcctcatgacccttgcagtctcccacatccagggcctgatgacatgcccccttgtcccaagtttcttgggaacccctgaccctgctggcccctctcatccaccccaaccctatccaccctggaccacctctgggggtctgtcagcctgctggtccccccaacagatctttgggggcagcctctatgggacaagagtgacacagggctggagaagaggagtgaggagcctccttgtgtctgatgcacagatgtggccctttcaaaccctggtgtcaccctctgggtgactggatccccagctccagcctcttcctgggccagccaggaaggctggaggaaagctctttgctgagtgcatgcatgggagtgtggggggtgactgagccctccccatgcaaggggcttggcctgggaccctggaagctgtttccctactgggataaagttgcgtcagccgcaggggtctctgccctcaaagaccccccactgcagggagccccaccccataagagggtcacggaagtccatgtccgcccacccccagtggcttctggtgtggccgtattggcctagaggggctgactggggagggtcagggccaagccctcagcatctgctcctgtccctgctttttcacccctgctgcctgaagtggtagccccgcctgctgcttctccacctcccctccccacctcttctctcccagatggggcccttgctgcgtgacggggtctccatgcgctttatttatttgcagtctgttttctaggcggtggagctagacactgaccggaatgacatacttttctgtgtgtgattcactgtgtactggtcagcacaggctggccagagagctgttcttgtttctggtgttgtcacgtcttcttgttttctctaagtttaaaaaaaagtccttggtttaatacactaaaatcccaa

SEQ ID NO: 3766 - DNA, 5674 bp, human
tggcactgctgctgtcgctgcagaaaaagaaccagctgctgcagcaggagctgtcgcgcgcggaggacttactggcccagagccacgccaagcgtgatgagctcaccattaagcacaatgggctggagcagggtgtgcgtctggagtctgaggagctggagatgcaggagcccgggggctggtacagcagagcgtggagttgtggaggcagctgcaggaggagcctaccaggagggccaacagtggcaggcccagcttgtgcagcagctgcaggccaagattctccagtacaagaagaggtgctgggagctggagcagcagctgctggagagatccagagagcttgcgcagcagcggctgagggacacagagcacagccaagacctggagagcgccctcattcggctggaggaggagcagcagaggagtgccagcctggtccaggtgaatgccatgctccgagagcagctggaccacgcaggatcggccagccagactctgagtgaggacatatgaaaggtgaccagccactggacactcagccgcaaggagctggagcagcgggaggcggcatggaggctcgaggaggagtccttcaacgcctacttcagcaacgagcacagtcgcctgttactcctctgtaggcaggtgggggtcgggtgactggtcagcgaggtgaagatgtccaccgagagggacctgctgcagctgggaggggagctggcctggacatcatacgctgtccaggaggcgggcctggtactgagcacgggcctgcggctggcagagagcggggccgaagcggccctggagaagcaggccctgctgcaggcccaactggaggagcagctgcaggacaaggtgctccatgagaaggacatggcccagcagcagatgcaaagcgacctggacaaggccgacctcagtgccagagtgacagagctggccctggcagtggagcgtcttcagaagcagaatctgtagtaggattaggtcaagaagcccctcggcaagcctgaggccctggaatccctgcggctacaggagcaggtggccctggagacagaggatggagaggggctgcagcagaccccgagggacctcgcacaggccgtcctgttggacactgagacggcgtccagctgagcggctccgagcacactgcggacgcgtgcgaaggcagcctgcggggctctcaggccagcggatcccatccccacccaccgcagtgctcctcactgggcagcagccgttcgccccaccgaagccggtccctggctagctcagactcctccaggctcgccctgattcactctgccctgcacaagcgacagctgcaggtccaggacatgcgtgggcactatgaggcaaaccaggacctgctgggcaccctgtggaagcagcttagcgacagtgaggttgagcggcgggccctagaggaacagctccagcaccagtgggacaagaccgatggcgccgtgcaggcccaagaggacgcccagcgcgaggtacagaggctgcggaacgccaatgagctcctgagcagggagaagagcaaactggcccacagtctgcaggtggcccagcaacaggccaaggaccttctgaaggagcgtgagaagctgcaggctgcccaggaggggctgcggcgccagcgggaccgattggaggaagagcaggaggaggcggtgcaggatggtacacgggtgcgccaggagcttgagcgcagccataaacagctagagcagctggaagggaagcgctcaggcctggccaaggagctggtggaggtgagggaggcgctgagctgcaccacactgcagcgggacatgctgcaggccgagaaggccgaggtggccgaggcgctgaccaaggctgaggctggccaggtgaaactcgagctctccgtgaccaagctgagggcagaggaggcctccctgcaggactccctgtccaagctgagcgccgtcaacgagagcctggctcaggacaagttggatctgaaccgccttgtcgcccagctggaggaagaaaaggcagccctgcagggccggctgcggcaggcggagcaggaagccaccgtggcgcgggaagagcaggagcggctggaggagctgcggttggagcaggaggcggcgcggcagggcctggagggctccctgcgagtggcagaggaggtccaggaggcgctggagcagcagctccccacgctgcgccatgagcgcagccagctgcaggagcagctagcccagctctcccagcagctgagcgggcgggagcaggagctggagcaggctcggctggaggcacagtggcaggcagaggcgctagccaaggggtgcactggcctggtcatgcagctggcggccgcggagcctgaaggcaggaccctgtcagaggaggccacatgcctgcgcttggagaaggaagccctggagggcagcctgtttgaggtgcaagggcacctggttcagctcgaggcccgctgggatcagctggaagccgatgggcaggccctgctgttggccaaggagaccctgactggggagctggcgggcctgcagcagcaaataatagctacaaaggagaaagccagcctagacaaggagctgatggcccagaagctggtgcaggctgagcaggaggcccaggcctctctgagggagcagcgggcagcccatgaggaggactggcagtgagtccagcgcgaaaaggaggcagcatggcgggagctggaagccaagcgggcccagctgcagagtcagctgcagtgcgagcaggaggagctgctggcccgactggagatcgagaaggaagagctgagcgaggagattgctgccttgcagcaagagcgcgacgagggcctcctcctggccgagagcaagaagcagcaagccttgtctctgaaggggtctgaaaagactctgtcagagaagttgtcagagaagttgatgggtacgcggcacagcctggccaccatctccctggagatgcagccacagaaactagatgcccagagctggcaggagcaggaccggagcaccgtgaacgctctgatgtccaagctgagggacctatgggcccagctggaggaggctgatgtggcccacgcccaggaagtgaggaggctgcaagagcaggcccgagacctgggcaagcagcaggactcctgtcttcgagaggcagaagagcttcggacccagctgcacgtgctggaggatgcccgcgaccggcttcggcgggagctgctggaggcccagcgcaagctgcgtgagagccaggagggcctcgaggtgcagcgccaggaggcgggcaagctgtggcgcagcctgggcgagggtgccaaggagcgtgaggcactgcaggccgccgtgaagaaggcagagagcgagcgcatcagcctgaagtttaccaatgaggacaaggagcagaagctggcactcctagagggcaaggaggctggggagctttggactgggctgcaggaggtggagcgctcacggctggaggcttggagggagctgcaggagctccggcgtcagatgaagatgctggacagtgagaataccagagtgggccgcgagttggcggagctgcagggccgcctggtgctgggctagcaggcagagaaggagagccggcgggagatcctgcgcctccggcagaggctgctgaagggcgaggacagcctggaggcgacgcggcaggagctccaggtagcccagcggaagctgcaggaacaagaaggcgagttccggacccgcgagcgaggcctgctgggcttcctggaggaggtgcgcggcaccgaaaagcagcagctggaccacgcccgcggcctggagcacaagctggaggcggcgcgggccgaggctgcggagctgggcctgtggctgagcgcggccgagagccgggcacaagacctggaggccgagctggcccgcgtggaggtgcagcggtgcgcggtggaggcccagctgggcggcctgcgctcggttctgtgccggggcctcgccctgggtcgcgcgcccagcccagtccagccccgccaccaatgcccggctcccctgcccgggacgcgcccgctggaggaagcggggaaaggctaggccgccccagcaccttagaatgcagccctgggtcccagccaccatttccaggacctaccacctccccggctcctctagacctggacccagaggcagtgcgcggggccctccgggaatttctgcaggagcggcggagcgccctgagagaacaggacgaacttcggacccagagtgccctgaatcgccaactggccaagatggaggctgagagggacaccacaacctcgaaggccaggcagctgcagaaggccagagtggctacagtggctgagagtgagaaagccctgcgcagtgtggatggacggctgagccgggtccaggaggagctggcgctgcaggaggagagtgtgcggcgcagtgagcgggagcgccagggccacagtggactaggtggccgcactggagagaagcctgcaggccactgagagcgagctccgggccagtcgggagaagatcagcaagatgaaggccaacaagaggaagctggagggcgacaagtggtgcctgaaggagatgctggacgcctccgagggcctcaccgtcaagctggaactgcagcggccctcgcttgagggggagccgtagcgcagccacctgggcctgagcggccacgaggcccaagcccaggccctccagaatcggatggactccctgcagagacaggtggcagacagcgaggtgaaggcaggaatcctgcagctgacagtggagtggctgaatggggccctggccaaggtggaggaaagggaggggctcctgcacgtcaaggtgcggggcctgacagaggccctggcctagagcagcgccagcctcaacagcacccaggacaagaacctgcatctgcagaaggctctgaccgcctgtgaacatgactgccaagtgctcctggaacggctggacgctgccaggcagacattgtctgaggcagggaagcagagcagctcccttggcgagcaggtgcagacgttgccaggcgaggtggctgacctggagctgcagtgggccgaggccgagggccagctacaacagcttcaggaggtgctgcagcagtggcaggagggcgaggctgcagtcctgcacacggtcctgaagctgcaggacgagcagaggatgctgcaggaaagcctgggcagcctgcagcgcaccctggctcagctggaagccgagaggcgggaggtggagcgctcagccctgcagctggagaaggaccctggggccctcaggagggcactggacaaggtggagcgagagaagcttcgcagtcataaggacacagtgccgctgagcccagagaagggccgcctgacctggaccctcatgggggctgagctggagctggccgaggcccagaggcagatctagcagctagaggcgcaggtggtggcgctggagcagagccacagcccagcccagctggaggtggacgcacagcagcagcagcagctggagctgcagtagaaggtggagcgcctgtgcagtgcccaggcacaggctgaacgtaccctggaggcatgggagcgggcccaccgccagagggtgcactagctggaggagcaggtgtccacact

SEQ ID NO: 3767 - DNA, 19290 bp, human
gcagaggcagaggaacacagaaccttctcacacagcgggataaaagggtgaatttggagctgacaggcaaatatatcttgtgatatatttctctggctttgatatcagggtaatattggccgcatagaatgaagtagtgttcctccgttattttttggaagacattgctaagtactggtattatttcttccttaaatgtttgatagaatttgcacgcgaagccatcttggcttggcttgtatttctggggagattttaaattactaattaaatctcttttcatgctatagtcctaagtcgattttctacttattatttatttatttatttattcatttattttgagacggagtttcactcttgttgttcgctcttgttgcccggggtggagtgcaatggcatgatcttggctcacccaacctccgcctcccgggttcaagtgattctcctgcctcagcctcccaaatagctgggattacaggcatgcgccaccacgcccagctaattttgtatttgtagtagagacggagtttctccatgtttgtcaggctggtctcaaactcccaacctcaggtgatccgcccgccttggcctcccaaagtgctgggattacaggcgtgagccactgcacccagcctgtttcttcttgagtcggtaatttgtcttccaagaattttttccattttacctaagttgtttagtttgttggcgtaaagttgttcataatgtattccttttaatttctgtaaggtcagtattaataacccccctttcatttttgattttgataatctgtgtagtcctttctatttttcttggtcagtcaagctaaaagattgttagattttttttttcaccttttcggtgaaccaacttttgatttcattgatttttctgtttcttatttcattgattttcttctactctaattttcatcattcccctccttctgcttgcttgtattaaatacatcagtttaaaacttcaggaataacaaaagatttgtttcgcaaaggaagatttgaaatgttagacatgtagaaatgcttatgatattgcaagtagcagtcatttcgaccagttaaccagaaggaaattcggtgtgctgaaaccaaacaagtgtttttttgtgccgggcttttactgattttgaaaatatcaagtctagtttgtgggaagctgtttattgcatgagcagtttatttttttaatgttttaatatagagaatgcccatgttcactaaatcccacaagtttgtttgtttgtttgtttgtttgtttgttttttaacttaaaggaaagtatgtattaaccagcacatacactatcctctttgtgctttatctctggtaatccttataagagcaccatgagttagatactgttttatgccctttttatggaaatagaatcttagagtgtacatttaagtagctctcccaggtataaccagctggaaaagtgacagaacctaggtctctcagattccagagattgcacacacgaatactatatcacactgcttactgctgtgagttcagcagagaattccttgtttatatggaaataacaaaattgatagtatccaggataattggcaacagtttacaaaccctctttacccccactttggtgattttaagtggggtcatctgtccactaaattaaacagatcttaggctggtcacacttctaaaattgtacaccaagtttgtgtgtaaaggtactttcccagggaaaaatatctgtagatttaatcaaattatccaaagagggttaggcccactacccagtgttccctggatgataagagaatgccatggagcctacacccttccagtgggaagaatagtgccaatttacttgccatttatgttctagtttttaatcagagtgttccagtcacacacacatagttagctatgaggaatatctgcagatgctggttcctccacttcaaacgagtcagctaactctaggtgaagagctttatactttggactatgtggttataaatgatgggcaggtaggataactagaacagtgtatatgctcattaatacatacttatcctttaagtctgaaaaaatgaacttgtggaattcagtgaaaattggcattctaaatattaaagtattaatatttagaattatagatttttagttgggatggtggtataaggaaggtcagcccattctcaaactgggttggaggcataagggacttgtttaacctaacctagtggtgtgaacctacaggaagtagtgatggtggactgagtcatgacttaggtaaagggagatgattctagatcatggaacatgatatagattctagacatgagattctaaactctggtaccaaggcacacattgctaagacaatctgtgatcatgtactctcaagaggatcatatatttcagctgtatagcgccaatttatgtgccagttacgttccagttataaatcaaagtgttctagtaacacacatagttaattatgaggactatctgcagatgcaggcttctccacttcaaacgagtcaaccaactccacctgaagaacttcatgctgctgcctatgtgtttacaaatgatgggcaggtaagataactctttctatttctgccctaattgtgacattcttcgtataattattttctcattggaaagatgaatataaactatatgtgttaattctcttgatttaaaagataaaatatgacacaggaaatcttatgtgaacataaaatgggaactttttgatccaagagtggattggttgtactaggaactgatttattttattttattttattttattttatttatatctttttttttttttttgagatggagtttcactcttgttgcccaggctggagtgcaatggcacgatctcagctcaccgcaacctccacttcccgggttcaagtgattctcctgccttagccttctgagtagctgggattacaggcatgcgccaccacacccagcttattttttgtatttttagtagagacagggtttctccattttggacaggctgctctcgaactcccgacctcaggtgatccgcccacctcgcctcccaaagtgctgggattacaggcatgagccaccgcacctggccgaactgatgtttttaattatcacatttaatgctcatagttgttctgcagatatgtattactatctaccctttaataagaaatcaaggctgacagtggtcaaatggcttgccccatgtgacacaagataggaggtagagccagggtttgaacgcatatctttctgactccagagtctatattctttcccactccccacaataactcctttaatatcgagattgcagtctacagtctctctttctgttatccaagtcactagtgctctgcctaaaaaaatgactaagtattcctcgtggaatatgaagcactaggtgatgttgccatgattggattgtcctgatggagatcttaatgtgagttttgtgttgtgtatgagagagacttactaacttcaccattagaacatgaagacaaaggagattgcatctgcactaggacacaattaggcaataatctcttctgtaacaaaaccagactaaagttattccaccacattcccaaaactcctcaattaattaggcttttccttaattttctgtgcctttattttctcttttttaacaatagtcataagaatcacacctcactcatagggattggccaaggattgagttaatacatgtaaagcattgagaacagtacctggagggtagtaaatgttcagtaaaaatgttttcacacattctccactctgcttttataggaaatgaaaatggtttggaaaattttttaatcaaaattatatatttgaatataattttcattaaatatgctcctgcatatttaatgcaagagcatattctttatttcttcaacttttactttaagtcctggggtacatgtgcaggatgtgcaggtttattacataggtaaacgtgtggcatggtggcttactgcacctatgaacccatcaccttggtattaagcccagcacccagtagctatttttcctgatgcattccctcccccaactcctcccccaacaggcccagtgtgtgttgccctgcccgacgtgtccatgtgttctcatcattcagctcccacttataagtgagaacacgtgctgtttggttttcttttcttgcgttagtttcctgatgataacggcttctagctccatccatgtttctgcaaaggacatgatctcattccttttttattttttttcttttttttgagacggagtcacgctctgtcgcccaggctggagtgcagtggcatgatctcggctcactgcaagctccgcctcccgggctcatgccattctcctgcctcagcctcccgagtagctggtactgcaagcgcccgccaccacacctggctaattttttttgtatttttagtagagacggggtttcaccgtgttagccaggatggtctccatctcctgacctcgtgatccgcccgccttggcctcccaaagtgctgggattacaggcgtgagccaccgcacccggccgatctcattcctttttatggctgcatagtattccgtggtgtatatgtactacattttctttatccagtctatcattgatgggcatttgggttgattccacatctttgctattgtgaatagtgctgcaatgaacatacatgtgcatgtatctttataatagaatgatttatatttctctgggtatatacccagtaatgagattgctggatcaaatgatatttctgcctctagatctttcaggaatcaccacactgtcatccacatggttgaagtaatttacactcccaccaacagtgtaaaagcagtcctttttctccacagccttgccagcatctgtagttttttgacgttttagtaatcgccattctgactggcatgagatgttatctcattgtggtttcgagttgcatttctctaatgatcagtgatgttgagctttttttcatatttttgttgcccgcgtgaatatcttcttttgagacgtgtctgttcatgtcctttgcccactttttaatggggttgtttggttttcttttgtaaatttgtttaagtttcttgtagactctggatagtagacctttgtcagatgggcagattgcaaaagttttctcccattctgtaggctgtctattcactctgatgatagtttattttgctatgcatatgctctttagtttaattagatcccatttgtcaacttttgcttttgttgccattgcttttggcatttttgtcatgaaatctttgccggtgcctatgtcctgaatagtattgcctatttttttttctagggtttgtatagttttgtgttctacatttaagtctttaatccatcttgagtaaatttttgtataaggtgtaaggaaggagcccagtttcaaattttgcatacagctagccagttctcccagcaccattaattaaatagggaatcctgtccccattgcttgtttttgtcaggtttgtcgaagatcagataattatcactgtgtgatcttatttccgagttctctattctgttccattggtccatgtatctgtttttctgccagcaccatgctgctttggttactgtagccctgtagtatagtttgaagttaggtagcgtgatgcctccagctttgttcttattgcttaggattgtcttggctattctggctcttttttcgttccatatgcattttaaaatagctccttctaacttggtgaagaatatcaatgatagtttaatggaaatagcattgaatttctaaattactttgggcagtatggccattttcacaatattgattcttcctatccatgagcatggaatgtttttccattcatttatttgctctctgatttccttgagcagtggtttgtagttctctctgaagaggtctttcacttcccttgttagccatattcctaggtaatttattctttttgtaggaattgttaatgggagttcattcatgatttgtctctctgcttgcctgtttttggtgtagaggaatgctagcaatttttgcacatggattttgtatcccgagactttgctgaaattgcttatcagcttaagaagcttttgggctgagacaacgggattttctagatatagggtcatgtcatctgcaaacaaaggtaatttgacttcctttctccctttttgaatactctttatttctttgccttgcccgattcccctggacagaacgtgtaatactatgttgaataggcgaggtgagggagggcatccttgttttgtgccagtttcaagggtaatgcttccaggtttttcccattcagtatgatattggctgtgggtttgtcatatatggctcttattattttgaggtatgttccttcaatacctggtttattgagagcttttaatataaggggatgttgaattttatcaaaggccttttctgcatctattgagataagcgtgtggtttttgtctttagttctgtttatgtgatgaattacattcattgattggcctattctgaaatgaccttgcatcccggggatgaagccaacttgatcatggggaataagctttttgatgtgctgctggattcagttttccagtattttattgaggattttgcatcgatgttcatcaggaatactggcctgaagtttttttttgttgtatctctgccaggttttggtatcagggtgatgctggtctcataaaatgagttaggtaggagtccctcctttttaattttttggaatagtttcggtagtaatattaccagctcttcttggtacctctagtaggcaggaacatattcttgggttatcctttgatgaaaacagcttttagttaacatacatactatacccttcattttcatgttttatttaccactaacattgtaaagctcgccctacccctacctgattccaagatcaacatatcggaatctccataaggttggaggtgggaaaatttatcttttcaatctatcctacccttcattatctatatgtatcatctaataaagtattaatgattattggttaataagtaactttaaagcactaaaagaggccgggtgtggtggctcgcacctgtaatcccagcactttgggaggccgaggtgggaggatcaggaggtcaggagatcaagaccatcctggctaacacggtgaaaccccatctctactaaaaatacaaaatagccgggcgtggtggcgggtgcctgtagtcccaggaactcgggaagctgaggcagtagaatggcgtgacttggggaagcagagcttgcagtgagccgagatcatgcaattgcaatccagcctgggcgacagagcaagactccgtctaaaaaaaaaaaaaaaaaaaaaaagcactaaaagataaaaaaggtatttctttttttttctcccctaacaagggctgagacaaaatgatgtgtacttcatgagagagataaccatatgtttatacctttggatgatgaaagccactcattccccaagcattctgatttatcatgactgtaccatgtttgactttggataacaccttgtattttaccttcccttgtttcactgagacttgactaaaattagcttgccttttctgagagcatcgtgtatgttcagggatgagaaatctttgacctgtgactaaaacttacattaatgatataaatgcatggctgtgtatgcatatgaagactgtgactttgcagtggttggatttgtctttaatggaatatgttcactgatgtttttcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaaggtgagggggaatccaatctttgggcctcaaccatgtcaaaggacatttgtagtcatgtccttgagggatgaacagatatgagcacatttgcaagtggaagggcaaggttctaattaggtgcaacaatttggagttgttgcaagcgttagatgaatgaagcaggttcctgaggcagaaggagatggtgggctcaacaagaggatgggtctgctcactttctgcctgtcctcacattccgctctaacccagtgtggtctggcttcttagtgtactccaatgaaactactatcatcaaggtcaccagtgtttgctacactttggcgttaatgtctcagcagcatgcgacacagttgtttactccctcctgcacggaaagcttcttgggtccccagacacctggatttcttaccctgttactagagactcattttccttctcttttttgtttttctcctctcccttcccacctctaaatatttcggaaccccaaagcttaatcctagactctcttctcttcagtatactatctatttaggcgatgccgtgctgtcttagaattttaaatgattcacactataagaactctcaccattatacttctacactacaacttgctcctgaaatccagactcaaatacgactacactcgcggtatctttactgggtgtctaataggcatgtaaaattcaactgactctacatgctcaaatttctgacctccctctctccaaaaatactctacttttagctttcactatttcaattaaagatactgtccattaggtgaaacatccacaaaggtgtaacaaccagctgttcacaggtatgggggattgaggaatcctggtttttacagtttgcagctatccatcgggcaaataatcccaccatggcctagttcaagctgtcaacataaggtcactgaaccagattcaggaagagttggcagcactcagctctcatggtcggttgcctaacacctcctgaacacccctggtgtacttttacttagtagttctagtcaaaatacttaaagtcacttatgagttatctcatgattcttttattactctctcatttcccatttcttagcaagtccagcagtagatgcccagtataaattctgcatccaaccatttctctctatgcctccagtgcatgctgccgtgatctgtctccaggctagtacaatgccttcttagctctgtgtttctaatcttcgctcatctatcgcatactctctaaccctgtggctagataattatttcagcacgtaaatcacatcatgccatgtccctcctgaaaacccatcctcatctctcctaagcactcagaacagaccctgaaccggctttggtctccaagcctctgcacagcctggcctctgtcaccctctcctaacatgggtcccatccatttcctcctggctctctctgcctctgaccttcacctctgtagtgcccggtccatccccactccattccctacccttggcctcactgcagcctggaactctccctctgcctctgcacaggaggctctgcttctttctccaagccctgcccaatggcacttcttcagaagcctctgccaaaccagctgcagccccaggggctccctctgctgctgtctcccacaggcctgtggactgcttttccaacaccagcccaatgctgcttgtttcatttgctcattgtgcatgtactgtctgactgccccatgaggatgtgagctccacaagggcagggaacgttgctccctgggctgtttactgctgatccctgggtcctggcatgctgcctgccacagatgatgaataaatgaaagaggcgtcagacctggagtgaaaagaaagtcactttttctagataaaagggaaggatctgtagaatcatataaaaatacagatgtgtgatgatggagtggtgataagagtgttcaactccaatagccacgtgtattttctcagagtatttggggtagaaaggaggcaggttaaggagggctcacttagtctggcttcctgctgtgcacagcatggcatttataggtgaactatacaaataatatcaagtgagaattatcatcttgctgcctatcaagggcagcaagatgatacaaaatgacgaatacaaaaacctgtgaatgtttattctgctgtcgtacttctttactgcatatattcattatgccaagaggtaaaaaggtagttttattgtattatctgacctgatctctgtcacaagatctgagatttccacgtggtaaatccttctgtttcatgaaataaataattctttagaacctgattaatacacagctgtccctctgggggaggatgggacaaaacacacctatcttgcagctcaacctcttcatttggtttccagctgctagcatcactcacaatgtccatgaagagaaggtaaaaaatggccaatctgcacacaataatgtcattgcaactgttccatcagtgcttattagtatggcagcagctggtatttcatccatgagtaccagggaccagtgtaaatttgctcacttgttatactgtcctacgaggattccactacgcaccatatatgcatagtgtcgtgagggaagaaggtaattttgttgtattatcttttctggcctcaattttagggttctcagattgctacctggtatatccttcttctttatgagataatttcctagatactgagcatcagtggggcatgcctgtgccattgacataatgcacttacctcacagctcaaccacttcatttggtttccagatgctgcagtcactcacagcatttgtgaagagaggataaataacggccaaccagtagctgataatgtcttgtcaactgctccaccatggcctggtaatatggcagcagcaggaatttcatccatgagtatgaaattcatccatgagtacttattaattgtactgtcctacttggtttccataagcaggcatattttcatgaattatagaaggtggttttgttgtatattctttcttagcctcaatttgaggggtatcagatggccagctggcatatcctcccctgcttttttagataatttcctagaaattgaacacagaggaatatacctgtggggttgacataatgcacttacctcacagctcaacctcttcacttggtttccacacgctactgtcaatcacagtgtccatgaggaggggatggaaaatggtcaaccccaacgagataatgtcatgtcaaatgttctatcagggcttattaatatgacaggagctggtattccagcgatgagtaccagggatctgtgtgtgtttgtttattagttgtagtgtcctccttggtttccatgtgcatgcataatgtcatgaagggaagaaggtggttttgttgaattatctttcgtgacctcaacttaagtggactcaaatcattatatgatgtattctcctgcattaggggataatttcctagaaaccgagcatcagtgggatatactggttcaattgtcataatgcacatacctcacaactcaacctgttccatcggtttccagatgctaccatcgctcacaatatccgtgaagagaggatggaaaatggccaatctcgaactgacaaagtcttgtcaactgctccaccacagcttgttcatatggctgcagctggtattccatccatgagtaccagggatctgcgtatgtctgctaattagttgtactgtcatacttgttttccataagcatggatattttcatgaaaggtagaagtcacttttgttgcatatactttcctagtctcaatttgaggggtctcagatggccacctggcaaatcctcccctgatttcctagataatttcctagaaactgagcatcagagggatatacctgttgggctgacatagtggacttacctcacagttcaaactcttcgtttgttttccagattcaactgttactcacattatctgtgaagagaagataaaaaatgaacaaatggcacctgataaattcttgtctactattacagcggggcttatgaatttcacaggggctgatattccacccctgagtaccagggatcagtgtgtgtttactagttgtactgacctacttgcttttcgtacgcatgcagtgtcatgcagggaagaaggtggtttcgttttattatcttttctggcctaaaattcaggggtctcaaatcaccacctgatatgtcctcctggtttatgggataatttcctagaaactgagcatcagagggatatacctgtggcactgacgtaatgcacttacctcacagcttgaactcttcatttggtttccagattctaccgtcactcacaatatccgtgaagagagaatggaaaatggccaaccccaacctgataacgtcttgtcaactggtcccacagggcttattaatatggcagcaactcctattccagccatgagtgccagagatctctgtatgtccacttataaattgtgctgtcttacttggttttcatatgcatacatagtgccatgaagggagttaggtggttttgttgtgttatcgtttctggcctaaatctgaggggtctcacatcaccacctgatatatcctactgctttatgaaataatttcatagaaactgagcaccagagggatatacttgtgagttggcataatgcacttacctcacagctcaacctcttcctttggtttccagatgctacagtcactcacaatgtctgtgaacagaagatggaaaatgtccaaccagcacctgataacgtgttgttgactcttcgaccacggcgtattaatatgacagacactggtatttcacccatgagtaccagggatccatgtaagtttgtttatttgtattactgtcctacttggtttccatatgcatgcatagtgtcaaaaagcatacaaggtggttttgttgtattgtcgttcctggtatttcacccatgagtaccagggatccatgtaagtttgtttatttgtattactgtcctacttggtttccatatgcatgcatagtgtcaaaaagcatacaaggtggttttgttgtattgtctttcctggcctcaatttcaggggtctcgtatggcaacctggtatatcctcctgtttatgagataatttcctagaaactgagcatcagagggatatacctgtggggttaccataatacacttacctaacagctcagcctcttcatttggtttccagatgctaccatcacttacaatgtccctgaggagaagatggaaaagggccaaccccaacctgataacatcttgtcaactgcttcaacagggcttattaatgtggcaggagctggtactccagccatcagcaccaatggcctgtgtatgtttgcttgttaattggattatcctgcttggtttccatatacgtgcatattgtcatgaaggggagatggaggttttgttgtatcatctatcttgagctcaatttgaggggtctcagatcaccacctgtcatgtcctcctgctttatgcaataatttcttagaagctgagcatcataggggtatacctgtggggctgacataatgcacttactcacagctcaacctcttcatttgttttccagattccaccgtccctcacaatgtctgtgaagagaagatggaaaatgaccaaccgcaacctaataacgtattgtcaactgttcaaccagtgattatttatttgacagcaactggtattccgggcatgaataccagggatcagtgtatgtttgtttactagttgtagtgtcctagttggtttacatatgaatgcacagtgtcataaagggaaggaggttgttttattggattctctttcatgagctcaatctgaggtgtctcagatcatcacttgctgtatcctcctgctttatgagttaatttcctagaccctgagcatcagagggatatacctgtagggctgacataatacacttagctcagagctcaagcttttcatttggtttccagatgctaccatcactcacaatgtctgtgaagagagagtggtaaataaccaaccactacctagtaacgccttgtcaactgttctaccagggcttgcttatttggcaacagctgatatgccagccatgagtaccagggatcagcgtaagtttgtttactagttgtggtgtcctacttggtttccatatgcatgcatattgtcatcaagggaagaagacggtattgttgtattatgttttctggcctcaattttagggttttcaattgctccctggtatatcctagttccttaggagataaattcctagatagtgagcatcagagggggtattcctgtgggattgacatactgcacttacctcacagctcatcaactacatttggtttccagatgctaccatcattcacaatctgcgtgaagagaagaaagataacagccaaccaacccctgataacgtcttgtcagctgttacaccagagcttattaacttggcaggagctggtattccacccatgagtaccagggatcagtgtatgtttgcttactagttgtactatcctacttggtttccatatgaatgcagtatcataaatggaagaatgtggttttattatattgtctttcgtgagttgaatttgtggggtctcagatcgctgcctggtatatcctcctgctttatgtgataaattcctagaaactgagcatcagagggatatatacatgtgtgcttggcataatgcacttaactcacagctcgacctctttatttggtttctagatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtgtatgtgtgttttttagttataccatcctccttgatttccatatgcatgcatagtgtcatgaagggaagaaggttgttttgtgaattatctttcctggcctcaatttgaggggcctcagatcatcatatgatgtattatcctgctttatgggataattttctaaaaattcatcatcagtgggatatatcggtggggttgacataatgcacgtacctcacagcttgacctctccctttggtttccagatgctaccattactcacagtgttcgtgaagagaagatggaaagtggcaaaccccaaactgataaggtcatatcaaatgatgcaccacagcttggtcatatggctgcaggtggtattccatccatgagtaccaaggatctgtgtatgtctgttaattagttgtactgtcatacttggtttacatatgcatgcatattttcatgaagggtagatgtggttttgtagtatattctttcctaacctcaatttgagggatctcagttgtccacatggcatatcctccccagctttcttagataatttcctagaaactgggtatcagaggaatatatctgcagggctgacataatgcacttacctcacagctcaacctcttcatgtggtttccagattttaccatcactcacaatgactgtgaagaaaagattaaaaattagcaaagagcacctgatacattattgtcaactgttacagcagggcttatgaatgtcacaggggctggtattccacccctgagtaccagggatcagtgtatgtttgtttactagtcgtactgtcctacttgacttccatacgcatgcagtgtcatgcagggaagaaggtggtttttttgcattatcgtttctggactaaatttgaggggtctcagatcaccacctgttatagcctcctgtgttatggaacaatttcttacaaactgaacatcagagggatatacctgtggtattgacataatgcacttacgtcacaagtcaacctctttatttggtttccagatgctaccgtcactcaaaatgtccatgaagagaggatggaaaataaccaaccacaacctagttatgacttgtcaactgttctaccaggacttacttatttgacagtagctggtattccggccatgagtaccagggatcagtgtatgtttgcttattcagttgtactgtcctacttggttttcatatgcatgcctagtgtcatgaataggagaaggtggttttgttgtattatctttcatgagttcaatttgagtgttctcagatcgccatctggcatatcctctccggctttatgatatacttttctagaagctgagcatcaggaagatatacctgtggggttgacataatgcacttaactcaaaacttaacctctttatttctgttccagatgctaccgtcactcacaatgtccatgaagagaagattaaaaatggccaagcagcatccgataatgtcttctcgactgttccaccagcatttattaatatggcagcaactggtgtttcatccatgagtaccagggatcagtgtaagtttattcacttgttgtactgtcatacttggtttccatatgcatgcatagtgtcatgagggaagaatgtagttttgttgtattaccttttcaggcctcaattttagggttctcagattgctacctggtatatcctccttcttaatgagataatttcctagatactgagcatcagaggggtatgcctgtgcggttgacataatgcacttacctcacgcccaacctcttcttttgtttccagatgctgcagtcactcacaacatccgtgaagagaagataaataacagccaaccagcacctggtaacatcttgtcaactgctcctccatggcttcgtcatatggcagcagctggaatttcatccacgattaccagggatctgtgtatgtctgcttattagttgtgctgtcctacttggtttccctaagcaggcatattttcatgaatggtagaaggtaattttgttgtatattctttcctagcctcagtttgaggggtatcatatgtccacctggcatatccttgccttcttttattgataacttcctagaaactgagcatctgagagatatacctatggggttgacataatgcacttacctcacggctcaatctcttcatttggtttccaaatgcaaccgttactcaccatgtccgtggagagaagataaaaaacggccaaccagcatctcataacttcttgttaacccttccatcagggcttattaatatagcaggagctaacatcccagccatgagtaccagggatctgtgtatgttttcttataagttgtactttcctacttgatttccatatgcatgcatagtgtcatcaagggaagaaggtggttttgcggtattacttttgcttgcctcaatttcagggtctctgattgccacctggtatatcctcctgctgtatgggataacgtcctggaaactgagcatcagcaggatatccctgtggggttgtcattatgcacttacttcacagctcagcctcttcattttgtttccagatgtcaccgccactcacagtgtccatgaggagaagatgacaaatggccaacaggcacctgataactccttgtcaacggttccacctggttgtattaatctgtcaggagctggtatttcatgcagaagtaccagggatctgtgtatgtttgtgtattggttgtactgtcctacttggtttccatatgcatgcatagtgtcctgcagggaagaaggtggttttgttgtattatcttactcaaacttagtttgaggggtcttggatcaccacctggtgtatcctcttgcttcatgagataactccctagaaactgggcatcggagggatatactgtgggggtgacataatgcacttatctcacagctcaattttttcatttggattccagatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaagtaagtactgcaagaatgtctatcaatgaaagcatgagaagtgtctcattctatgatttagaacagaattgagctgcctcttgagctcattgtttggctgaattggatctatatataatttagcatggctttactttaatttcactgaaaattgctaatatgtctgcttaagtgttttgttttcctttgttagtgttcacaatagtttccttagtaatatacagatgtcgtgatttaagcattcaaaacaagcactatgtaacattgtagcccatgaaaaatgtatactgtggtagtggatgcactaagattgaggtatatttcatttttgtaattgtagaaatactaatttttaaaatatcttcagattatgaaagaattttcattttgcttgaagaggtacaaggatctatgaaagtcaagagacaatttgttgaatttaccatcaaggaagcagcaaggtgagtgcaaaaaggaactgtgctattgttttaagcacttgcgcccaatttgggacaggggcaggaaaaaatcatggtttgttcctcctaatccctggccctcaatcatagttcatgctatttccacaggcatttaggttgatactatcttattctaacactttcttccaataccatggaggcttccaaatttatcaaaatctgggagtgtatgtgggccctcagttgactcactttgtatttttctagtttgtatctttcaatgaggatgcattttctgtttgcatgtagatggtaaattctattttgtatccactctacctcttacatctcatagatcctgtaggtatcctctggtgaatggaatacctctttaatttcaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaa

SEQ ID NO: 3768 - DNA, 23801 bp, human
ataagcagaggaatgcagaaccttctcacccagcgggatgaaatcgcctgggtaacatagtgagaccccggctctacagagcaaccaaccaaccaaaaaaacacacacaaaaattagctgggcatggtggcgtgtacctgtggtcccaactactcgggaagttgaggtgggaggatcgcttgaacccgggaggtggaggtagcagtgagccaagatcgtgccagtgcactctccatcccagaccatacagaagactccatcaaaaaaaaaagaaagaaagaaaaagaagcaacaacaacaacaaactgaaattttcatttgagggggttgttttttaaagtcaaccccgaccgggcgcagtggctcacgcctgtaatgtcagcaccttgggaggccgaagtgtctggatcacctgaggtcaggagtccaagaccagcatggccaacatggtgaatcccgtctctactaaaaatacagaaaattagccaggtgtggtggcacgcacctgtagtcccgctaaggaaggagaccactactactcctgctgccctcctccccctaccttgcctagttcacaagacaggaggaaagaaagaaagcaaaaagttggaaaaaaaaaaagtaaaataaatagccagacaaccttggcaccaccacccggccctaggagttaaaaaaagtgataataatttcaacccctgacctaaactacttgtgttatctctaaattccagacactgtatgaaaaaaagcattgtaaaacttattgttctgttagctgctgcatgtagcccccagtcacatttcccacacttgctcaatttatcacgactctttcacgtggaccccttaaagttgtaagcctctaaaaaggccaagaatttctttttcggggaactcagctcttatgatgcaagttggctgatgctcccagccgaataaaccacttccttctttaatccagtgcctgaggagttttgtctgcggctcatcctgctacatttcttggtttcctgattaacggacagtcgaggcagccccttaggcagctcatgcctgccctgtagagcatccctgctgggaactctggccagcttgagcgatgcagatcctgagagcgctccggggtaggcatttgcccctgtggaacgccttgtcagagcagtgcacagcaggcccccgcggaggatcaacgcagtggctgaacaccaggaaggaactggcactttaagtctggacatctaaaacttggtaagactggtctttggaacttgccgactccatttgagtggaagcatggccagatcacccacggtgtacctgtaccagccctttggtttttgtttttgacttgacttgaattgcttgataattttagttttgattttgacttgacttgaattgcttgataaaaaggcgtgcctttattggcactttggtttaccttccatggaatggaagacattattaagagacattattgttaattctctcagaatgaacataccaatcatttaaaattccaccgtgttaacaaaattttttctgaaaattgacaaacagataattgttttaagtatgtgcaaatcgaaggtttggtaaagctaagacaatctttaagaaaaagaactaagttggtaaatacacactactaaatatgagatttactataaaggtagagtaattaaaaccgtgtggtattggagcaatgacaggtaaatacaccaagggcagaggacacagaggccagaaacaatctggaaatggaaaatagctagatttaccacaggagagctcctgtaaatcattgtggaaagactagtgcttttaataaatgcacttcataaatgcagggaaaatacaaactttgattcttaccccatcccactgcagaaaacattattaaagatagatagtgaatccagtaaaaaatataagatattagctttacagctttagaataggccaaggtgtttttgattaggataaaaaaggtctaaccataaagaatacattgtttaattagacataattaaatgtaaaacttctattcctcaaaagacactcttaagagagtggaaaagcaaagcatatatgtagattacatattatataatgtataggataggttatatataaaaatatacattaatcatatataaatatatatagtatatataatataatattttatatatatacatatatatgtatctgacaacaactgagtggaatccagagtatatccagaactacaaatcaattttaaaagcaaacatcgcaataaaatttggggggaaaagctgaatatgcatatcataagagtcatactcaaatatacctttagtaatcacataaaatatacccggactctgactttactccattccatgaaaatttatttgaggtgaataggagatctagaagaaaacttagaatattatcgtcatggcattgggggaggcaaagattttcacttaaaataataaagagctctagccataaacaagactgattaataagattaagagaatctgttcatctaaaacacattattgagatagtgtaaaagcaaaacagatttgtagaagacattaaaattgtatatgtattttaatacatgtacatatatgcctgtgtgcatgtgtgtacaactgaaacccagaatatatgtaaactacaaatccatttttaaaatacaaacatctcaataaaatttggcagaaaagacctcaaagggaacttcctaaaagacatggttaaatgaccaataaacacatgaaaaagtgctccgaaaaaaaaaaaaacaataaatagctgggcgcagtggctcacgcctgtaatcccagcactttgggaggccgaattgggcagatcacttgagtccaggagttcgagaccagcctgggcaatttggcaaaaccccatctctactaaaaaatacaaagattagccaggcttggtggcatgcgcttgtagtcccagctactgaggcacgagaatcgagcgagcctgggagcccaaaaaacaatcaaaaatcgataaatgaacacttttaaaaagggtgctcaatctcattaattagcacaaaattgcaagtgtagacataaggagagatcactacactcccaaagagtggctggaatgaaagaataattgcacagtgagttgtgtgcatgtggcgaatctggaaccttcaaacatttctggaccccgattcctgcacagacatctgaggctatggctgaaaggtcagatagaatcccagggaagagctccctcaggactgagaaccaaccaaggaaaagcacccaaccctggggtgagacagagctcccaaggtcagctgggtgccctcgtggctgacacaagagttccccgagtcccaccacaggctcagagaatccaaggaacagcaccccactcccccacagcaccaggagacagcacccacagataataattttaaaaacccagcaccaagagaaagcgtctggtaagcgtccccatcagggataagcagaaccaaagaaaagccaacacatcctagctgagagcgagcaacatctaaggacaaatgtgccccacagccgagaacagcactcaaggaagagtccctcacaggctgagataaagcccgcgacagagagtgaccccatagggctgtgatcatgtgtccagggcacagccaccaccaccccggcccttgaacatagacagagctcccaaggcagagtcccccctcagggctgccaccgagcagggaagaaacacggccacacccgaggctgacacaggcaaccaaggcagggtccccaaccctgggcttaggtcatttcagcaggaaaagcccctcacatcactgagggagcccccaagaaaagccccccggacccacaacatagccgagatggggtgcccaaggaaaacgctcccccatggttgacacaggctcccatggcggtgtcctcagagtggagccactttcccagggaaccctaccacacacccgacagagaacacctcagaaaagacactttctgaggaaaaaggacactttcccgggcgaaattaaagcatccagggaaaaactgccccactcacagtcctgaagtcctgaccttgccggaggaggggcggcagcacctcacaaaatggcagtgaagttgtggcgcctccccactgttgtaactttgtagaaacttgccgtttgggagttatgggaaacgtgccccctcgcgtgcttgggagtgatgctcatggggaggcgtctcaccagaagcaccaatccggaaaggctcaaggcggatggaaggaagggaagctgaccgctttcgcgtgccctcccccagcctaacactgggaacctgtgtggggcgccagagtccggaagagaagttttgcgctcagcaggaccgctggcgccagcgggagaaccaggaagcgcagctctccccttagctgactctggtgctctctacaggtggccttcactatcaactgcacagcgggcagaggcagaggaacacagaaccttctcacacagcgggataaaagggtgaatttggagctgacaggcaaatatatcttgtgatatatttctctggctttgatatcagggtaatattggccgcatagaatgaagtagtgttcctccgttattttttggaagacattgctaagtactggtattatttcttccttaaatgtttgatagaatttgcacgcgaagccatcttggcttggcttgtatttctggggagattttaaattactaattaaatctcttttcatgctatagtcctaagtcgattttctacttattatttatttatttatttattcatttattttgagacggagtttcactcttgttgttcgctcttgttgcccggggtggagtgcaatggcatgatcttggctcacccaacctccgcctcccgggttcaagtgattctcctgcctcagcctcccaaatagctgggattacaggcatgcgccaccacgcccagctaattttgtatttgtagtagagacggagtttctccatgtttgtcaggctggtctcaaactcccaacctcaggtgatccgcccgccttggcctcccaaagtgctgggattacaggcgtgagccactgcacccagcctgtttcttcttgagtcggtaatttgtcttccaagaattttttccattttacctaagttgtttagtttgttggcgtaaagttgttcataatgtattccttttaatttctgtaaggtcagtattaataacccccctttcatttttgattttgataatctgtgtagtcctttctatttttcttggtcagtcaagctaaaagattgttagattttttttttcaccttttcggtgaaccaacttttgatttcattgatttttctgtttcttatttcattgattttcttctactctaattttcatcattcccctccttctgcttgcttgtattaaatacatcagtttaaaacttcaggaataacaaaagatttgtttcgcaaaggaagatttgaaatgttagacatgtagaaatgcttatgatattgcaagtagcagtcatttcgaccagttaaccagaaggaaattcggtgtgctgaaaccaaacaagtgtttttttgtgccgggcttttactgattttgaaaatatcaagtctagtttgtgggaagctgtttattgcatgagcagtttatttttttaatgttttaatatagagaatgcccatgttcactaaatcccacaagtttgtttgtttgtttgtttgtttgtttgttttttaacttaaaggaaagtatgtattaaccagcacatacactatcctctttgtgctttatctctggtaatccttataagagcaccatgagttagatactgttttatgccctttttatggaaatagaatcttagagtgtacatttaagtagctctcccaggtataaccagctggaaaagtgacagaacctaggtctctcagattccagagattgcacacacgaatactatatcacactgcttactgctgtgagttcagcagagaattccttgtttatatggaaataacaaaattgatagtatccaggataattggcaacagtttacaaaccctctttacccccactttggtgattttaagtggggtcatctgtccactaaattaaacagatcttaggctggtcacacttctaaaattgtacaccaagtttgtgtgtaaaggtactttcccagggaaaaatatctgtagatttaatcaaattatccaaagagggttaggcccactacccagtgttccctggatgataagagaatgccatggagcctacacccttccagtgggaagaatagtgccaatttacttgccatttatgttctagtttttaatcagagtgttccagtcacacacacatagttagctatgaggaatatctgcagatgctggttcctccacttcaaacgagtcagctaactctaggtgaagagctttatactttggactatgtggttataaatgatgggcaggtaggataactagaacagtgtatatgctcattaatacatacttatcctttaagtctgaaaaaatgaacttgtggaattcagtgaaaattggcattctaaatattaaagtattaatatttagaattatagatttttagttgggatggtggtataaggaaggtcagcccattctcaaactgggttggaggcataagggacttgtttaacctaacctagtggtgtgaacctacaggaagtagtgatggtggactgagtcatgacttaggtaaagggagatgattctagatcatggaacatgatatagattctagacatgagattctaaactctggtaccaaggcacacattgctaagacaatctgtgatcatgtactctcaagaggatcatatatttcagctgtatagcgccaatttatgtgccagttacgttccagttataaatcaaagtgttctagtaacacacatagttaattatgaggactatctgcagatgcaggcttctccacttcaaacgagtcaaccaactccacctgaagaacttcatgctgctgcctatgtgtttacaaatgatgggcaggtaagataactctttctatttctgccctaattgtgacattcttcgtataattattttctcattggaaagatgaatataaactatatgtgttaattctcttgatttaaaagataaaatatgacacaggaaatcttatgtgaacataaaatgggaactttttgatccaagagtggattggttgtactaggaactgatttattttattttattttattttattttatttatatctttttttttttttttgagatggagtttcactcttgttgcccaggctggagtgcaatggcacgatctcagctcaccgcaacctccacttcccgggttcaagtgattctcctgccttagccttctgagtagctgggattacaggcatgcgccaccacacccagcttattttttgtatttttagtagagacagggtttctccattttggacaggctgctctcgaactcccgacctcaggtgatccgcccacctcgcctcccaaagtgctgggattacaggcatgagccaccgcacctggccgaactgatgtttttaattatcacatttaatgctcatagttgttctgcagatatgtattactatctaccctttaataagaaatcaaggctgacagtggtcaaatggcttgccccatgtgacacaagataggaggtagagccagggtttgaacgcatatctttctgactccagagtctatattctttcccactccccacaataactcctttaatatcgagattgcagtctacagtctctctttctgttatccaagtcactagtgctctgcctaaaaaaatgactaagtattcctcgtggaatatgaagcactaggtgatgttgccatgattggattgtcctgatggagatcttaatgtgagttttgtgttgtgtatgagagagacttactaacttcaccattagaacatgaagacaaaggagattgcatctgcactaggacacaattaggcaataatctcttctgtaacaaaaccagactaaagttattccaccacattcccaaaactcctcaattaattaggcttttccttaattttctgtgcctttattttctcttttttaacaatagtcataagaatcacacctcactcatagggattggccaaggattgagttaatacatgtaaagcattgagaacagtacctggagggtagtaaatgttcagtaaaaatgttttcacacattctccactctgcttttataggaaatgaaaatggtttggaaaattttttaatcaaaattatatatttgaatataattttcattaaatatgctcctgcatatttaatgcaagagcatattctttatttcttcaacttttactttaagtcctggggtacatgtgcaggatgtgcaggtttattacataggtaaacgtgtggcatggtggcttactgcacctatgaacccatcaccttggtattaagcccagcacccagtagctatttttcctgatgcattccctcccccaactcctcccccaacaggcccagtgtgtgttgccctgcccgacgtgtccatgtgttctcatcattcagctcccacttataagtgagaacacgtgctgtttggttttcttttcttgcgttagtttcctgatgataacggcttctagctccatccatgtttctgcaaaggacatgatctcattccttttttattttttttcttttttttgagacggagtcacgctctgtcgcccaggctggagtgcagtggcatgatctcggctcactgcaagctccgcctcccgggctcatgccattctcctgcctcagcctcccgagtagctggtactgcaagcgcccgccaccacacctggctaattttttttgtatttttagtagagacggggtttcaccgtgttagccaggatggtctccatctcctgacctcgtgatccgcccgccttggcctcccaaagtgctgggattacaggcgtgagccaccgcacccggccgatctcattcctttttatggctgcatagtattccgtggtgtatatgtactacattttctttatccagtctatcattgatgggcatttgggttgattccacatctttgctattgtgaatagtgctgcaatgaacatacatgtgcatgtatctttataatagaatgatttatatttctctgggtatatacccagtaatgagattgctggatcaaatgatatttctgcctctagatctttcaggaatcaccacactgtcatccacatggttgaagtaatttacactcccaccaacagtgtaaaagcagtcctttttctccacagccttgccagcatctgtagttttttgacgttttagtaatcgccattctgactggcatgagatgttatctcattgtggtttcgagttgcatttctctaatgatcagtgatgttgagctttttttcatatttttgttgcccgcgtgaatatcttcttttgagacgtgtctgttcatgtcctttgcccactttttaatggggttgtttggttttcttttgtaaatttgtttaagtttcttgtagactctggatagtagacctttgtcagatgggcagattgcaaaagttttctcccattctgtaggctgtctattcactctgatgatagtttattttgctatgcatatgctctttagtttaattagatcccatttgtcaacttttgcttttgttgccattgcttttggcatttttgtcatgaaatctttgccggtgcctatgtcctgaatagtattgcctatttttttttctagggtttgtatagttttgtgttctacatttaagtctttaatccatcttgagtaaatttttgtataaggtgtaaggaaggagcccagtttcaaattttgcatacagctagccagttctcccagcaccattaattaaatagggaatcctgtccccattgcttgtttttgtcaggtttgtcgaagatcagataattatcactgtgtgatcttatttccgagttctctattctgttccattggtccatgtatctgtttttctgccagcaccatgctgctttggttactgtagccctgtagtatagtttgaagttaggtagcgtgatgcctccagctttgttcttattgcttaggattgtcttggctattctggctcttttttcgttccatatgcattttaaaatagctccttctaacttggtgaagaatatcaatgatagtttaatggaaatagcattgaatttctaaattactttgggcagtatggccattttcacaatattgattcttcctatccatgagcatggaatgtttttccattcatttatttgctctctgatttccttgagcagtggtttgtagttctctctgaagaggtctttcacttcccttgttagccatattcctaggtaatttattctttttgtaggaattgttaatgggagttcattcatgatttgtctctctgcttgcctgtttttggtgtagaggaatgctagcaatttttgcacatggattttgtatcccgagactttgctgaaattgcttatcagcttaagaagcttttgggctgagacaacgggattttctagatatagggtcatgtcatctgcaaacaaaggtaatttgacttcctttctccctttttgaatactctttatttctttgccttgcccgattcccctggacagaacgtgtaatactatgttgaataggcgaggtgagggagggcatccttgttttgtgccagtttcaagggtaatgcttccaggtttttcccattcagtatgatattggctgtgggtttgtcatatatggctcttattattttgaggtatgttccttcaatacctggtttattgagagcttttaatataaggggatgttgaattttatcaaaggccttttctgcatctattgagataagcgtgtggtttttgtctttagttctgtttatgtgatgaattacattcattgattggcctattctgaaatgaccttgcatcccggggatgaagccaacttgatcatggggaataagctttttgatgtgctgctggattcagttttccagtattttattgaggattttgcatcgatgttcatcaggaatactggcctgaagtttttttttgttgtatctctgccaggttttggtatcagggtgatgctggtctcataaaatgagttaggtaggagtccctcctttttaattttttggaatagtttcggtagtaatattaccagctcttcttggtacctctagtaggcaggaacatattcttgggttatcctttgatgaaaacagcttttagttaacatacatactatacccttcattttcatgttttatttaccactaacattgtaaagctcgccctacccctacctgattccaagatcaacatatcggaatctccataaggttggaggtgggaaaatttatcttttcaatctatcctacccttcattatctatatgtatcatctaataaagtattaatgattattggttaataagtaactttaaagcactaaaagaggccgggtgtggtggctcgcacctgtaatcccagcactttgggaggccgaggtgggaggatcaggaggtcaggagatcaagaccatcctggctaacacggtgaaaccccatctctactaaaaatacaaaatagccgggcgtggtggcgggtgcctgtagtcccaggaactcgggaagctgaggcagtagaatggcgtgacttggggaagcagagcttgcagtgagccgagatcatgcaattgcaatccagcctgggcgacagagcaagactccgtctaaaaaaaaaaaaaaaaaaaaaaagcactaaaagataaaaaaggtatttctttttttttctcccctaacaagggctgagacaaaatgatgtgtacttcatgagagagataaccatatgtttatacctttggatgatgaaagccactcattccccaagcattctgatttatcatgactgtaccatgtttgactttggataacaccttgtattttaccttcccttgtttcactgagacttgactaaaattagcttgccttttctgagagcatcgtgtatgttcagggatgagaaatctttgacctgtgactaaaacttacattaatgatataaatgcatggctgtgtatgcatatgaagactgtgactttgcagtggttggatttgtctttaatggaatatgttcactgatgtttttcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaaggtgagggggaatccaatctttgggcctcaaccatgtcaaaggacatttgtagtcatgtccttgagggatgaacagatatgagcacatttgcaagtggaagggcaaggttctaattaggtgcaacaatttggagttgttgcaagcgttagatgaatgaagcaggttcctgaggcagaaggagatggtgggctcaacaagaggatgggtctgctcactttctgcctgtcctcacattccgctctaacccagtgtggtctggcttcttagtgtactccaatgaaactactatcatcaaggtcaccagtgtttgctacactttggcgttaatgtctcagcagcatgcgacacagttgtttactccctcctgcacggaaagcttcttgggtccccagacacctggatttcttaccctgttactagagactcattttccttctcttttttgtttttctcctctcccttcccacctctaaatatttcggaaccccaaagcttaatcctagactctcttctcttcagtatactatctatttaggcgatgccgtgctgtcttagaattttaaatgattcacactataagaactctcaccattatacttctacactacaacttgctcctgaaatccagactcaaatacgactacactcgcggtatctttactgggtgtctaataggcatgtaaaattcaactgactctacatgctcaaatttctgacctccctctctccaaaaatactctacttttagctttcactatttcaattaaagatactgtccattaggtgaaacatccacaaaggtgtaacaaccagctgttcacaggtatgggggattgaggaatcctggtttttacagtttgcagctatccatcgggcaaataatcccaccatggcctagttcaagctgtcaacataaggtcactgaaccagattcaggaagagttggcagcactcagctctcatggtcggttgcctaacacctcctgaacacccctggtgtacttttacttagtagttctagtcaaaatacttaaagtcacttatgagttatctcatgattcttttattactctctcatttcccatttcttagcaagtccagcagtagatgcccagtataaattctgcatccaaccatttctctctatgcctccagtgcatgctgccgtgatctgtctccaggctagtacaatgccttcttagctctgtgtttctaatcttcgctcatctatcgcatactctctaaccctgtggctagataattatttcagcacgtaaatcacatcatgccatgtccctcctgaaaacccatcctcatctctcctaagcactcagaacagaccctgaaccggctttggtctccaagcctctgcacagcctggcctctgtcaccctctcctaacatgggtcccatccatttcctcctggctctctctgcctctgaccttcacctctgtagtgcccggtccatccccactccattccctacccttggcctcactgcagcctggaactctccctctgcctctgcacaggaggctctgcttctttctccaagccctgcccaatggcacttcttcagaagcctctgccaaaccagctgcagccccaggggctccctctgctgctgtctcccacaggcctgtggactgcttttccaacaccagcccaatgctgcttgtttcatttgctcattgtgcatgtactgtctgactgccccatgaggatgtgagctccacaagggcagggaacgttgctccctgggctgtttactgctgatccctgggtcctggcatgctgcctgccacagatgatgaataaatgaaagaggcgtcagacctggagtgaaaagaaagtcactttttctagataaaagggaaggatctgtagaatcatataaaaatacagatgtgtgatgatggagtggtgataagagtgttcaactccaatagccacgtgtattttctcagagtatttggggtagaaaggaggcaggttaaggagggctcacttagtctggcttcctgctgtgcacagcatggcatttataggtgaactatacaaataatatcaagtgagaattatcatcttgctgcctatcaagggcagcaagatgatacaaaatgacgaatacaaaaacctgtgaatgtttattctgctgtcgtacttctttactgcatatattcattatgccaagaggtaaaaaggtagttttattgtattatctgacctgatctctgtcacaagatctgagatttccacgtggtaaatccttctgtttcatgaaataaataattctttagaacctgattaatacacagctgtccctctgggggaggatgggacaaaacacacctatcttgcagctcaacctcttcatttggtttccagctgctagcatcactcacaatgtccatgaagagaaggtaaaaaatggccaatctgcacacaataatgtcattgcaactgttccatcagtgcttattagtatggcagcagctggtatttcatccatgagtaccagggaccagtgtaaatttgctcacttgttatactgtcctacgaggattccactacgcaccatatatgcatagtgtcgtgagggaagaaggtaattttgttgtattatcttttctggcctcaattttagggttctcagattgctacctggtatatccttcttctttatgagataatttcctagatactgagcatcagtggggcatgcctgtgccattgacataatgcacttacctcacagctcaaccacttcatttggtttccagatgctgcagtcactcacagcatttgtgaagagaggataaataacggccaaccagtagctgataatgtcttgtcaactgctccaccatggcctggtaatatggcagcagcaggaatttcatccatgagtatgaaattcatccatgagtacttattaattgtactgtcctacttggtttccataagcaggcatattttcatgaattatagaaggtggttttgttgtatattctttcttagcctcaatttgaggggtatcagatggccagctggcatatcctcccctgcttttttagataatttcctagaaattgaacacagaggaatatacctgtggggttgacataatgcacttacctcacagctcaacctcttcacttggtttccacacgctactgtcaatcacagtgtccatgaggaggggatggaaaatggtcaaccccaacgagataatgtcatgtcaaatgttctatcagggcttattaatatgacaggagctggtattccagcgatgagtaccagggatctgtgtgtgtttgtttattagttgtagtgtcctccttggtttccatgtgcatgcataatgtcatgaagggaagaaggtggttttgttgaattatctttcgtgacctcaacttaagtggactcaaatcattatatgatgtattctcctgcattaggggataatttcctagaaaccgagcatcagtgggatatactggttcaattgtcataatgcacatacctcacaactcaacctgttccatcggtttccagatgctaccatcgctcacaatatccgtgaagagaggatggaaaatggccaatctcgaactgacaaagtcttgtcaactgctccaccacagcttgttcatatggctgcagctggtattccatccatgagtaccagggatctgcgtatgtctgctaattagttgtactgtcatacttgttttccataagcatggatattttcatgaaaggtagaagtcacttttgttgcatatactttcctagtctcaatttgaggggtctcagatggccacctggcaaatcctcccctgatttcctagataatttcctagaaactgagcatcagagggatatacctgttgggctgacatagtggacttacctcacagttcaaactcttcgtttgttttccagattcaactgttactcacattatctgtgaagagaagataaaaaatgaacaaatggcacctgataaattcttgtctactattacagcggggcttatgaatttcacaggggctgatattccacccctgagtaccagggatcagtgtgtgtttactagttgtactgacctacttgcttttcgtacgcatgcagtgtcatgcagggaagaaggtggtttcgttttattatcttttctggcctaaaattcaggggtctcaaatcaccacctgatatgtcctcctggtttatgggataatttcctagaaactgagcatcagagggatatacctgtggcactgacgtaatgcacttacctcacagcttgaactcttcatttggtttccagattctaccgtcactcacaatatccgtgaagagagaatggaaaatggccaaccccaacctgataacgtcttgtcaactggtcccacagggcttattaatatggcagcaactcctattccagccatgagtgccagagatctctgtatgtccacttataaattgtgctgtcttacttggttttcatatgcatacatagtgccatgaagggagttaggtggttttgttgtgttatcgtttctggcctaaatctgaggggtctcacatcaccacctgatatatcctactgctttatgaaataatttcatagaaactgagcaccagagggatatacttgtgagttggcataatgcacttacctcacagctcaacctcttcctttggtttccagatgctacagtcactcacaatgtctgtgaacagaagatggaaaatgtccaaccagcacctgataacgtgttgttgactcttcgaccacggcgtattaatatgacagacactggtatttcacccatgagtaccagggatccatgtaagtttgtttatttgtattactgtcctacttggtttccatatgcatgcatagtgtcaaaaagcatacaaggtggttttgttgtattgtcgttcctggtatttcacccatgagtaccagggatccatgtaagtttgtttatttgtattactgtcctacttggtttccatatgcatgcatagtgtcaaaaagcatacaaggtggttttgttgtattgtctttcctggcctcaatttcaggggtctcgtatggcaacctggtatatcctcctgtttatgagataatttcctagaaactgagcatcagagggatatacctgtggggttaccataatacacttacctaacagctcagcctcttcatttggtttccagatgctaccatcacttacaatgtccctgaggagaagatggaaaagggccaaccccaacctgataacatcttgtcaactgcttcaacagggcttattaatgtggcaggagctggtactccagccatcagcaccaatggcctgtgtatgtttgcttgttaattggattatcctgcttggtttccatatacgtgcatattgtcatgaaggggagatggaggttttgttgtatcatctatcttgagctcaatttgaggggtctcagatcaccacctgtcatgtcctcctgctttatgcaataatttcttagaagctgagcatcataggggtatacctgtggggctgacataatgcacttactcacagctcaacctcttcatttgttttccagattccaccgtccctcacaatgtctgtgaagagaagatggaaaatgaccaaccgcaacctaataacgtattgtcaactgttcaaccagtgattatttatttgacagcaactggtattccgggcatgaataccagggatcagtgtatgtttgtttactagttgtagtgtcctagttggtttacatatgaatgcacagtgtcataaagggaaggaggttgttttattggattctctttcatgagctcaatctgaggtgtctcagatcatcacttgctgtatcctcctgctttatgagttaatttcctagaccctgagcatcagagggatatacctgtagggctgacataatacacttagctcagagctcaagcttttcatttggtttccagatgctaccatcactcacaatgtctgtgaagagagagtggtaaataaccaaccactacctagtaacgccttgtcaactgttctaccagggcttgcttatttggcaacagctgatatgccagccatgagtaccagggatcagcgtaagtttgtttactagttgtggtgtcctacttggtttccatatgcatgcatattgtcatcaagggaagaagacggtattgttgtattatgttttctggcctcaattttagggttttcaattgctccctggtatatcctagttccttaggagataaattcctagatagtgagcatcagagggggtattcctgtgggattgacatactgcacttacctcacagctcatcaactacatttggtttccagatgctaccatcattcacaatctgcgtgaagagaagaaagataacagccaaccaacccctgataacgtcttgtcagctgttacaccagagcttattaacttggcaggagctggtattccacccatgagtaccagggatcagtgtatgtttgcttactagttgtactatcctacttggtttccatatgaatgcagtatcataaatggaagaatgtggttttattatattgtctttcgtgagttgaatttgtggggtctcagatcgctgcctggtatatcctcctgctttatgtgataaattcctagaaactgagcatcagagggatatatacatgtgtgcttggcataatgcacttaactcacagctcgacctctttatttggtttctagatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtgtatgtgtgttttttagttataccatcctccttgatttccatatgcatgcatagtgtcatgaagggaagaaggttgttttgtgaattatctttcctggcctcaatttgaggggcctcagatcatcatatgatgtattatcctgctttatgggataattttctaaaaattcatcatcagtgggatatatcggtggggttgacataatgcacgtacctcacagcttgacctctccctttggtttccagatgctaccattactcacagtgttcgtgaagagaagatggaaagtggcaaaccccaaactgataaggtcatatcaaatgatgcaccacagcttggtcatatggctgcaggtggtattccatccatgagtaccaaggatctgtgtatgtctgttaattagttgtactgtcatacttggtttacatatgcatgcatattttcatgaagggtagatgtggttttgtagtatattctttcctaacctcaatttgagggatctcagttgtccacatggcatatcctccccagctttcttagataatttcctagaaactgggtatcagaggaatatatctgcagggctgacataatgcacttacctcacagctcaacctcttcatgtggtttccagattttaccatcactcacaatgactgtgaagaaaagattaaaaattagcaaagagcacctgatacattattgtcaactgttacagcagggcttatgaatgtcacaggggctggtattccacccctgagtaccagggatcagtgtatgtttgtttactagtcgtactgtcctacttgacttccatacgcatgcagtgtcatgcagggaagaaggtggtttttttgcattatcgtttctggactaaatttgaggggtctcagatcaccacctgttatagcctcctgtgttatggaacaatttcttacaaactgaacatcagagggatatacctgtggtattgacataatgcacttacgtcacaagtcaacctctttatttggtttccagatgctaccgtcactcaaaatgtccatgaagagaggatggaaaataaccaaccacaacctagttatgacttgtcaactgttctaccaggacttacttatttgacagtagctggtattccggccatgagtaccagggatcagtgtatgtttgcttattcagttgtactgtcctacttggttttcatatgcatgcctagtgtcatgaataggagaaggtggttttgttgtattatctttcatgagttcaatttgagtgttctcagatcgccatctggcatatcctctccggctttatgatatacttttctagaagctgagcatcaggaagatatacctgtggggttgacataatgcacttaactcaaaacttaacctctttatttctgttccagatgctaccgtcactcacaatgtccatgaagagaagattaaaaatggccaagcagcatccgataatgtcttctcgactgttccaccagcatttattaatatggcagcaactggtgtttcatccatgagtaccagggatcagtgtaagtttattcacttgttgtactgtcatacttggtttccatatgcatgcatagtgtcatgagggaagaatgtagttttgttgtattaccttttcaggcctcaattttagggttctcagattgctacctggtatatcctccttcttaatgagataatttcctagatactgagcatcagaggggtatgcctgtgcggttgacataatgcacttacctcacgcccaacctcttcttttgtttccagatgctgcagtcactcacaacatccgtgaagagaagataaataacagccaaccagcacctggtaacatcttgtcaactgctcctccatggcttcgtcatatggcagcagctggaatttcatccacgattaccagggatctgtgtatgtctgcttattagttgtgctgtcctacttggtttccctaagcaggcatattttcatgaatggtagaaggtaattttgttgtatattctttcctagcctcagtttgaggggtatcatatgtccacctggcatatccttgccttcttttattgataacttcctagaaactgagcatctgagagatatacctatggggttgacataatgcacttacctcacggctcaatctcttcatttggtttccaaatgcaaccgttactcaccatgtccgtggagagaagataaaaaacggccaaccagcatctcataacttcttgttaacccttccatcagggcttattaatatagcaggagctaacatcccagccatgagtaccagggatctgtgtatgttttcttataagttgtactttcctacttgatttccatatgcatgcatagtgtcatcaagggaagaaggtggttttgcggtattacttttgcttgcctcaatttcagggtctctgattgccacctggtatatcctcctgctgtatgggataacgtcctggaaactgagcatcagcaggatatccctgtggggttgtcattatgcacttacttcacagctcagcctcttcattttgtttccagatgtcaccgccactcacagtgtccatgaggagaagatgacaaatggccaacaggcacctgataactccttgtcaacggttccacctggttgtattaatctgtcaggagctggtatttcatgcagaagtaccagggatctgtgtatgtttgtgtattggttgtactgtcctacttggtttccatatgcatgcatagtgtcctgcagggaagaaggtggttttgttgtattatcttactcaaacttagtttgaggggtcttggatcaccacctggtgtatcctcttgcttcatgagataactccctagaaactgggcatcggagggatatactgtgggggtgacataatgcacttatctcacagctcaattttttcatttggattccagatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaagtaagtactgcaagaatgtctatcaatgaaagcatgagaagtgtctcattctatgatttagaacagaattgagctgcctcttgagctcattgtttggctgaattggatctatatataatttagcatggctttactttaatttcactgaaaattgctaatatgtctgcttaagtgttttgttttcctttgttagtgttcacaatagtttccttagtaatatacagatgtcgtgatttaagcattcaaaacaagcactatgtaacattgtagcccatgaaaaatgtatactgtggtagtggatgcactaagattgaggtatatttcatttttgtaattgtagaaatactaatttttaaaatatcttcagattatgaaagaattttcattttgcttgaagaggtacaaggatctatgaaagtcaagagacaatttgttgaatttaccatcaaggaagcagcaaggtgagtgcaaaaaggaactgtgctattgttttaagcacttgcgcccaatttgggacaggggcaggaaaaaatcatggtttgttcctcctaatccctggccctcaatcatagttcatgctatttccacaggcatttaggttgatactatcttattctaacactttcttccaataccatggaggcttccaaatttatcaaaatctgggagtgtatgtgggccctcagttgactcactttgtatttttctagtttgtatctttcaatgaggatgcattttctgtttgcatgtagatggtaaattctattttgtatccactctacctcttacatctcatagatcctgtaggtatcctctggtgaatggaatacctctttaatttcaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaa

SEQ ID NO: 3769 - DNA, 19434 bp, human
aggaccgctggcgccagcgggagaaccaggaagcgcagctctccccttagctgactctggtgctctctacaggtggccttcactatcaactgcacagcgggcagaggcagaggaacacagaaccttctcacacagcgggataaaagggtgaatttggagctgacaggcaaatatatcttgtgatatatttctctggctttgatatcagggtaatattggccgcatagaatgaagtagtgttcctccgttattttttggaagacattgctaagtactggtattatttcttccttaaatgtttgatagaatttgcacgcgaagccatcttggcttggcttgtatttctggggagattttaaattactaattaaatctcttttcatgctatagtcctaagtcgattttctacttattatttatttatttatttattcatttattttgagacggagtttcactcttgttgttcgctcttgttgcccggggtggagtgcaatggcatgatcttggctcacccaacctccgcctcccgggttcaagtgattctcctgcctcagcctcccaaatagctgggattacaggcatgcgccaccacgcccagctaattttgtatttgtagtagagacggagtttctccatgtttgtcaggctggtctcaaactcccaacctcaggtgatccgcccgccttggcctcccaaagtgctgggattacaggcgtgagccactgcacccagcctgtttcttcttgagtcggtaatttgtcttccaagaattttttccattttacctaagttgtttagtttgttggcgtaaagttgttcataatgtattccttttaatttctgtaaggtcagtattaataacccccctttcatttttgattttgataatctgtgtagtcctttctatttttcttggtcagtcaagctaaaagattgttagattttttttttcaccttttcggtgaaccaacttttgatttcattgatttttctgtttcttatttcattgattttcttctactctaattttcatcattcccctccttctgcttgcttgtattaaatacatcagtttaaaacttcaggaataacaaaagatttgtttcgcaaaggaagatttgaaatgttagacatgtagaaatgcttatgatattgcaagtagcagtcatttcgaccagttaaccagaaggaaattcggtgtgctgaaaccaaacaagtgtttttttgtgccgggcttttactgattttgaaaatatcaagtctagtttgtgggaagctgtttattgcatgagcagtttatttttttaatgttttaatatagagaatgcccatgttcactaaatcccacaagtttgtttgtttgtttgtttgtttgtttgttttttaacttaaaggaaagtatgtattaaccagcacatacactatcctctttgtgctttatctctggtaatccttataagagcaccatgagttagatactgttttatgccctttttatggaaatagaatcttagagtgtacatttaagtagctctcccaggtataaccagctggaaaagtgacagaacctaggtctctcagattccagagattgcacacacgaatactatatcacactgcttactgctgtgagttcagcagagaattccttgtttatatggaaataacaaaattgatagtatccaggataattggcaacagtttacaaaccctctttacccccactttggtgattttaagtggggtcatctgtccactaaattaaacagatcttaggctggtcacacttctaaaattgtacaccaagtttgtgtgtaaaggtactttcccagggaaaaatatctgtagatttaatcaaattatccaaagagggttaggcccactacccagtgttccctggatgataagagaatgccatggagcctacacccttccagtgggaagaatagtgccaatttacttgccatttatgttctagtttttaatcagagtgttccagtcacacacacatagttagctatgaggaatatctgcagatgctggttcctccacttcaaacgagtcagctaactctaggtgaagagctttatactttggactatgtggttataaatgatgggcaggtaggataactagaacagtgtatatgctcattaatacatacttatcctttaagtctgaaaaaatgaacttgtggaattcagtgaaaattggcattctaaatattaaagtattaatatttagaattatagatttttagttgggatggtggtataaggaaggtcagcccattctcaaactgggttggaggcataagggacttgtttaacctaacctagtggtgtgaacctacaggaagtagtgatggtggactgagtcatgacttaggtaaagggagatgattctagatcatggaacatgatatagattctagacatgagattctaaactctggtaccaaggcacacattgctaagacaatctgtgatcatgtactctcaagaggatcatatatttcagctgtatagcgccaatttatgtgccagttacgttccagttataaatcaaagtgttctagtaacacacatagttaattatgaggactatctgcagatgcaggcttctccacttcaaacgagtcaaccaactccacctgaagaacttcatgctgctgcctatgtgtttacaaatgatgggcaggtaagataactctttctatttctgccctaattgtgacattcttcgtataattattttctcattggaaagatgaatataaactatatgtgttaattctcttgatttaaaagataaaatatgacacaggaaatcttatgtgaacataaaatgggaactttttgatccaagagtggattggttgtactaggaactgatttattttattttattttattttattttatttatatctttttttttttttttgagatggagtttcactcttgttgcccaggctggagtgcaatggcacgatctcagctcaccgcaacctccacttcccgggttcaagtgattctcctgccttagccttctgagtagctgggattacaggcatgcgccaccacacccagcttattttttgtatttttagtagagacagggtttctccattttggacaggctgctctcgaactcccgacctcaggtgatccgcccacctcgcctcccaaagtgctgggattacaggcatgagccaccgcacctggccgaactgatgtttttaattatcacatttaatgctcatagttgttctgcagatatgtattactatctaccctttaataagaaatcaaggctgacagtggtcaaatggcttgccccatgtgacacaagataggaggtagagccagggtttgaacgcatatctttctgactccagagtctatattctttcccactccccacaataactcctttaatatcgagattgcagtctacagtctctctttctgttatccaagtcactagtgctctgcctaaaaaaatgactaagtattcctcgtggaatatgaagcactaggtgatgttgccatgattggattgtcctgatggagatcttaatgtgagttttgtgttgtgtatgagagagacttactaacttcaccattagaacatgaagacaaaggagattgcatctgcactaggacacaattaggcaataatctcttctgtaacaaaaccagactaaagttattccaccacattcccaaaactcctcaattaattaggcttttccttaattttctgtgcctttattttctcttttttaacaatagtcataagaatcacacctcactcatagggattggccaaggattgagttaatacatgtaaagcattgagaacagtacctggagggtagtaaatgttcagtaaaaatgttttcacacattctccactctgcttttataggaaatgaaaatggtttggaaaattttttaatcaaaattatatatttgaatataattttcattaaatatgctcctgcatatttaatgcaagagcatattctttatttcttcaacttttactttaagtcctggggtacatgtgcaggatgtgcaggtttattacataggtaaacgtgtggcatggtggcttactgcacctatgaacccatcaccttggtattaagcccagcacccagtagctatttttcctgatgcattccctcccccaactcctcccccaacaggcccagtgtgtgttgccctgcccgacgtgtccatgtgttctcatcattcagctcccacttataagtgagaacacgtgctgtttggttttcttttcttgcgttagtttcctgatgataacggcttctagctccatccatgtttctgcaaaggacatgatctcattccttttttattttttttcttttttttgagacggagtcacgctctgtcgcccaggctggagtgcagtggcatgatctcggctcactgcaagctccgcctcccgggctcatgccattctcctgcctcagcctcccgagtagctggtactgcaagcgcccgccaccacacctggctaattttttttgtatttttagtagagacggggtttcaccgtgttagccaggatggtctccatctcctgacctcgtgatccgcccgccttggcctcccaaagtgctgggattacaggcgtgagccaccgcacccggccgatctcattcctttttatggctgcatagtattccgtggtgtatatgtactacattttctttatccagtctatcattgatgggcatttgggttgattccacatctttgctattgtgaatagtgctgcaatgaacatacatgtgcatgtatctttataatagaatgatttatatttctctgggtatatacccagtaatgagattgctggatcaaatgatatttctgcctctagatctttcaggaatcaccacactgtcatccacatggttgaagtaatttacactcccaccaacagtgtaaaagcagtcctttttctccacagccttgccagcatctgtagttttttgacgttttagtaatcgccattctgactggcatgagatgttatctcattgtggtttcgagttgcatttctctaatgatcagtgatgttgagctttttttcatatttttgttgcccgcgtgaatatcttcttttgagacgtgtctgttcatgtcctttgcccactttttaatggggttgtttggttttcttttgtaaatttgtttaagtttcttgtagactctggatagtagacctttgtcagatgggcagattgcaaaagttttctcccattctgtaggctgtctattcactctgatgatagtttattttgctatgcatatgctctttagtttaattagatcccatttgtcaacttttgcttttgttgccattgcttttggcatttttgtcatgaaatctttgccggtgcctatgtcctgaatagtattgcctatttttttttctagggtttgtatagttttgtgttctacatttaagtctttaatccatcttgagtaaatttttgtataaggtgtaaggaaggagcccagtttcaaattttgcatacagctagccagttctcccagcaccattaattaaatagggaatcctgtccccattgcttgtttttgtcaggtttgtcgaagatcagataattatcactgtgtgatcttatttccgagttctctattctgttccattggtccatgtatctgtttttctgccagcaccatgctgctttggttactgtagccctgtagtatagtttgaagttaggtagcgtgatgcctccagctttgttcttattgcttaggattgtcttggctattctggctcttttttcgttccatatgcattttaaaatagctccttctaacttggtgaagaatatcaatgatagtttaatggaaatagcattgaatttctaaattactttgggcagtatggccattttcacaatattgattcttcctatccatgagcatggaatgtttttccattcatttatttgctctctgatttccttgagcagtggtttgtagttctctctgaagaggtctttcacttcccttgttagccatattcctaggtaatttattctttttgtaggaattgttaatgggagttcattcatgatttgtctctctgcttgcctgtttttggtgtagaggaatgctagcaatttttgcacatggattttgtatcccgagactttgctgaaattgcttatcagcttaagaagcttttgggctgagacaacgggattttctagatatagggtcatgtcatctgcaaacaaaggtaatttgacttcctttctccctttttgaatactctttatttctttgccttgcccgattcccctggacagaacgtgtaatactatgttgaataggcgaggtgagggagggcatccttgttttgtgccagtttcaagggtaatgcttccaggtttttcccattcagtatgatattggctgtgggtttgtcatatatggctcttattattttgaggtatgttccttcaatacctggtttattgagagcttttaatataaggggatgttgaattttatcaaaggccttttctgcatctattgagataagcgtgtggtttttgtctttagttctgtttatgtgatgaattacattcattgattggcctattctgaaatgaccttgcatcccggggatgaagccaacttgatcatggggaataagctttttgatgtgctgctggattcagttttccagtattttattgaggattttgcatcgatgttcatcaggaatactggcctgaagtttttttttgttgtatctctgccaggttttggtatcagggtgatgctggtctcataaaatgagttaggtaggagtccctcctttttaattttttggaatagtttcggtagtaatattaccagctcttcttggtacctctagtaggcaggaacatattcttgggttatcctttgatgaaaacagcttttagttaacatacatactatacccttcattttcatgttttatttaccactaacattgtaaagctcgccctacccctacctgattccaagatcaacatatcggaatctccataaggttggaggtgggaaaatttatcttttcaatctatcctacccttcattatctatatgtatcatctaataaagtattaatgattattggttaataagtaactttaaagcactaaaagaggccgggtgtggtggctcgcacctgtaatcccagcactttgggaggccgaggtgggaggatcaggaggtcaggagatcaagaccatcctggctaacacggtgaaaccccatctctactaaaaatacaaaatagccgggcgtggtggcgggtgcctgtagtcccaggaactcgggaagctgaggcagtagaatggcgtgacttggggaagcagagcttgcagtgagccgagatcatgcaattgcaatccagcctgggcgacagagcaagactccgtctaaaaaaaaaaaaaaaaaaaaaaagcactaaaagataaaaaaggtatttctttttttttctcccctaacaagggctgagacaaaatgatgtgtacttcatgagagagataaccatatgtttatacctttggatgatgaaagccactcattccccaagcattctgatttatcatgactgtaccatgtttgactttggataacaccttgtattttaccttcccttgtttcactgagacttgactaaaattagcttgccttttctgagagcatcgtgtatgttcagggatgagaaatctttgacctgtgactaaaacttacattaatgatataaatgcatggctgtgtatgcatatgaagactgtgactttgcagtggttggatttgtctttaatggaatatgttcactgatgtttttcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaaggtgagggggaatccaatctttgggcctcaaccatgtcaaaggacatttgtagtcatgtccttgagggatgaacagatatgagcacatttgcaagtggaagggcaaggttctaattaggtgcaacaatttggagttgttgcaagcgttagatgaatgaagcaggttcctgaggcagaaggagatggtgggctcaacaagaggatgggtctgctcactttctgcctgtcctcacattccgctctaacccagtgtggtctggcttcttagtgtactccaatgaaactactatcatcaaggtcaccagtgtttgctacactttggcgttaatgtctcagcagcatgcgacacagttgtttactccctcctgcacggaaagcttcttgggtccccagacacctggatttcttaccctgttactagagactcattttccttctcttttttgtttttctcctctcccttcccacctctaaatatttcggaaccccaaagcttaatcctagactctcttctcttcagtatactatctatttaggcgatgccgtgctgtcttagaattttaaatgattcacactataagaactctcaccattatacttctacactacaacttgctcctgaaatccagactcaaatacgactacactcgcggtatctttactgggtgtctaataggcatgtaaaattcaactgactctacatgctcaaatttctgacctccctctctccaaaaatactctacttttagctttcactatttcaattaaagatactgtccattaggtgaaacatccacaaaggtgtaacaaccagctgttcacaggtatgggggattgaggaatcctggtttttacagtttgcagctatccatcgggcaaataatcccaccatggcctagttcaagctgtcaacataaggtcactgaaccagattcaggaagagttggcagcactcagctctcatggtcggttgcctaacacctcctgaacacccctggtgtacttttacttagtagttctagtcaaaatacttaaagtcacttatgagttatctcatgattcttttattactctctcatttcccatttcttagcaagtccagcagtagatgcccagtataaattctgcatccaaccatttctctctatgcctccagtgcatgctgccgtgatctgtctccaggctagtacaatgccttcttagctctgtgtttctaatcttcgctcatctatcgcatactctctaaccctgtggctagataattatttcagcacgtaaatcacatcatgccatgtccctcctgaaaacccatcctcatctctcctaagcactcagaacagaccctgaaccggctttggtctccaagcctctgcacagcctggcctctgtcaccctctcctaacatgggtcccatccatttcctcctggctctctctgcctctgaccttcacctctgtagtgcccggtccatccccactccattccctacccttggcctcactgcagcctggaactctccctctgcctctgcacaggaggctctgcttctttctccaagccctgcccaatggcacttcttcagaagcctctgccaaaccagctgcagccccaggggctccctctgctgctgtctcccacaggcctgtggactgcttttccaacaccagcccaatgctgcttgtttcatttgctcattgtgcatgtactgtctgactgccccatgaggatgtgagctccacaagggcagggaacgttgctccctgggctgtttactgctgatccctgggtcctggcatgctgcctgccacagatgatgaataaatgaaagaggcgtcagacctggagtgaaaagaaagtcactttttctagataaaagggaaggatctgtagaatcatataaaaatacagatgtgtgatgatggagtggtgataagagtgttcaactccaatagccacgtgtattttctcagagtatttggggtagaaaggaggcaggttaaggagggctcacttagtctggcttcctgctgtgcacagcatggcatttataggtgaactatacaaataatatcaagtgagaattatcatcttgctgcctatcaagggcagcaagatgatacaaaatgacgaatacaaaaacctgtgaatgtttattctgctgtcgtacttctttactgcatatattcattatgccaagaggtaaaaaggtagttttattgtattatctgacctgatctctgtcacaagatctgagatttccacgtggtaaatccttctgtttcatgaaataaataattctttagaacctgattaatacacagctgtccctctgggggaggatgggacaaaacacacctatcttgcagctcaacctcttcatttggtttccagctgctagcatcactcacaatgtccatgaagagaaggtaaaaaatggccaatctgcacacaataatgtcattgcaactgttccatcagtgcttattagtatggcagcagctggtatttcatccatgagtaccagggaccagtgtaaatttgctcacttgttatactgtcctacgaggattccactacgcaccatatatgcatagtgtcgtgagggaagaaggtaattttgttgtattatcttttctggcctcaattttagggttctcagattgctacctggtatatccttcttctttatgagataatttcctagatactgagcatcagtggggcatgcctgtgccattgacataatgcacttacctcacagctcaaccacttcatttggtttccagatgctgcagtcactcacagcatttgtgaagagaggataaataacggccaaccagtagctgataatgtcttgtcaactgctccaccatggcctggtaatatggcagcagcaggaatttcatccatgagtatgaaattcatccatgagtacttattaattgtactgtcctacttggtttccataagcaggcatattttcatgaattatagaaggtggttttgttgtatattctttcttagcctcaatttgaggggtatcagatggccagctggcatatcctcccctgcttttttagataatttcctagaaattgaacacagaggaatatacctgtggggttgacataatgcacttacctcacagctcaacctcttcacttggtttccacacgctactgtcaatcacagtgtccatgaggaggggatggaaaatggtcaaccccaacgagataatgtcatgtcaaatgttctatcagggcttattaatatgacaggagctggtattccagcgatgagtaccagggatctgtgtgtgtttgtttattagttgtagtgtcctccttggtttccatgtgcatgcataatgtcatgaagggaagaaggtggttttgttgaattatctttcgtgacctcaacttaagtggactcaaatcattatatgatgtattctcctgcattaggggataatttcctagaaaccgagcatcagtgggatatactggttcaattgtcataatgcacatacctcacaactcaacctgttccatcggtttccagatgctaccatcgctcacaatatccgtgaagagaggatggaaaatggccaatctcgaactgacaaagtcttgtcaactgctccaccacagcttgttcatatggctgcagctggtattccatccatgagtaccagggatctgcgtatgtctgctaattagttgtactgtcatacttgttttccataagcatggatattttcatgaaaggtagaagtcacttttgttgcatatactttcctagtctcaatttgaggggtctcagatggccacctggcaaatcctcccctgatttcctagataatttcctagaaactgagcatcagagggatatacctgttgggctgacatagtggacttacctcacagttcaaactcttcgtttgttttccagattcaactgttactcacattatctgtgaagagaagataaaaaatgaacaaatggcacctgataaattcttgtctactattacagcggggcttatgaatttcacaggggctgatattccacccctgagtaccagggatcagtgtgtgtttactagttgtactgacctacttgcttttcgtacgcatgcagtgtcatgcagggaagaaggtggtttcgttttattatcttttctggcctaaaattcaggggtctcaaatcaccacctgatatgtcctcctggtttatgggataatttcctagaaactgagcatcagagggatatacctgtggcactgacgtaatgcacttacctcacagcttgaactcttcatttggtttccagattctaccgtcactcacaatatccgtgaagagagaatggaaaatggccaaccccaacctgataacgtcttgtcaactggtcccacagggcttattaatatggcagcaactcctattccagccatgagtgccagagatctctgtatgtccacttataaattgtgctgtcttacttggttttcatatgcatacatagtgccatgaagggagttaggtggttttgttgtgttatcgtttctggcctaaatctgaggggtctcacatcaccacctgatatatcctactgctttatgaaataatttcatagaaactgagcaccagagggatatacttgtgagttggcataatgcacttacctcacagctcaacctcttcctttggtttccagatgctacagtcactcacaatgtctgtgaacagaagatggaaaatgtccaaccagcacctgataacgtgttgttgactcttcgaccacggcgtattaatatgacagacactggtatttcacccatgagtaccagggatccatgtaagtttgtttatttgtattactgtcctacttggtttccatatgcatgcatagtgtcaaaaagcatacaaggtggttttgttgtattgtcgttcctggtatttcacccatgagtaccagggatccatgtaagtttgtttatttgtattactgtcctacttggtttccatatgcatgcatagtgtcaaaaagcatacaaggtggttttgttgtattgtctttcctggcctcaatttcaggggtctcgtatggcaacctggtatatcctcctgtttatgagataatttcctagaaactgagcatcagagggatatacctgtggggttaccataatacacttacctaacagctcagcctcttcatttggtttccagatgctaccatcacttacaatgtccctgaggagaagatggaaaagggccaaccccaacctgataacatcttgtcaactgcttcaacagggcttattaatgtggcaggagctggtactccagccatcagcaccaatggcctgtgtatgtttgcttgttaattggattatcctgcttggtttccatatacgtgcatattgtcatgaaggggagatggaggttttgttgtatcatctatcttgagctcaatttgaggggtctcagatcaccacctgtcatgtcctcctgctttatgcaataatttcttagaagctgagcatcataggggtatacctgtggggctgacataatgcacttactcacagctcaacctcttcatttgttttccagattccaccgtccctcacaatgtctgtgaagagaagatggaaaatgaccaaccgcaacctaataacgtattgtcaactgttcaaccagtgattatttatttgacagcaactggtattccgggcatgaataccagggatcagtgtatgtttgtttactagttgtagtgtcctagttggtttacatatgaatgcacagtgtcataaagggaaggaggttgttttattggattctctttcatgagctcaatctgaggtgtctcagatcatcacttgctgtatcctcctgctttatgagttaatttcctagaccctgagcatcagagggatatacctgtagggctgacataatacacttagctcagagctcaagcttttcatttggtttccagatgctaccatcactcacaatgtctgtgaagagagagtggtaaataaccaaccactacctagtaacgccttgtcaactgttctaccagggcttgcttatttggcaacagctgatatgccagccatgagtaccagggatcagcgtaagtttgtttactagttgtggtgtcctacttggtttccatatgcatgcatattgtcatcaagggaagaagacggtattgttgtattatgttttctggcctcaattttagggttttcaattgctccctggtatatcctagttccttaggagataaattcctagatagtgagcatcagagggggtattcctgtgggattgacatactgcacttacctcacagctcatcaactacatttggtttccagatgctaccatcattcacaatctgcgtgaagagaagaaagataacagccaaccaacccctgataacgtcttgtcagctgttacaccagagcttattaacttggcaggagctggtattccacccatgagtaccagggatcagtgtatgtttgcttactagttgtactatcctacttggtttccatatgaatgcagtatcataaatggaagaatgtggttttattatattgtctttcgtgagttgaatttgtggggtctcagatcgctgcctggtatatcctcctgctttatgtgataaattcctagaaactgagcatcagagggatatatacatgtgtgcttggcataatgcacttaactcacagctcgacctctttatttggtttctagatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtgtatgtgtgttttttagttataccatcctccttgatttccatatgcatgcatagtgtcatgaagggaagaaggttgttttgtgaattatctttcctggcctcaatttgaggggcctcagatcatcatatgatgtattatcctgctttatgggataattttctaaaaattcatcatcagtgggatatatcggtggggttgacataatgcacgtacctcacagcttgacctctccctttggtttccagatgctaccattactcacagtgttcgtgaagagaagatggaaagtggcaaaccccaaactgataaggtcatatcaaatgatgcaccacagcttggtcatatggctgcaggtggtattccatccatgagtaccaaggatctgtgtatgtctgttaattagttgtactgtcatacttggtttacatatgcatgcatattttcatgaagggtagatgtggttttgtagtatattctttcctaacctcaatttgagggatctcagttgtccacatggcatatcctccccagctttcttagataatttcctagaaactgggtatcagaggaatatatctgcagggctgacataatgcacttacctcacagctcaacctcttcatgtggtttccagattttaccatcactcacaatgactgtgaagaaaagattaaaaattagcaaagagcacctgatacattattgtcaactgttacagcagggcttatgaatgtcacaggggctggtattccacccctgagtaccagggatcagtgtatgtttgtttactagtcgtactgtcctacttgacttccatacgcatgcagtgtcatgcagggaagaaggtggtttttttgcattatcgtttctggactaaatttgaggggtctcagatcaccacctgttatagcctcctgtgttatggaacaatttcttacaaactgaacatcagagggatatacctgtggtattgacataatgcacttacgtcacaagtcaacctctttatttggtttccagatgctaccgtcactcaaaatgtccatgaagagaggatggaaaataaccaaccacaacctagttatgacttgtcaactgttctaccaggacttacttatttgacagtagctggtattccggccatgagtaccagggatcagtgtatgtttgcttattcagttgtactgtcctacttggttttcatatgcatgcctagtgtcatgaataggagaaggtggttttgttgtattatctttcatgagttcaatttgagtgttctcagatcgccatctggcatatcctctccggctttatgatatacttttctagaagctgagcatcaggaagatatacctgtggggttgacataatgcacttaactcaaaacttaacctctttatttctgttccagatgctaccgtcactcacaatgtccatgaagagaagattaaaaatggccaagcagcatccgataatgtcttctcgactgttccaccagcatttattaatatggcagcaactggtgtttcatccatgagtaccagggatcagtgtaagtttattcacttgttgtactgtcatacttggtttccatatgcatgcatagtgtcatgagggaagaatgtagttttgttgtattaccttttcaggcctcaattttagggttctcagattgctacctggtatatcctccttcttaatgagataatttcctagatactgagcatcagaggggtatgcctgtgcggttgacataatgcacttacctcacgcccaacctcttcttttgtttccagatgctgcagtcactcacaacatccgtgaagagaagataaataacagccaaccagcacctggtaacatcttgtcaactgctcctccatggcttcgtcatatggcagcagctggaatttcatccacgattaccagggatctgtgtatgtctgcttattagttgtgctgtcctacttggtttccctaagcaggcatattttcatgaatggtagaaggtaattttgttgtatattctttcctagcctcagtttgaggggtatcatatgtccacctggcatatccttgccttcttttattgataacttcctagaaactgagcatctgagagatatacctatggggttgacataatgcacttacctcacggctcaatctcttcatttggtttccaaatgcaaccgttactcaccatgtccgtggagagaagataaaaaacggccaaccagcatctcataacttcttgttaacccttccatcagggcttattaatatagcaggagctaacatcccagccatgagtaccagggatctgtgtatgttttcttataagttgtactttcctacttgatttccatatgcatgcatagtgtcatcaagggaagaaggtggttttgcggtattacttttgcttgcctcaatttcagggtctctgattgccacctggtatatcctcctgctgtatgggataacgtcctggaaactgagcatcagcaggatatccctgtggggttgtcattatgcacttacttcacagctcagcctcttcattttgtttccagatgtcaccgccactcacagtgtccatgaggagaagatgacaaatggccaacaggcacctgataactccttgtcaacggttccacctggttgtattaatctgtcaggagctggtatttcatgcagaagtaccagggatctgtgtatgtttgtgtattggttgtactgtcctacttggtttccatatgcatgcatagtgtcctgcagggaagaaggtggttttgttgtattatcttactcaaacttagtttgaggggtcttggatcaccacctggtgtatcctcttgcttcatgagataactccctagaaactgggcatcggagggatatactgtgggggtgacataatgcacttatctcacagctcaattttttcatttggattccagatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaagtaagtactgcaagaatgtctatcaatgaaagcatgagaagtgtctcattctatgatttagaacagaattgagctgcctcttgagctcattgtttggctgaattggatctatatataatttagcatggctttactttaatttcactgaaaattgctaatatgtctgcttaagtgttttgttttcctttgttagtgttcacaatagtttccttagtaatatacagatgtcgtgatttaagcattcaaaacaagcactatgtaacattgtagcccatgaaaaatgtatactgtggtagtggatgcactaagattgaggtatatttcatttttgtaattgtagaaatactaatttttaaaatatcttcagattatgaaagaattttcattttgcttgaagaggtacaaggatctatgaaagtcaagagacaatttgttgaatttaccatcaaggaagcagcaaggtgagtgcaaaaaggaactgtgctattgttttaagcacttgcgcccaatttgggacaggggcaggaaaaaatcatggtttgttcctcctaatccctggccctcaatcatagttcatgctatttccacaggcatttaggttgatactatcttattctaacactttcttccaataccatggaggcttccaaatttatcaaaatctgggagtgtatgtgggccctcagttgactcactttgtatttttctagtttgtatctttcaatgaggatgcattttctgtttgcatgtagatggtaaattctattttgtatccactctacctcttacatctcatagatcctgtaggtatcctctggtgaatggaatacctctttaatttcaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgc

SEQ ID NO: 3770 - DNA, 62945 bp, human
gtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggtgcgtgcctcggccttccctgggtttttggctcgatggggactaagaggcagtggggtggaggtgggggggatcgggagtgaaatgggggctctccatgttttcctgtgcgggggatggtggggagtgaggagggagtgaagggggggccctggttttgtcaccaaggatggcgggcagtggggggtggggcgaggtggggacacctcttggttctttcagccaggatagctagcaggggctgtggggagcgggtgaggatgaagcggtgggtcgactcccttggttttcccatcaaggatggcggggatcgtggaggggggagatgggagacctgccttgcttcgctcaacgaggatggcgggggtggcgacgaggagtagacgtgagggggcccgcctcggttttcttgactgggatgcttgtggggtggttggaggatgggggtggggtgcagaataaggagggagggggagggcccgctgtggttcttctgtccaagggggatggcgcgggtttggcgaatgggggtggggagggggtatttcagctccagcgtggaatctagagaagcacgaggaaggttctatcacgggggttgagccttagaaggtgggttttcaaaactgcagggcgtgacctctcccgcctcgaaaaacgtgaaatccttacaaggtgccgtctgttctaggctctgggacagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaagggcaggagatacatccttgtagcatttcgcttggttttgagaagagtagaagtagtagaataagcgtatgtatttgctggaagtccccttgtattcatttaaattatcccttcgggattatccgagccccctttgatttgggtttggaatagatccagttttcctaattggagccatcatcttgtaattgcttgtaattcttctctgggttatcaagtctatggcaagcttatagaacagcaggaataattttttccgtcatcttaagacagttttaatgtaaacgttacggtgttccttgcaaatgtgaacatttgcagaatagcacaagtttaaattatgggcccccctggaattttgtaaagcctttcctgcctcagctcatctccaagaaccgggccctcccgatccttacactgaagaagcaagagcttctgggatggtagctttgcctttacaaactcatgttcatgtttgcttaagaagaatacgtattaagcaggcatttgccttttatgtggtgagactatagtgttttcccatttttggttacataaggttccgatcaagtctttaccttcagtctttaaaaatgcttatttaacatttttaagggcaaatataatctttatgcaacaggaaattggtcagataggccatgatttgtgcaaaccacctcacgataagtacatagtctaagactatcatatagattctgtaaccatatatggtttttgaaattctaggctaccattcccatatttaattttcagaaaaggaaaatatttttttcagccaagtctagatttttgagtgaaactaagaaaaattgtgtaagatttaaattgataaaattcctcctgtataataccagtgcattggaggtaatttaatatatattaaatgaatcgaccgctaaaacaaaataattattttttttcctggaagtgttaaactggaaatgtttaaggggaaatagatttttagtcacaaagaccgacaaaaatgcatttatttacactattgtattataatgttagtatggtattcattctgtgcccccaaatagcaattgaaaaaatagcatatttttataataaaatttaagcataatgtttttttctctgaggagtagaatgcagaaagtggtaaaaaatcttttacagagagaagcatgttgataggaagtgggctttaagtttctctctggacagaaggtgtaaatggcgtatcttttacctggctttttgagaatctgttgccctctaggacatgaaagacatttcaggaattaacagaagtcggatcaaattctcttgctagatgttcttaaagattttgctgatacgcatttgaaaatttgtaaatcacgttttcatgtaagaaattaaccctcacctctaaagtttgagcattaaaaaagtttgttgaaggcatggaaggtaatctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactgaacttttttttgttaattgaactatctagttgtttggatttggggtaaaagggagtagactgtaattgttttttcttaaaagatcttttcttttagctcctgtgggacaagagcagagaaaggttcttttttggtcagtggtgtacttaattaagcagaatatatgacttttcgtttattcaacaaacatttgccgagttacctcctctgttggaggctccatgctaggtgtggagttatttggttgataagaaatggcttccacctttctggtgaagttatgaaaatgaaaaatagacagtgaatctgttgtgagtaatcaagaattgtctggagttttttggacagacaaaaaagatttcttgatgtttacattcagctttgtattactgtatagagtagggagaagtggatggccagcatcccttcctgcgacttaatgcatctctgatggcaaattgggcctccccaaaatatttttctggggtcaactttgaattatggatagtaatggatgatggagcccagaagagtggatagtcctaaatagtagctcgaataaacctttgaccttctacagggttgcttcctgagtgcctggagaaatcccctctttgtggatagtgccacactggtggttttcagccagggcgcttttgccccccggggtcactcaacaatttttgctagatgcactccactggcatccagttggtagagacagggatgctgcttaaatatccaacagcgcatagggcagtgcctggcggcaaacaaaattatccagcctgaaatgtcgatatgccgaggttgatgtaatttcctctacataatgtagcagaacataattccaggagagtagagaacaataacagcgtcttgaggtgactgagtagttggcggagctcactttattcgtctcaaaaatgactagtttcagccaggtgctgtggttcacgcctgtaatcccagtactttgggaggctgaggcaagcggatcacttgagcccaggagttcgagaccagtctggccaacatggcaaaatcctgtctctactaaaaatacaaagaattagccgggtgtggtggtgtgcgcctgtagtcccagctacttgggaggctgaggcacgagaatcgcttggacccaggaggcggaggttgctgtgagctgagattgcaccactgcactccagcctgggcgacagagtgagaccctgtctcaaaaacataaaataaataaataaaagtgactagttcctgcataccaacctgaagaattaaagaaaataacagctaccatttatggcacttactctgtgccagaggacttgtatacattatatattctcttcattttataaatgaggaaccacactcagagaggtagaagatcttgcctggagcctcacagctggtcaaggttagaagtagaaatcaagattaagattattactccttttaagttcatggttttaagcacaactatgcattatctcccttgcggcatgcatcattcaaaatcttatgtaacaaaatgaaaattactatatgtcctatataccattgggcttgcctgagagtaattaaaaccatgaatgctaaatgtgatcatacttggagtaagtgacaaggagtaggggaaaagggaaccaacattaattgaacacctactaaaatttcaggaagcacgcaaattaaatatatactcattgtctaatttgattctcagagcaactctgcagttatgatgcacattttacagatgagagtgggagatatttgttaagtaacttgtctaagattgcacaactaataagcagcaaggttgggatttgagatgatgtcccacaaccaagccactctttgctgcttactctaaaggtaggaagtaagttgagcctcttggagaaaggaaggtaactggctctgggtaaaaagtaacttcaggcagagcgcagtggcttacgcctgtaatcccagcactttgggaggccaagccgggcagatcacctgaggtcaggagttcaagaccagcctggccaacatggtgaaaccccgtcatggctaaaacacaaaaattagccaggcgtggtagtgggtgcctgtaatcccagctactcgggaggctgaggcaggaagaattgcttgaatccaggagtcggaggttgcagtgagccgagatagcgccactgtattccagcctgggcgacagagctagactccatctcaaaaaaaaaaaaaaaaaaaaaagtaatttgagaggtaacacgtagtagacgttggattatattcaggtagagaatggagagatgaattgctataccttcctcatctgataagaatcgaattctacctggaatttgttctagagatctactcaaattgaaacagtgattgtcattttgtcaaacttcattttctatctcacctgaattttccaagctgtgctttgataaccatgaacctggaagttatggaaatctgtgcttaacctttcggtagctcaccttccacctttcttagggctgtcctgtagaacttaggagtgacaacatttggtttttgtcttctttttacacaatttaaacatttgtgcttgctatggaaattgtttttataatacgcggcatcaaattcattcttgtgtttttcatatggggttgttttgttttgacaactaaatatttactttaagttttaacgtgttttgtttcggagcacaaaaagaggaaacatttaaaaaacagcccaatcacaatcattttgtctgaaaagcatttttttgcgggaggtgggggggggcaggaaaaggaccacatgtttaatttcatttgcttcaattggaaaggaattttaaccacgattctcaagggccaggatgctggaaaaaaatgttatttagataaaatgcctgttttgatatccacatagaactgtgagccatagattctgattataataataatgtcctgattctactacagcaatcagccacttgagtaatcaaccactgtgtatagacagacatgcatggtggtaccatctgatttgtcccatcacccattgattcattctagagtagacttgagagatctgatagaacttgcaagaatgaatgatccttttgaaaatcaaatttttcaataagaatggtacattttattgtaggaaaatgcagaaaatatagaaaagcttcaagaagaaaaccaaaatcagtcataatccaccaccccaaaattaatgacaatattttgtatgtcctttaaaaatggagtactttctaaaaatggtggattcaagcccattgcaaaacctccaacttatatagtgtgttatttttttttaaatgactagattttctgaacgactgctacatctctagatggaagtcatggtcataacccatgaaaagggaaagctgacaggtagttggagaactatgctatagcctcttcctggcagctatgtaaagaagcttaagggtagctccttcaaatttctcctcttccagcttgaatgatcaagtttcaatgctaaaagaggctgttagtacccaccccccattattttacagatgaggaaactgaggctcaaaggggtcaagcacctaatgtgctaacgtcagagttccagcttgaatttttagattgtcttcataggtaggtaaattttttatttcctaaagattcttcacagtcaaaaactttttcatggcctgaccctcaaaagaacaagctattgtggtgggagtatactataaaggatactaaaaggccaagtataataacttgctaatttcagaatatgttccgaacagctgtgggcagtacaggaatttttcatgttatttgctttattgtaattgaacatttagtgatggggaacctcttggatgggtctagctctcagtttaattttctctagcctatgaggcaagtgccaaggcatatgaagtatgcctataggtacaaaaatgaaagatgacattgaaagagtctttagacatggtagcctggaagatcgcaattagggcttttgctccatgaaagtatttttttcctttataaagggagatatctgttgaaattgtgggatagagattttaaagattgcatctgcttccaaactaaggtcaaaagttaaattgtagtaaatgtgtgcagtgtggtatcattaaactgtacacacatacgtgaaattgttgttttaatctggcatcttttttttttttttgagatggagtctccctgtgtcgcccaggctggagtgcagtggcgctctctcagctcactgcaacctccgcctcctagcatcaaccgattctcttgcctcagcctccctactagctgggattacaggcacgtgacaccacatcttgctaatgtttgtatttttagtagagacggggtttcaccatgttggccaggctggtctcaaactcctgacctcaggtgatccactcacctcggcctcccaaagtgctgggattacaggcgtgagccaccacgcccggccttaatctggcattcttaaaaaaatcagttatttagctttcttccccctcttctcctgccccatttcatttctttctgtagctgtgagggtcattctctctttgtatctgtttcactctcagggtgactcttttttcagtccacctgactgcactcactttcctttttccaggctctccgtggatccatatccttctatcacattcatctgccactgcatcttgcccttgtccccgtttgccagtgttaacaattaccccaccctgggctgggccagggctgtttttcagcttaggccgggcagggaagctgatctccagggcagatgtggagtgagaagagttgttgtcactctatacagaaatgtcattgacagaataggattaaacaaaatatgtacagagattacataggctatgtatacatgtaaacttgtgaacacaaaatcattccttctttacagctagggtcccagcaaatgctacagctacatgaaataatgagtatggatacctattgccgagggcttactatttgaacaagtgagagaattgtactcttgcctaggggtgtatttttaagtagtttttgctcctgttccttattattgcctgctaatggatacgtatattgtcagtaagtgaccaactctcctagcttcctgtagtacactgtatttctcttctgaaaatggattttcctctgtatttaaaccacagatttacttgtgcctcatttttgaactactatagataaaaactcacagataggaaatacctgtggactgtttgaaatgcagtgaaacctagaaaaaaaaaaacaatcaaaataataagtatctcctgtcggcattttactgcttgtagaattgatattctatttgcccacataaaatctctctggatgttattcctattgcaagacatagtagcttttcttcctgttccttattattgcctgctaatggatatgtacattgtcagtaagtgaccggctctccacagcttcctatagtacactatttctcttctgaaaatggattcctctgtatttaaactactgagatttatttgtgcctcatttttgaactactatagataaaaaaggcacagataggaaatacctgtggactgtttttgaaatgcattgaaacctagaaaaagaaaataacaatcaaaataataaatatctcttgtaagcattttactgtttctttttacccacataaaaactgtctggatgttattcctgttgcaagacattaaatgttctatagccttttttttttttttttgagacggagtttcgctcttgttgcccaggctggagtgcaatggtacaatcatggctcactacaacctctgcctccgggttcaagcgattctcctgcctcagcctcccaagtagctgggactacaggcacccaccaccatgcccagctaatttttgtatttttggtagtgacggggtttcactgtgttggtcaggctgatctcgaactcctgacatcaggtgatccgccctcctcggcctcccaaattgctgggattgcaggcgtgagctgttctgtagactttctaataacaagaatttgtaacagtcacaaggttttaaatttccttttcagtactaaggaaatgatagctgggaatgcaaaggctttattggcaagattgttttgacaaggatggcacaaaactaaatttctatacttgattaatttataagtcttgtcactcacttttagttttagagtgtggataaagctgtttgattcttgtcagatttgaaatgtatgatttatgagacattaaggattggtttttcagtgcactctgccaggtctagttttatgcgtcattctggtttgggaagctgagtgcaagtctgcctacagacataatcaatcacctgcactttcgggtggccaggtggactgaagtaacaggtttccccccaggtttctcagagactaaggaatacacacacacacacacacacacacacacacataggcagacctgcaaattatcggtccaaaaatatttatatcactaagccagagcagtggatttagacatttgacttaacaaaatttgtttttcaacacgttctagcaactaccctgtaaatgatcgtcatttcacctacaacaatgaaaagataaagtcctcagccgcatagcttctagaggctaaagaggcacgttaagttgcttgtcaaagactccacaccttcagatgccagggtcaacacaagttttcaaaccctagacccaatcccttctaggccacagaaggtctgcctcttgtaaggaaggaattttccaatgcactaagcacagctaatcacactaaggaaagaaaccaagcagccaaactaatatgaggaagtgaaagtttatacttgcatcttatagcagatggcctttgttagagccacttttaaaatatcaacttcaccgagcatgatttaggtacaaaaaccggcatccaattaaagcctccaatttgatgagtttagacagatgtatatacccatgaaaccactgccccaatcaggatgtggaatgtttttatcacctccacaagtttatccttgccccttttccagtaacattcttcccccagcccctttcccccagatatcccgttatgcttttgtgtgagagccactttcaaaactcagatttgaaagtttgtggatcttcctctataaaaagactatatttatgtccaaaatgcaattgtcttctctatgtttaaaataatactacagagaaattctaggtattgatttcctagaatctttccctcatcctctgcaagtaagctacttagtaaatagtttcattatgtacttgaattgaagagaaattacagccaagagaaaaacaattctgatagacagaaaagcagtgtatgttcttctcaagtagttacagtgaggtgttaaatccctcaagaaccagagaagtaaaatttgaattttgcttcgtacttatttgtaaagtaaaaatgaagactgagaataaaggttttatatgtatctatctgtctaatcattcatccatccacccatccctccagctagtgtgtgtatatatgtttctgtataaaattactatgtattaataaccctatcccttgaggattacaaaagatttgaaggcttcagagggaattttctgtgcatgaaaggtgtactgtctttacacacttaggtgcaaagcaagcttttcatatgctgttattactctcattgatatatttaattgaactaataattattgagcaatttaaaggctgctgcattgagatggagtttgtcccttcgtttgtcaccttctagaaaaatccaagtgtcaaaaaatatctcgctggctctctgttctgttgctattacttcggcatgcgtcgtctcctcttgccactctcgatttctactgtttctgccctatcttccttccctgattttcctcctccatgtctttcccgtatcctgatgccacttctcttgcactgctctgatttctcatgagaaagccatttttataaacatctccagaccgagagggcagcagactaattccaatgtgtcagatagcatcttggaggctgtttctcctgtgatccaacacttttttcacactcctttccagtttcgagctgtactggaaattggagagttgtgaaaggatggtttttggataatcaaagttgaatatacttgctgggctgtgttatgaccgtctttgaagccacgaatcattaaaaataagtgaatagtttacattataatattcctaggaaacttcctttgataattgtaaagcaattaaaattgtcctgagataaggtgatttattgtttttcagaatgggccataaagatattaaagaacccattcaacatttgtcaaaacccataaaatgcacaacgcaatgaatgaaccctaatgtaaaccctagactttagttcattataatgtattaacgttggcccatcaattgggacaaatgtaccacatcaatacaagatattaataataggggaaactgggagatggatgctaaggaggtatacagaaactcagtacttcctgcttagtttttctgtaaacctaaaactgctaaaaaaaaaaaaagtctactaattaaaaaaaaaaactcttcaaatgtatgggtttcagaaatacaaagactagatcaggagctttttattattaccgtgtggattaaagtctactgtttgtggccaggtacagtggctcatgcctgtaatcccagcaatctgggaggctgaggtgggtggatcacttaaggccaggagtttgagaccagcctggccaacatgatgaaaccctgtctctactgaaaatacaaaaattagccgggtgtggtggcatgtgcctgtattcccagctattcgggtggttgaggtgggagaatcacttaaacgcgggaggcagaggttgcggtgaaccgagatcacgccactgtactccaacctgggagacagagtgagaccctgtcttaaataaatacataaataaataaataaattccagtgtttgtttttcagaatgagtgaaataagagatgtgtttctccttgagtgatgtaacttgtggcacgagcccctgaaaaggggaagtatgaggttccaggagagctgcccagtacctccaatgctatgtctagttgcacaatagtcagtagataggtcagtgggagcagtgggttgggacttcgcttgccacccttgaaacatcatgccatctttgcagtggagtcccagatttggcaaattccctgccctacaacccagtgggccctcttttgacccttgcatttgtggtatcattagcaacagtgacagttggtgaacttatgccaactctgagccaatatccaggtcagagtttgattgctttgggccaaaggctattattgcatggcttgtagaagcataggcccaatgccagaacttccatgcacttactcagtatggccagctctacagtaaacgtgtgtgaaaagattcggtttttataggcattaatgtaaatagtttctttatattggacctgggtaactatgatgggcaattacaagtacccattgctttcctgagttggctatgagaacagaacattctgtggtacgtggtagtgggggtgaggggaggatcaggtctaagagggacattgcagctgcaaagggaaagaaaaaaactgagaagccatcaaggattagaaggcaaatgggagccatcactcaagcactgtgtatcttgaagtggttgtctgtcaggtctgtgataagacctggggtgaaaaacctcatagttcatgtgattatctgaaaaataccaataaagggaagagttgattatagagttcgcctgtttagtttttttgtttgtttgtttgttttttttgaaactgtgtcttgctctgtcacacaggctggaaaacagtgacgatcgtggctcactgcagtcttgacctcctgggcgcaaacaatccctctgcttcagcctcctgagtagctgggactgcaggtgtgcatcaccacacccatctaatgttttagtttcgtagaggcagggtctcgctatattgtccaggctggtctcaaactcatggcttgtttagcttattaaactttattttgtatattggaaataattctttgtgtacagatctgttaggtgtcctcattgttacatctattgttagacagaattttatttttcttaatttcattggttgcctgaattgactatatatgtggtaccacctgttaaaagcagattttgatgaggaaggggagaaagaggataaaaataacctctccctcaagtcccatttcatgatggaagctaggattccagttcagtggccaggctaaatggtcacttgatgccagtagtgagctactgccactggatttctttcagtcagcttcacaatcgacaccaaatcctgcagctgacgtgactttactgcaattcatgttgattggaaaaatggcaaaagtcaccatctaacccaatcataatatgtttgtttcccagatatagacaggctgggttcgtcattaggcctagtgtagtcatgctccctaactactgtgagtatctggaaggattggggaggtatagtggcagcggcttgtgggacaggcatgtgacagcatccttttgcccccttgctgctcacccacctgcttcttgccacctattggctcctctttgtcttcccctcattctgtcttctctttatccttaatccagttacttttgaattttctgttaaggaaccaggagagcctcagcatgaaaataattggcttaagtattcaaagtaccagagcaacatactttataattcttggactgcctgattgttactgctgcagtggtttgttgggtattaaatgagacttagggtattttgtaaacgttttctgacatacaatttgaaagttgaattttgtcaccttacaaacttagttattcctgcaacttttaaaacccccctaaattttccttatgtgttcatgattatccccatagcagataatggccacatgcgtgctgatatgaaggatttgctccagggctaattgatgggagcagagctgcccagttgctgaattgtaaggaaacagttcatggagcgccaatgccaatttaggaaaagtatggggctgagtacttagtaagatgaaataaaaaaatatttatccagtgcttactctaaggagaaggcacttggctaggtttgctagatgctgtggggagccttaaaacaacagtgatctcttcaaggccgggcgtggtggctcatgcctgtaatcccagcactttgggaggccgaggcaggcggatcacttgaggtcaggagtttgagaccagcatggacaatatggtgaaaccccgtttctactaaaaatacaaacattagctgggtgtggtggcatctgcctgtggtcccagctactcaggaggctgaggcaggaggatcacttgaacctgggatatggaggtggcagtgagatgagattgtgccactccactccagcctgggcgacagagagagaccctgtctcaaaaaaaaaaaaaaaaaaaaagtactagcgatctcttcaagcaaagaacgcccattctaattggagaagctgttaaagacacatgaaggatgtggtggaaagagtattgaactgcatagggtgtggggagagagtcaggagttttgaatcctagcctgagttctgccactaagcattggaaactctgggcaaatcatctccccactctgggtctcagtttataaaaaggcaaatgaacgagatcatctctaagatattctgtagattgattcataaatgtggaagagattctggaaaacggaagcttgagcccaggagttccagaccagcctgggcaacatggtgagactctgtctctacaaaaaatacaaaacattagcctggtgaggtgatgtgtgtttgtagtccctgtttctcaggaggctgaggtgggaggatcacatgggcccaggaggctgcagtgagctatcacctgggagcttgttagaaatgcaactttcatgggccccactccagacctagggaatcagaaacgctggggatggggccccgccatctgtgtcctaacaaggtcctctctcaggagattttgaggcacaataaagtctgacaattacaggctataggaatttgggtcagtggttctcagcctctgccatacaatagattcatctgggggaactttgttgggggtggggcgctgactttgtttgtgctgctgtaacagaatatctgagactggataccttataaagaacagaaatctatttctcacggttctggagactgggaagtcccaagatcaaggtgcaaacaggttcgattgttaagggctgctctctgcttccaagatgacactttagttctccagcctccagaggggaggaacgccctgccctcatgtggcggaaggcagaagggcaagagagccaaaggctctgttgaagctttaatcccatccaccagggaggagctctcccggtttaatcaccccacctcttagaggccccacctctcaataccatcacattgtccattaagattcaacacctgaatcttggacacatgaaaaccgtagcaggcacccaggcatcactagttgctttggctctccaggtgccgccaattttgagaatcactggtttaggggaaagtggcatgaaccaagacttctgtcattctctagctgcaatgaacgtcagatgcagggagtcagccaaagccagaggcttgaatttcactcaaagaaacttggcctttagattacaatggagaaaggtttttggcaatgggagtgatacatccgaggtggaacatttgagagatgattctgatgctagctatgtgaagaagagggcatacccatagttaagaaatctgatgaaatagtctggtgtgaagtgataatgggccaaattaggaccttagaaatgaaattataaggaagaaaatgtatgaaagctcttttgcaggaaaaatgggcagggtttggcgatggttgctggggtgacagcaatgttagaatgtctttggttcaggagtacctctcagacttctgggagggccagtgctctctagatgcatctggcaaaattgtcatgtatggatctgtacaattctttgttttttgttgctttgatttaggagttataatgcggaggtgacccacagcaagttatagaaaaatacagaattacagtcacctcaaaagctactcatggtcatcatgtcagagggaaaaaatgctgtttttcttttaaggaaagaatgcttggagttgtgggaaagttgtagacttggcaatgagtaattcaagcctatcagtcaattaagtgagtttttattttatcatttgttttatttgggagctgctgtaatagtcattgagaggacatcagtcttcatatttttaaaacaaaacaaaaataccattgaacattagggcaaaggacaagaatttcaaggtttttaccttttgacttcagcaaatatttgctgctccatttttcttgctagattttgccatttgacttgtgtttttcctttgttccaatttgttctttgtgcttgataactgtagtgtactctatttttttttttttgagacacagtcttgctcttttgcccaggttggagtacagtggtgcaatctcggctcactgcaacctctgcctcctggattcaagtgattctcgtgtctcggcctcccaagtagctggaattacaggcacgcaccaccatgtctggctcatttttgtattttcagtagagatggggcttcaccatgttggccaggctggtctcgacctcccaaagtgctgggattacaggcgtgcatcactgctccttgcctctattctattttcgatggcttttttattcataagtattcttaaggttttaatattccagttaaaaaataaatatatttgtccctttatgtttttccccaatatacttattcttcctttatgaccaaaaattattcaaatttgcatccagaaatggctcacagaaagagctccttggtatttatttagggcatggtgggaccttttgttagtttctaggtcatgccacatctggaaggaaagacaccttttatttactaatttgaaaatctatgaaagcagactcagtattttacagggttgcatatattcctatgcaaagttgcatatattcctatgcaaagttaaaaatgactcactactccaactttggtaaatgtgtgcactttagtttttgaaagaagtgcaaaaatctgcagaaaaatctggactaatcataacttgaaatttttagtatatctggtagataacttttaaaaatataacccatcttttcccaaactggatagggataattcctctctttgcaaattgtgaggaatattatgattgtatcatataaaataaatatagaaacgtgtagaataaatgatcttccagagtatatagaggatatcaccagataatactctgtactaaatataaggacacaaaactggactttattatatttctataactggtaatatccttccagtttttgcttgtttattaaatgaatatactgttaaagatttggttatgttgtagatcttaattatgttggaattattaaaaatgaggcatctttaatctgtactgcttatttccaataaattattttgccgaatgagagccagtttaccagttcttttgttaaagaaaatgagccagtggctacctcagttgtatttatcattgccttttatggtaaacatttaaaatgtgtttttaatggtgcacatgccgatgtttctgacctctatagtagcataagtatttgaataaaagtgaggtaaatgagaagtctgtgccacccagtctcatcacaagtgtacctaattaagaagatgtttggaattcactgttctttgatttcttgggtgggagagaatattctgaaggctgtgattaaggaatcgttaccatgacaatcacattcaaagaattgagaggagacaatgagtctgtgggggatcatctcttttgattgatttgactcttcttttaagttctttcaaacagctgttgtcactggattttcttttccacgtaattcacacaattgattggtgatgtggggatcattgaagcttggttgtcagtagtgataagggtcagcagtgtccatgaccacaatacttttgctaaacctggagagtgattgtatgtgttaaatgtcactaaaaagtaactcttggcttctttctggaataatatatgtggtttgtctattttcacttattaattttgtcagggtgggatatgattatcatgatctctttgaaagcatgactaactctaaagtgtttgagctttattttggattactttgctgtcatcttacccagtgttttgtgtgctgttttgtttttattctttaacttgcacaatgttgtcaacgtaatttatatgatgttctggtcagagacacagttacacgctgcagattgaaaagtacacacaaatatacccaccatgagtgcttcagcctcacgaccccagctcatgttaagtgggacatgctagtacagatgataaagtgaaatggagatacaaaggcagttcagatctgactgtcaatttttctcctttgtggactaattctgggtggtgaaaccatgaactatggaacgaagactgctccagcatgagtctgagttgaatcccatgtgagagctttgcctcctcagcctttgggcctttctttcttctgccctctggagggtgtcagagaacatgaaatgcaaggactttctggaaaggatagccagggtttggtctggtaactagaagacactttccctgccccttccccaccaccccctccaagccggaacatgtagaggtgaggagcagacagagagatggcagggaagccattggcaaggtgggaatcttaggaaggaagtgattccggttcttgaaaaagacaaccggattccattaagtagaatcggtatgaattgtactcatctctaggaaaaatcaattccagaagggtgagtaagatgaaatatgataagactagtgtgtgacagattcaggtttgaagcttaaggtggatggaatcgaaagaaaggtatatttggtgtcaagtgtttgtggcggcatgtgaaatcattatccacgtttgataacagtttgactctttgcctgctataataatagtagtaagtatgtatttaacattcaatgcgtaccttgtgtgggggaggcactgctaaatgctttgcatggacgtacctccttacctctatgaggtaggtggccattatgatgctcatagaggctggacagctaatatgaggcggagcctgtatttgggctcaggcagtctgactctggtgcccctgctgtgaagagctgtgccctgctgcattcctcctgtagctgcacgaaagggtgtggaatcttctagaaacagtgagttctatatgagtggagtgtggtggtgggagaatagatggagtaaagccttttgtgtaaacataccatgctaagtactgggagatagaaacgaaatgagagatttttttgttttgttttttgagatggagtcttgctctgtcgctcaggctggagtgcagtggtgcgatctcagatcaccgcaacctccaccttccaggttcaagcaattctcctgcctcagcctcctgagtacctgggactacagacacacgccaccacgccggctaatttttgtatttttttggtagagacggggtttcatcatgttggccaggatggtcttgatctcatgacctcgtgatccacccaccgcagcctcccaaagtgctgggattacaggtgccagccaccacacccagccaaaataagacatttctttgcccctgccaccaagatatttaacatcttacaggactaacaaaacctaacatgaaccagtccagattcatatgatagaatatgaaaatgttttctggaaagaatagccagagtcccagtctggttactagaagacactttccctgtcctttccccacctgtagcccttccaagctggaatgtgcagaggtgaggaacagacagagagatggcagggaagctattggcaaggtgggaatcttaggaaggaagtgattccggttcttgaaaaagagaaccggattccgtcaagtagaatcggtatgaattgtacccatctctaggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcagg

SEQ ID NO: 3771 - DNA, 60900 bp, human
cctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggtgcgtgcctcggccttccctgggtttttggctcgatggggactaagaggcagtggggtggaggtgggggggatcgggagtgaaatgggggctctccatgttttcctgtgcgggggatggtggggagtgaggagggagtgaagggggggccctggttttgtcaccaaggatggcgggcagtggggggtggggcgaggtggggacacctcttggttctttcagccaggatagctagcaggggctgtggggagcgggtgaggatgaagcggtgggtcgactcccttggttttcccatcaaggatggcggggatcgtggaggggggagatgggagacctgccttgcttcgctcaacgaggatggcgggggtggcgacgaggagtagacgtgagggggcccgcctcggttttcttgactgggatgcttgtggggtggttggaggatgggggtggggtgcagaataaggagggagggggagggcccgctgtggttcttctgtccaagggggatggcgcgggtttggcgaatgggggtggggagggggtatttcagctccagcgtggaatctagagaagcacgaggaaggttctatcacgggggttgagccttagaaggtgggttttcaaaactgcagggcgtgacctctcccgcctcgaaaaacgtgaaatccttacaaggtgccgtctgttctaggctctgggacagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaagggcaggagatacatccttgtagcatttcgcttggttttgagaagagtagaagtagtagaataagcgtatgtatttgctggaagtccccttgtattcatttaaattatcccttcgggattatccgagccccctttgatttgggtttggaatagatccagttttcctaattggagccatcatcttgtaattgcttgtaattcttctctgggttatcaagtctatggcaagcttatagaacagcaggaataattttttccgtcatcttaagacagttttaatgtaaacgttacggtgttccttgcaaatgtgaacatttgcagaatagcacaagtttaaattatgggcccccctggaattttgtaaagcctttcctgcctcagctcatctccaagaaccgggccctcccgatccttacactgaagaagcaagagcttctgggatggtagctttgcctttacaaactcatgttcatgtttgcttaagaagaatacgtattaagcaggcatttgccttttatgtggtgagactatagtgttttcccatttttggttacataaggttccgatcaagtctttaccttcagtctttaaaaatgcttatttaacatttttaagggcaaatataatctttatgcaacaggaaattggtcagataggccatgatttgtgcaaaccacctcacgataagtacatagtctaagactatcatatagattctgtaaccatatatggtttttgaaattctaggctaccattcccatatttaattttcagaaaaggaaaatatttttttcagccaagtctagatttttgagtgaaactaagaaaaattgtgtaagatttaaattgataaaattcctcctgtataataccagtgcattggaggtaatttaatatatattaaatgaatcgaccgctaaaacaaaataattattttttttcctggaagtgttaaactggaaatgtttaaggggaaatagatttttagtcacaaagaccgacaaaaatgcatttatttacactattgtattataatgttagtatggtattcattctgtgcccccaaatagcaattgaaaaaatagcatatttttataataaaatttaagcataatgtttttttctctgaggagtagaatgcagaaagtggtaaaaaatcttttacagagagaagcatgttgataggaagtgggctttaagtttctctctggacagaaggtgtaaatggcgtatcttttacctggctttttgagaatctgttgccctctaggacatgaaagacatttcaggaattaacagaagtcggatcaaattctcttgctagatgttcttaaagattttgctgatacgcatttgaaaatttgtaaatcacgttttcatgtaagaaattaaccctcacctctaaagtttgagcattaaaaaagtttgttgaaggcatggaaggtaatctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactgaacttttttttgttaattgaactatctagttgtttggatttggggtaaaagggagtagactgtaattgttttttcttaaaagatcttttcttttagctcctgtgggacaagagcagagaaaggttcttttttggtcagtggtgtacttaattaagcagaatatatgacttttcgtttattcaacaaacatttgccgagttacctcctctgttggaggctccatgctaggtgtggagttatttggttgataagaaatggcttccacctttctggtgaagttatgaaaatgaaaaatagacagtgaatctgttgtgagtaatcaagaattgtctggagttttttggacagacaaaaaagatttcttgatgtttacattcagctttgtattactgtatagagtagggagaagtggatggccagcatcccttcctgcgacttaatgcatctctgatggcaaattgggcctccccaaaatatttttctggggtcaactttgaattatggatagtaatggatgatggagcccagaagagtggatagtcctaaatagtagctcgaataaacctttgaccttctacagggttgcttcctgagtgcctggagaaatcccctctttgtggatagtgccacactggtggttttcagccagggcgcttttgccccccggggtcactcaacaatttttgctagatgcactccactggcatccagttggtagagacagggatgctgcttaaatatccaacagcgcatagggcagtgcctggcggcaaacaaaattatccagcctgaaatgtcgatatgccgaggttgatgtaatttcctctacataatgtagcagaacataattccaggagagtagagaacaataacagcgtcttgaggtgactgagtagttggcggagctcactttattcgtctcaaaaatgactagtttcagccaggtgctgtggttcacgcctgtaatcccagtactttgggaggctgaggcaagcggatcacttgagcccaggagttcgagaccagtctggccaacatggcaaaatcctgtctctactaaaaatacaaagaattagccgggtgtggtggtgtgcgcctgtagtcccagctacttgggaggctgaggcacgagaatcgcttggacccaggaggcggaggttgctgtgagctgagattgcaccactgcactccagcctgggcgacagagtgagaccctgtctcaaaaacataaaataaataaataaaagtgactagttcctgcataccaacctgaagaattaaagaaaataacagctaccatttatggcacttactctgtgccagaggacttgtatacattatatattctcttcattttataaatgaggaaccacactcagagaggtagaagatcttgcctggagcctcacagctggtcaaggttagaagtagaaatcaagattaagattattactccttttaagttcatggttttaagcacaactatgcattatctcccttgcggcatgcatcattcaaaatcttatgtaacaaaatgaaaattactatatgtcctatataccattgggcttgcctgagagtaattaaaaccatgaatgctaaatgtgatcatacttggagtaagtgacaaggagtaggggaaaagggaaccaacattaattgaacacctactaaaatttcaggaagcacgcaaattaaatatatactcattgtctaatttgattctcagagcaactctgcagttatgatgcacattttacagatgagagtgggagatatttgttaagtaacttgtctaagattgcacaactaataagcagcaaggttgggatttgagatgatgtcccacaaccaagccactctttgctgcttactctaaaggtaggaagtaagttgagcctcttggagaaaggaaggtaactggctctgggtaaaaagtaacttcaggcagagcgcagtggcttacgcctgtaatcccagcactttgggaggccaagccgggcagatcacctgaggtcaggagttcaagaccagcctggccaacatggtgaaaccccgtcatggctaaaacacaaaaattagccaggcgtggtagtgggtgcctgtaatcccagctactcgggaggctgaggcaggaagaattgcttgaatccaggagtcggaggttgcagtgagccgagatagcgccactgtattccagcctgggcgacagagctagactccatctcaaaaaaaaaaaaaaaaaaaaaagtaatttgagaggtaacacgtagtagacgttggattatattcaggtagagaatggagagatgaattgctataccttcctcatctgataagaatcgaattctacctggaatttgttctagagatctactcaaattgaaacagtgattgtcattttgtcaaacttcattttctatctcacctgaattttccaagctgtgctttgataaccatgaacctggaagttatggaaatctgtgcttaacctttcggtagctcaccttccacctttcttagggctgtcctgtagaacttaggagtgacaacatttggtttttgtcttctttttacacaatttaaacatttgtgcttgctatggaaattgtttttataatacgcggcatcaaattcattcttgtgtttttcatatggggttgttttgttttgacaactaaatatttactttaagttttaacgtgttttgtttcggagcacaaaaagaggaaacatttaaaaaacagcccaatcacaatcattttgtctgaaaagcatttttttgcgggaggtgggggggggcaggaaaaggaccacatgtttaatttcatttgcttcaattggaaaggaattttaaccacgattctcaagggccaggatgctggaaaaaaatgttatttagataaaatgcctgttttgatatccacatagaactgtgagccatagattctgattataataataatgtcctgattctactacagcaatcagccacttgagtaatcaaccactgtgtatagacagacatgcatggtggtaccatctgatttgtcccatcacccattgattcattctagagtagacttgagagatctgatagaacttgcaagaatgaatgatccttttgaaaatcaaatttttcaataagaatggtacattttattgtaggaaaatgcagaaaatatagaaaagcttcaagaagaaaaccaaaatcagtcataatccaccaccccaaaattaatgacaatattttgtatgtcctttaaaaatggagtactttctaaaaatggtggattcaagcccattgcaaaacctccaacttatatagtgtgttatttttttttaaatgactagattttctgaacgactgctacatctctagatggaagtcatggtcataacccatgaaaagggaaagctgacaggtagttggagaactatgctatagcctcttcctggcagctatgtaaagaagcttaagggtagctccttcaaatttctcctcttccagcttgaatgatcaagtttcaatgctaaaagaggctgttagtacccaccccccattattttacagatgaggaaactgaggctcaaaggggtcaagcacctaatgtgctaacgtcagagttccagcttgaatttttagattgtcttcataggtaggtaaattttttatttcctaaagattcttcacagtcaaaaactttttcatggcctgaccctcaaaagaacaagctattgtggtgggagtatactataaaggatactaaaaggccaagtataataacttgctaatttcagaatatgttccgaacagctgtgggcagtacaggaatttttcatgttatttgctttattgtaattgaacatttagtgatggggaacctcttggatgggtctagctctcagtttaattttctctagcctatgaggcaagtgccaaggcatatgaagtatgcctataggtacaaaaatgaaagatgacattgaaagagtctttagacatggtagcctggaagatcgcaattagggcttttgctccatgaaagtatttttttcctttataaagggagatatctgttgaaattgtgggatagagattttaaagattgcatctgcttccaaactaaggtcaaaagttaaattgtagtaaatgtgtgcagtgtggtatcattaaactgtacacacatacgtgaaattgttgttttaatctggcatcttttttttttttttgagatggagtctccctgtgtcgcccaggctggagtgcagtggcgctctctcagctcactgcaacctccgcctcctagcatcaaccgattctcttgcctcagcctccctactagctgggattacaggcacgtgacaccacatcttgctaatgtttgtatttttagtagagacggggtttcaccatgttggccaggctggtctcaaactcctgacctcaggtgatccactcacctcggcctcccaaagtgctgggattacaggcgtgagccaccacgcccggccttaatctggcattcttaaaaaaatcagttatttagctttcttccccctcttctcctgccccatttcatttctttctgtagctgtgagggtcattctctctttgtatctgtttcactctcagggtgactcttttttcagtccacctgactgcactcactttcctttttccaggctctccgtggatccatatccttctatcacattcatctgccactgcatcttgcccttgtccccgtttgccagtgttaacaattaccccaccctgggctgggccagggctgtttttcagcttaggccgggcagggaagctgatctccagggcagatgtggagtgagaagagttgttgtcactctatacagaaatgtcattgacagaataggattaaacaaaatatgtacagagattacataggctatgtatacatgtaaacttgtgaacacaaaatcattccttctttacagctagggtcccagcaaatgctacagctacatgaaataatgagtatggatacctattgccgagggcttactatttgaacaagtgagagaattgtactcttgcctaggggtgtatttttaagtagtttttgctcctgttccttattattgcctgctaatggatacgtatattgtcagtaagtgaccaactctcctagcttcctgtagtacactgtatttctcttctgaaaatggattttcctctgtatttaaaccacagatttacttgtgcctcatttttgaactactatagataaaaactcacagataggaaatacctgtggactgtttgaaatgcagtgaaacctagaaaaaaaaaaacaatcaaaataataagtatctcctgtcggcattttactgcttgtagaattgatattctatttgcccacataaaatctctctggatgttattcctattgcaagacatagtagcttttcttcctgttccttattattgcctgctaatggatatgtacattgtcagtaagtgaccggctctccacagcttcctatagtacactatttctcttctgaaaatggattcctctgtatttaaactactgagatttatttgtgcctcatttttgaactactatagataaaaaaggcacagataggaaatacctgtggactgtttttgaaatgcattgaaacctagaaaaagaaaataacaatcaaaataataaatatctcttgtaagcattttactgtttctttttacccacataaaaactgtctggatgttattcctgttgcaagacattaaatgttctatagccttttttttttttttttgagacggagtttcgctcttgttgcccaggctggagtgcaatggtacaatcatggctcactacaacctctgcctccgggttcaagcgattctcctgcctcagcctcccaagtagctgggactacaggcacccaccaccatgcccagctaatttttgtatttttggtagtgacggggtttcactgtgttggtcaggctgatctcgaactcctgacatcaggtgatccgccctcctcggcctcccaaattgctgggattgcaggcgtgagctgttctgtagactttctaataacaagaatttgtaacagtcacaaggttttaaatttccttttcagtactaaggaaatgatagctgggaatgcaaaggctttattggcaagattgttttgacaaggatggcacaaaactaaatttctatacttgattaatttataagtcttgtcactcacttttagttttagagtgtggataaagctgtttgattcttgtcagatttgaaatgtatgatttatgagacattaaggattggtttttcagtgcactctgccaggtctagttttatgcgtcattctggtttgggaagctgagtgcaagtctgcctacagacataatcaatcacctgcactttcgggtggccaggtggactgaagtaacaggtttccccccaggtttctcagagactaaggaatacacacacacacacacacacacacacacacataggcagacctgcaaattatcggtccaaaaatatttatatcactaagccagagcagtggatttagacatttgacttaacaaaatttgtttttcaacacgttctagcaactaccctgtaaatgatcgtcatttcacctacaacaatgaaaagataaagtcctcagccgcatagcttctagaggctaaagaggcacgttaagttgcttgtcaaagactccacaccttcagatgccagggtcaacacaagttttcaaaccctagacccaatcccttctaggccacagaaggtctgcctcttgtaaggaaggaattttccaatgcactaagcacagctaatcacactaaggaaagaaaccaagcagccaaactaatatgaggaagtgaaagtttatacttgcatcttatagcagatggcctttgttagagccacttttaaaatatcaacttcaccgagcatgatttaggtacaaaaaccggcatccaattaaagcctccaatttgatgagtttagacagatgtatatacccatgaaaccactgccccaatcaggatgtggaatgtttttatcacctccacaagtttatccttgccccttttccagtaacattcttcccccagcccctttcccccagatatcccgttatgcttttgtgtgagagccactttcaaaactcagatttgaaagtttgtggatcttcctctataaaaagactatatttatgtccaaaatgcaattgtcttctctatgtttaaaataatactacagagaaattctaggtattgatttcctagaatctttccctcatcctctgcaagtaagctacttagtaaatagtttcattatgtacttgaattgaagagaaattacagccaagagaaaaacaattctgatagacagaaaagcagtgtatgttcttctcaagtagttacagtgaggtgttaaatccctcaagaaccagagaagtaaaatttgaattttgcttcgtacttatttgtaaagtaaaaatgaagactgagaataaaggttttatatgtatctatctgtctaatcattcatccatccacccatccctccagctagtgtgtgtatatatgtttctgtataaaattactatgtattaataaccctatcccttgaggattacaaaagatttgaaggcttcagagggaattttctgtgcatgaaaggtgtactgtctttacacacttaggtgcaaagcaagcttttcatatgctgttattactctcattgatatatttaattgaactaataattattgagcaatttaaaggctgctgcattgagatggagtttgtcccttcgtttgtcaccttctagaaaaatccaagtgtcaaaaaatatctcgctggctctctgttctgttgctattacttcggcatgcgtcgtctcctcttgccactctcgatttctactgtttctgccctatcttccttccctgattttcctcctccatgtctttcccgtatcctgatgccacttctcttgcactgctctgatttctcatgagaaagccatttttataaacatctccagaccgagagggcagcagactaattccaatgtgtcagatagcatcttggaggctgtttctcctgtgatccaacacttttttcacactcctttccagtttcgagctgtactggaaattggagagttgtgaaaggatggtttttggataatcaaagttgaatatacttgctgggctgtgttatgaccgtctttgaagccacgaatcattaaaaataagtgaatagtttacattataatattcctaggaaacttcctttgataattgtaaagcaattaaaattgtcctgagataaggtgatttattgtttttcagaatgggccataaagatattaaagaacccattcaacatttgtcaaaacccataaaatgcacaacgcaatgaatgaaccctaatgtaaaccctagactttagttcattataatgtattaacgttggcccatcaattgggacaaatgtaccacatcaatacaagatattaataataggggaaactgggagatggatgctaaggaggtatacagaaactcagtacttcctgcttagtttttctgtaaacctaaaactgctaaaaaaaaaaaaagtctactaattaaaaaaaaaaactcttcaaatgtatgggtttcagaaatacaaagactagatcaggagctttttattattaccgtgtggattaaagtctactgtttgtggccaggtacagtggctcatgcctgtaatcccagcaatctgggaggctgaggtgggtggatcacttaaggccaggagtttgagaccagcctggccaacatgatgaaaccctgtctctactgaaaatacaaaaattagccgggtgtggtggcatgtgcctgtattcccagctattcgggtggttgaggtgggagaatcacttaaacgcgggaggcagaggttgcggtgaaccgagatcacgccactgtactccaacctgggagacagagtgagaccctgtcttaaataaatacataaataaataaataaattccagtgtttgtttttcagaatgagtgaaataagagatgtgtttctccttgagtgatgtaacttgtggcacgagcccctgaaaaggggaagtatgaggttccaggagagctgcccagtacctccaatgctatgtctagttgcacaatagtcagtagataggtcagtgggagcagtgggttgggacttcgcttgccacccttgaaacatcatgccatctttgcagtggagtcccagatttggcaaattccctgccctacaacccagtgggccctcttttgacccttgcatttgtggtatcattagcaacagtgacagttggtgaacttatgccaactctgagccaatatccaggtcagagtttgattgctttgggccaaaggctattattgcatggcttgtagaagcataggcccaatgccagaacttccatgcacttactcagtatggccagctctacagtaaacgtgtgtgaaaagattcggtttttataggcattaatgtaaatagtttctttatattggacctgggtaactatgatgggcaattacaagtacccattgctttcctgagttggctatgagaacagaacattctgtggtacgtggtagtgggggtgaggggaggatcaggtctaagagggacattgcagctgcaaagggaaagaaaaaaactgagaagccatcaaggattagaaggcaaatgggagccatcactcaagcactgtgtatcttgaagtggttgtctgtcaggtctgtgataagacctggggtgaaaaacctcatagttcatgtgattatctgaaaaataccaataaagggaagagttgattatagagttcgcctgtttagtttttttgtttgtttgtttgttttttttgaaactgtgtcttgctctgtcacacaggctggaaaacagtgacgatcgtggctcactgcagtcttgacctcctgggcgcaaacaatccctctgcttcagcctcctgagtagctgggactgcaggtgtgcatcaccacacccatctaatgttttagtttcgtagaggcagggtctcgctatattgtccaggctggtctcaaactcatggcttgtttagcttattaaactttattttgtatattggaaataattctttgtgtacagatctgttaggtgtcctcattgttacatctattgttagacagaattttatttttcttaatttcattggttgcctgaattgactatatatgtggtaccacctgttaaaagcagattttgatgaggaaggggagaaagaggataaaaataacctctccctcaagtcccatttcatgatggaagctaggattccagttcagtggccaggctaaatggtcacttgatgccagtagtgagctactgccactggatttctttcagtcagcttcacaatcgacaccaaatcctgcagctgacgtgactttactgcaattcatgttgattggaaaaatggcaaaagtcaccatctaacccaatcataatatgtttgtttcccagatatagacaggctgggttcgtcattaggcctagtgtagtcatgctccctaactactgtgagtatctggaaggattggggaggtatagtggcagcggcttgtgggacaggcatgtgacagcatccttttgcccccttgctgctcacccacctgcttcttgccacctattggctcctctttgtcttcccctcattctgtcttctctttatccttaatccagttacttttgaattttctgttaaggaaccaggagagcctcagcatgaaaataattggcttaagtattcaaagtaccagagcaacatactttataattcttggactgcctgattgttactgctgcagtggtttgttgggtattaaatgagacttagggtattttgtaaacgttttctgacatacaatttgaaagttgaattttgtcaccttacaaacttagttattcctgcaacttttaaaacccccctaaattttccttatgtgttcatgattatccccatagcagataatggccacatgcgtgctgatatgaaggatttgctccagggctaattgatgggagcagagctgcccagttgctgaattgtaaggaaacagttcatggagcgccaatgccaatttaggaaaagtatggggctgagtacttagtaagatgaaataaaaaaatatttatccagtgcttactctaaggagaaggcacttggctaggtttgctagatgctgtggggagccttaaaacaacagtgatctcttcaaggccgggcgtggtggctcatgcctgtaatcccagcactttgggaggccgaggcaggcggatcacttgaggtcaggagtttgagaccagcatggacaatatggtgaaaccccgtttctactaaaaatacaaacattagctgggtgtggtggcatctgcctgtggtcccagctactcaggaggctgaggcaggaggatcacttgaacctgggatatggaggtggcagtgagatgagattgtgccactccactccagcctgggcgacagagagagaccctgtctcaaaaaaaaaaaaaaaaaaaaagtactagcgatctcttcaagcaaagaacgcccattctaattggagaagctgttaaagacacatgaaggatgtggtggaaagagtattgaactgcatagggtgtggggagagagtcaggagttttgaatcctagcctgagttctgccactaagcattggaaactctgggcaaatcatctccccactctgggtctcagtttataaaaaggcaaatgaacgagatcatctctaagatattctgtagattgattcataaatgtggaagagattctggaaaacggaagcttgagcccaggagttccagaccagcctgggcaacatggtgagactctgtctctacaaaaaatacaaaacattagcctggtgaggtgatgtgtgtttgtagtccctgtttctcaggaggctgaggtgggaggatcacatgggcccaggaggctgcagtgagctatcacctgggagcttgttagaaatgcaactttcatgggccccactccagacctagggaatcagaaacgctggggatggggccccgccatctgtgtcctaacaaggtcctctctcaggagattttgaggcacaataaagtctgacaattacaggctataggaatttgggtcagtggttctcagcctctgccatacaatagattcatctgggggaactttgttgggggtggggcgctgactttgtttgtgctgctgtaacagaatatctgagactggataccttataaagaacagaaatctatttctcacggttctggagactgggaagtcccaagatcaaggtgcaaacaggttcgattgttaagggctgctctctgcttccaagatgacactttagttctccagcctccagaggggaggaacgccctgccctcatgtggcggaaggcagaagggcaagagagccaaaggctctgttgaagctttaatcccatccaccagggaggagctctcccggtttaatcaccccacctcttagaggccccacctctcaataccatcacattgtccattaagattcaacacctgaatcttggacacatgaaaaccgtagcaggcacccaggcatcactagttgctttggctctccaggtgccgccaattttgagaatcactggtttaggggaaagtggcatgaaccaagacttctgtcattctctagctgcaatgaacgtcagatgcagggagtcagccaaagccagaggcttgaatttcactcaaagaaacttggcctttagattacaatggagaaaggtttttggcaatgggagtgatacatccgaggtggaacatttgagagatgattctgatgctagctatgtgaagaagagggcatacccatagttaagaaatctgatgaaatagtctggtgtgaagtgataatgggccaaattaggaccttagaaatgaaattataaggaagaaaatgtatgaaagctcttttgcaggaaaaatgggcagggtttggcgatggttgctggggtgacagcaatgttagaatgtctttggttcaggagtacctctcagacttctgggagggccagtgctctctagatgcatctggcaaaattgtcatgtatggatctgtacaattctttgttttttgttgctttgatttaggagttataatgcggaggtgacccacagcaagttatagaaaaatacagaattacagtcacctcaaaagctactcatggtcatcatgtcagagggaaaaaatgctgtttttcttttaaggaaagaatgcttggagttgtgggaaagttgtagacttggcaatgagtaattcaagcctatcagtcaattaagtgagtttttattttatcatttgttttatttgggagctgctgtaatagtcattgagaggacatcagtcttcatatttttaaaacaaaacaaaaataccattgaacattagggcaaaggacaagaatttcaaggtttttaccttttgacttcagcaaatatttgctgctccatttttcttgctagattttgccatttgacttgtgtttttcctttgttccaatttgttctttgtgcttgataactgtagtgtactctatttttttttttttgagacacagtcttgctcttttgcccaggttggagtacagtggtgcaatctcggctcactgcaacctctgcctcctggattcaagtgattctcgtgtctcggcctcccaagtagctggaattacaggcacgcaccaccatgtctggctcatttttgtattttcagtagagatggggcttcaccatgttggccaggctggtctcgacctcccaaagtgctgggattacaggcgtgcatcactgctccttgcctctattctattttcgatggcttttttattcataagtattcttaaggttttaatattccagttaaaaaataaatatatttgtccctttatgtttttccccaatatacttattcttcctttatgaccaaaaattattcaaatttgcatccagaaatggctcacagaaagagctccttggtatttatttagggcatggtgggaccttttgttagtttctaggtcatgccacatctggaaggaaagacaccttttatttactaatttgaaaatctatgaaagcagactcagtattttacagggttgcatatattcctatgcaaagttgcatatattcctatgcaaagttaaaaatgactcactactccaactttggtaaatgtgtgcactttagtttttgaaagaagtgcaaaaatctgcagaaaaatctggactaatcataacttgaaatttttagtatatctggtagataacttttaaaaatataacccatcttttcccaaactggatagggataattcctctctttgcaaattgtgaggaatattatgattgtatcatataaaataaatatagaaacgtgtagaataaatgatcttccagagtatatagaggatatcaccagataatactctgtactaaatataaggacacaaaactggactttattatatttctataactggtaatatccttccagtttttgcttgtttattaaatgaatatactgttaaagatttggttatgttgtagatcttaattatgttggaattattaaaaatgaggcatctttaatctgtactgcttatttccaataaattattttgccgaatgagagccagtttaccagttcttttgttaaagaaaatgagccagtggctacctcagttgtatttatcattgccttttatggtaaacatttaaaatgtgtttttaatggtgcacatgccgatgtttctgacctctatagtagcataagtatttgaataaaagtgaggtaaatgagaagtctgtgccacccagtctcatcacaagtgtacctaattaagaagatgtttggaattcactgttctttgatttcttgggtgggagagaatattctgaaggctgtgattaaggaatcgttaccatgacaatcacattcaaagaattgagaggagacaatgagtctgtgggggatcatctcttttgattgatttgactcttcttttaagttctttcaaacagctgttgtcactggattttcttttccacgtaattcacacaattgattggtgatgtggggatcattgaagcttggttgtcagtagtgataagggtcagcagtgtccatgaccacaatacttttgctaaacctggagagtgattgtatgtgttaaatgtcactaaaaagtaactcttggcttctttctggaataatatatgtggtttgtctattttcacttattaattttgtcagggtgggatatgattatcatgatctctttgaaagcatgactaactctaaagtgtttgagctttattttggattactttgctgtcatcttacccagtgttttgtgtgctgttttgtttttattctttaacttgcacaatgttgtcaacgtaatttatatgatgttctggtcagagacacagttacacgctgcagattgaaaagtacacacaaatatacccaccatgagtgcttcagcctcacgaccccagctcatgttaagtgggacatgctagtacagatgataaagtgaaatggagatacaaaggcagttcagatctgactgtcaatttttctcctttgtggactaattctgggtggtgaaaccatgaactatggaacgaagactgctccagcatgagtctgagttgaatcccatgtgagagctttgcctcctcagcctttgggcctttctttcttctgccctctggagggtgtcagagaacatgaaatgcaaggactttctggaaaggatagccagggtttggtctggtaactagaagacactttccctgccccttccccaccaccccctccaagccggaacatgtagaggtgaggagcagacagagagatggcagggaagccattggcaaggtgggaatcttaggaaggaagtgattccggttcttgaaaaagacaaccggattccattaagtagaatcggtatgaattgtactcatctctaggaaaaatcaattccagaagggtgagtaagatgaaatatgataagactagtgtgtgacagattcaggtttgaagcttaaggtggatggaatcgaaagaaaggtatatttggtgtcaagtgtttgtggcggcatgtgaaatcattatccacgtttgataacagtttgactctttgcctgctataataatagtagtaagtatgtatttaacattcaatgcgtaccttgtgtgggggaggcactgctaaatgctttgcatggacgtacctccttacctctatgaggtaggtggccattatgatgctcatagaggctggacagctaatatgaggcggagcctgtatttgggctcaggcagtctgactctggtgcccctgctgtgaagagctgtgccctgctgcattcctcctgtagctgcacgaaagggtgtggaatcttctagaaacagtgagttctatatgagtggagtgtggtggtgggagaatagatggagtaaagccttttgtgtaaacataccatgctaagtactgggagatagaaacgaaatgagagatttttttgttttgttttttgagatggagtcttgctctgtcgctcaggctggagtgcagtggtgcgatctcagatcaccgcaacctccaccttccaggttcaagcaattctcctgcctcagcctcctgagtacctgggactacagacacacgccaccacgccggctaatttttgtatttttttggtagagacggggtttcatcatgttggccaggatggtcttgatctcatgacctcgtgatccacccaccgcagcctcccaaagtgctgggattacaggtgccagccaccacacccagccaaaataagacatttctttgcccctgccaccaagatatttaacatcttacaggactaacaaaacctaacatgaaccagtccagattcatatgatagaatatgaaaatgttttctggaaagaatagccagagtcccagtctggttactagaagacactttccctgtcctttccccacctgtagcccttccaagctggaatgtgcagaggtgaggaacagacagagagatggcagggaagctattggcaaggtgggaatcttaggaaggaagtgattccggttcttgaaaaagagaaccggattccgtcaagtagaatcggtatgaattgtacccatctctaggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggagg

SEQ ID NO: 3772 - DNA, 63894 bp, human
ccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggtgcgtgcctcggccttccctgggtttttggctcgatggggactaagaggcagtggggtggaggtgggggggatcgggagtgaaatgggggctctccatgttttcctgtgcgggggatggtggggagtgaggagggagtgaagggggggccctggttttgtcaccaaggatggcgggcagtggggggtggggcgaggtggggacacctcttggttctttcagccaggatagctagcaggggctgtggggagcgggtgaggatgaagcggtgggtcgactcccttggttttcccatcaaggatggcggggatcgtggaggggggagatgggagacctgccttgcttcgctcaacgaggatggcgggggtggcgacgaggagtagacgtgagggggcccgcctcggttttcttgactgggatgcttgtggggtggttggaggatgggggtggggtgcagaataaggagggagggggagggcccgctgtggttcttctgtccaagggggatggcgcgggtttggcgaatgggggtggggagggggtatttcagctccagcgtggaatctagagaagcacgaggaaggttctatcacgggggttgagccttagaaggtgggttttcaaaactgcagggcgtgacctctcccgcctcgaaaaacgtgaaatccttacaaggtgccgtctgttctaggctctgggacagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaagggcaggagatacatccttgtagcatttcgcttggttttgagaagagtagaagtagtagaataagcgtatgtatttgctggaagtccccttgtattcatttaaattatcccttcgggattatccgagccccctttgatttgggtttggaatagatccagttttcctaattggagccatcatcttgtaattgcttgtaattcttctctgggttatcaagtctatggcaagcttatagaacagcaggaataattttttccgtcatcttaagacagttttaatgtaaacgttacggtgttccttgcaaatgtgaacatttgcagaatagcacaagtttaaattatgggcccccctggaattttgtaaagcctttcctgcctcagctcatctccaagaaccgggccctcccgatccttacactgaagaagcaagagcttctgggatggtagctttgcctttacaaactcatgttcatgtttgcttaagaagaatacgtattaagcaggcatttgccttttatgtggtgagactatagtgttttcccatttttggttacataaggttccgatcaagtctttaccttcagtctttaaaaatgcttatttaacatttttaagggcaaatataatctttatgcaacaggaaattggtcagataggccatgatttgtgcaaaccacctcacgataagtacatagtctaagactatcatatagattctgtaaccatatatggtttttgaaattctaggctaccattcccatatttaattttcagaaaaggaaaatatttttttcagccaagtctagatttttgagtgaaactaagaaaaattgtgtaagatttaaattgataaaattcctcctgtataataccagtgcattggaggtaatttaatatatattaaatgaatcgaccgctaaaacaaaataattattttttttcctggaagtgttaaactggaaatgtttaaggggaaatagatttttagtcacaaagaccgacaaaaatgcatttatttacactattgtattataatgttagtatggtattcattctgtgcccccaaatagcaattgaaaaaatagcatatttttataataaaatttaagcataatgtttttttctctgaggagtagaatgcagaaagtggtaaaaaatcttttacagagagaagcatgttgataggaagtgggctttaagtttctctctggacagaaggtgtaaatggcgtatcttttacctggctttttgagaatctgttgccctctaggacatgaaagacatttcaggaattaacagaagtcggatcaaattctcttgctagatgttcttaaagattttgctgatacgcatttgaaaatttgtaaatcacgttttcatgtaagaaattaaccctcacctctaaagtttgagcattaaaaaagtttgttgaaggcatggaaggtaatctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactgaacttttttttgttaattgaactatctagttgtttggatttggggtaaaagggagtagactgtaattgttttttcttaaaagatcttttcttttagctcctgtgggacaagagcagagaaaggttcttttttggtcagtggtgtacttaattaagcagaatatatgacttttcgtttattcaacaaacatttgccgagttacctcctctgttggaggctccatgctaggtgtggagttatttggttgataagaaatggcttccacctttctggtgaagttatgaaaatgaaaaatagacagtgaatctgttgtgagtaatcaagaattgtctggagttttttggacagacaaaaaagatttcttgatgtttacattcagctttgtattactgtatagagtagggagaagtggatggccagcatcccttcctgcgacttaatgcatctctgatggcaaattgggcctccccaaaatatttttctggggtcaactttgaattatggatagtaatggatgatggagcccagaagagtggatagtcctaaatagtagctcgaataaacctttgaccttctacagggttgcttcctgagtgcctggagaaatcccctctttgtggatagtgccacactggtggttttcagccagggcgcttttgccccccggggtcactcaacaatttttgctagatgcactccactggcatccagttggtagagacagggatgctgcttaaatatccaacagcgcatagggcagtgcctggcggcaaacaaaattatccagcctgaaatgtcgatatgccgaggttgatgtaatttcctctacataatgtagcagaacataattccaggagagtagagaacaataacagcgtcttgaggtgactgagtagttggcggagctcactttattcgtctcaaaaatgactagtttcagccaggtgctgtggttcacgcctgtaatcccagtactttgggaggctgaggcaagcggatcacttgagcccaggagttcgagaccagtctggccaacatggcaaaatcctgtctctactaaaaatacaaagaattagccgggtgtggtggtgtgcgcctgtagtcccagctacttgggaggctgaggcacgagaatcgcttggacccaggaggcggaggttgctgtgagctgagattgcaccactgcactccagcctgggcgacagagtgagaccctgtctcaaaaacataaaataaataaataaaagtgactagttcctgcataccaacctgaagaattaaagaaaataacagctaccatttatggcacttactctgtgccagaggacttgtatacattatatattctcttcattttataaatgaggaaccacactcagagaggtagaagatcttgcctggagcctcacagctggtcaaggttagaagtagaaatcaagattaagattattactccttttaagttcatggttttaagcacaactatgcattatctcccttgcggcatgcatcattcaaaatcttatgtaacaaaatgaaaattactatatgtcctatataccattgggcttgcctgagagtaattaaaaccatgaatgctaaatgtgatcatacttggagtaagtgacaaggagtaggggaaaagggaaccaacattaattgaacacctactaaaatttcaggaagcacgcaaattaaatatatactcattgtctaatttgattctcagagcaactctgcagttatgatgcacattttacagatgagagtgggagatatttgttaagtaacttgtctaagattgcacaactaataagcagcaaggttgggatttgagatgatgtcccacaaccaagccactctttgctgcttactctaaaggtaggaagtaagttgagcctcttggagaaaggaaggtaactggctctgggtaaaaagtaacttcaggcagagcgcagtggcttacgcctgtaatcccagcactttgggaggccaagccgggcagatcacctgaggtcaggagttcaagaccagcctggccaacatggtgaaaccccgtcatggctaaaacacaaaaattagccaggcgtggtagtgggtgcctgtaatcccagctactcgggaggctgaggcaggaagaattgcttgaatccaggagtcggaggttgcagtgagccgagatagcgccactgtattccagcctgggcgacagagctagactccatctcaaaaaaaaaaaaaaaaaaaaaagtaatttgagaggtaacacgtagtagacgttggattatattcaggtagagaatggagagatgaattgctataccttcctcatctgataagaatcgaattctacctggaatttgttctagagatctactcaaattgaaacagtgattgtcattttgtcaaacttcattttctatctcacctgaattttccaagctgtgctttgataaccatgaacctggaagttatggaaatctgtgcttaacctttcggtagctcaccttccacctttcttagggctgtcctgtagaacttaggagtgacaacatttggtttttgtcttctttttacacaatttaaacatttgtgcttgctatggaaattgtttttataatacgcggcatcaaattcattcttgtgtttttcatatggggttgttttgttttgacaactaaatatttactttaagttttaacgtgttttgtttcggagcacaaaaagaggaaacatttaaaaaacagcccaatcacaatcattttgtctgaaaagcatttttttgcgggaggtgggggggggcaggaaaaggaccacatgtttaatttcatttgcttcaattggaaaggaattttaaccacgattctcaagggccaggatgctggaaaaaaatgttatttagataaaatgcctgttttgatatccacatagaactgtgagccatagattctgattataataataatgtcctgattctactacagcaatcagccacttgagtaatcaaccactgtgtatagacagacatgcatggtggtaccatctgatttgtcccatcacccattgattcattctagagtagacttgagagatctgatagaacttgcaagaatgaatgatccttttgaaaatcaaatttttcaataagaatggtacattttattgtaggaaaatgcagaaaatatagaaaagcttcaagaagaaaaccaaaatcagtcataatccaccaccccaaaattaatgacaatattttgtatgtcctttaaaaatggagtactttctaaaaatggtggattcaagcccattgcaaaacctccaacttatatagtgtgttatttttttttaaatgactagattttctgaacgactgctacatctctagatggaagtcatggtcataacccatgaaaagggaaagctgacaggtagttggagaactatgctatagcctcttcctggcagctatgtaaagaagcttaagggtagctccttcaaatttctcctcttccagcttgaatgatcaagtttcaatgctaaaagaggctgttagtacccaccccccattattttacagatgaggaaactgaggctcaaaggggtcaagcacctaatgtgctaacgtcagagttccagcttgaatttttagattgtcttcataggtaggtaaattttttatttcctaaagattcttcacagtcaaaaactttttcatggcctgaccctcaaaagaacaagctattgtggtgggagtatactataaaggatactaaaaggccaagtataataacttgctaatttcagaatatgttccgaacagctgtgggcagtacaggaatttttcatgttatttgctttattgtaattgaacatttagtgatggggaacctcttggatgggtctagctctcagtttaattttctctagcctatgaggcaagtgccaaggcatatgaagtatgcctataggtacaaaaatgaaagatgacattgaaagagtctttagacatggtagcctggaagatcgcaattagggcttttgctccatgaaagtatttttttcctttataaagggagatatctgttgaaattgtgggatagagattttaaagattgcatctgcttccaaactaaggtcaaaagttaaattgtagtaaatgtgtgcagtgtggtatcattaaactgtacacacatacgtgaaattgttgttttaatctggcatcttttttttttttttgagatggagtctccctgtgtcgcccaggctggagtgcagtggcgctctctcagctcactgcaacctccgcctcctagcatcaaccgattctcttgcctcagcctccctactagctgggattacaggcacgtgacaccacatcttgctaatgtttgtatttttagtagagacggggtttcaccatgttggccaggctggtctcaaactcctgacctcaggtgatccactcacctcggcctcccaaagtgctgggattacaggcgtgagccaccacgcccggccttaatctggcattcttaaaaaaatcagttatttagctttcttccccctcttctcctgccccatttcatttctttctgtagctgtgagggtcattctctctttgtatctgtttcactctcagggtgactcttttttcagtccacctgactgcactcactttcctttttccaggctctccgtggatccatatccttctatcacattcatctgccactgcatcttgcccttgtccccgtttgccagtgttaacaattaccccaccctgggctgggccagggctgtttttcagcttaggccgggcagggaagctgatctccagggcagatgtggagtgagaagagttgttgtcactctatacagaaatgtcattgacagaataggattaaacaaaatatgtacagagattacataggctatgtatacatgtaaacttgtgaacacaaaatcattccttctttacagctagggtcccagcaaatgctacagctacatgaaataatgagtatggatacctattgccgagggcttactatttgaacaagtgagagaattgtactcttgcctaggggtgtatttttaagtagtttttgctcctgttccttattattgcctgctaatggatacgtatattgtcagtaagtgaccaactctcctagcttcctgtagtacactgtatttctcttctgaaaatggattttcctctgtatttaaaccacagatttacttgtgcctcatttttgaactactatagataaaaactcacagataggaaatacctgtggactgtttgaaatgcagtgaaacctagaaaaaaaaaaacaatcaaaataataagtatctcctgtcggcattttactgcttgtagaattgatattctatttgcccacataaaatctctctggatgttattcctattgcaagacatagtagcttttcttcctgttccttattattgcctgctaatggatatgtacattgtcagtaagtgaccggctctccacagcttcctatagtacactatttctcttctgaaaatggattcctctgtatttaaactactgagatttatttgtgcctcatttttgaactactatagataaaaaaggcacagataggaaatacctgtggactgtttttgaaatgcattgaaacctagaaaaagaaaataacaatcaaaataataaatatctcttgtaagcattttactgtttctttttacccacataaaaactgtctggatgttattcctgttgcaagacattaaatgttctatagccttttttttttttttttgagacggagtttcgctcttgttgcccaggctggagtgcaatggtacaatcatggctcactacaacctctgcctccgggttcaagcgattctcctgcctcagcctcccaagtagctgggactacaggcacccaccaccatgcccagctaatttttgtatttttggtagtgacggggtttcactgtgttggtcaggctgatctcgaactcctgacatcaggtgatccgccctcctcggcctcccaaattgctgggattgcaggcgtgagctgttctgtagactttctaataacaagaatttgtaacagtcacaaggttttaaatttccttttcagtactaaggaaatgatagctgggaatgcaaaggctttattggcaagattgttttgacaaggatggcacaaaactaaatttctatacttgattaatttataagtcttgtcactcacttttagttttagagtgtggataaagctgtttgattcttgtcagatttgaaatgtatgatttatgagacattaaggattggtttttcagtgcactctgccaggtctagttttatgcgtcattctggtttgggaagctgagtgcaagtctgcctacagacataatcaatcacctgcactttcgggtggccaggtggactgaagtaacaggtttccccccaggtttctcagagactaaggaatacacacacacacacacacacacacacacacataggcagacctgcaaattatcggtccaaaaatatttatatcactaagccagagcagtggatttagacatttgacttaacaaaatttgtttttcaacacgttctagcaactaccctgtaaatgatcgtcatttcacctacaacaatgaaaagataaagtcctcagccgcatagcttctagaggctaaagaggcacgttaagttgcttgtcaaagactccacaccttcagatgccagggtcaacacaagttttcaaaccctagacccaatcccttctaggccacagaaggtctgcctcttgtaaggaaggaattttccaatgcactaagcacagctaatcacactaaggaaagaaaccaagcagccaaactaatatgaggaagtgaaagtttatacttgcatcttatagcagatggcctttgttagagccacttttaaaatatcaacttcaccgagcatgatttaggtacaaaaaccggcatccaattaaagcctccaatttgatgagtttagacagatgtatatacccatgaaaccactgccccaatcaggatgtggaatgtttttatcacctccacaagtttatccttgccccttttccagtaacattcttcccccagcccctttcccccagatatcccgttatgcttttgtgtgagagccactttcaaaactcagatttgaaagtttgtggatcttcctctataaaaagactatatttatgtccaaaatgcaattgtcttctctatgtttaaaataatactacagagaaattctaggtattgatttcctagaatctttccctcatcctctgcaagtaagctacttagtaaatagtttcattatgtacttgaattgaagagaaattacagccaagagaaaaacaattctgatagacagaaaagcagtgtatgttcttctcaagtagttacagtgaggtgttaaatccctcaagaaccagagaagtaaaatttgaattttgcttcgtacttatttgtaaagtaaaaatgaagactgagaataaaggttttatatgtatctatctgtctaatcattcatccatccacccatccctccagctagtgtgtgtatatatgtttctgtataaaattactatgtattaataaccctatcccttgaggattacaaaagatttgaaggcttcagagggaattttctgtgcatgaaaggtgtactgtctttacacacttaggtgcaaagcaagcttttcatatgctgttattactctcattgatatatttaattgaactaataattattgagcaatttaaaggctgctgcattgagatggagtttgtcccttcgtttgtcaccttctagaaaaatccaagtgtcaaaaaatatctcgctggctctctgttctgttgctattacttcggcatgcgtcgtctcctcttgccactctcgatttctactgtttctgccctatcttccttccctgattttcctcctccatgtctttcccgtatcctgatgccacttctcttgcactgctctgatttctcatgagaaagccatttttataaacatctccagaccgagagggcagcagactaattccaatgtgtcagatagcatcttggaggctgtttctcctgtgatccaacacttttttcacactcctttccagtttcgagctgtactggaaattggagagttgtgaaaggatggtttttggataatcaaagttgaatatacttgctgggctgtgttatgaccgtctttgaagccacgaatcattaaaaataagtgaatagtttacattataatattcctaggaaacttcctttgataattgtaaagcaattaaaattgtcctgagataaggtgatttattgtttttcagaatgggccataaagatattaaagaacccattcaacatttgtcaaaacccataaaatgcacaacgcaatgaatgaaccctaatgtaaaccctagactttagttcattataatgtattaacgttggcccatcaattgggacaaatgtaccacatcaatacaagatattaataataggggaaactgggagatggatgctaaggaggtatacagaaactcagtacttcctgcttagtttttctgtaaacctaaaactgctaaaaaaaaaaaaagtctactaattaaaaaaaaaaactcttcaaatgtatgggtttcagaaatacaaagactagatcaggagctttttattattaccgtgtggattaaagtctactgtttgtggccaggtacagtggctcatgcctgtaatcccagcaatctgggaggctgaggtgggtggatcacttaaggccaggagtttgagaccagcctggccaacatgatgaaaccctgtctctactgaaaatacaaaaattagccgggtgtggtggcatgtgcctgtattcccagctattcgggtggttgaggtgggagaatcacttaaacgcgggaggcagaggttgcggtgaaccgagatcacgccactgtactccaacctgggagacagagtgagaccctgtcttaaataaatacataaataaataaataaattccagtgtttgtttttcagaatgagtgaaataagagatgtgtttctccttgagtgatgtaacttgtggcacgagcccctgaaaaggggaagtatgaggttccaggagagctgcccagtacctccaatgctatgtctagttgcacaatagtcagtagataggtcagtgggagcagtgggttgggacttcgcttgccacccttgaaacatcatgccatctttgcagtggagtcccagatttggcaaattccctgccctacaacccagtgggccctcttttgacccttgcatttgtggtatcattagcaacagtgacagttggtgaacttatgccaactctgagccaatatccaggtcagagtttgattgctttgggccaaaggctattattgcatggcttgtagaagcataggcccaatgccagaacttccatgcacttactcagtatggccagctctacagtaaacgtgtgtgaaaagattcggtttttataggcattaatgtaaatagtttctttatattggacctgggtaactatgatgggcaattacaagtacccattgctttcctgagttggctatgagaacagaacattctgtggtacgtggtagtgggggtgaggggaggatcaggtctaagagggacattgcagctgcaaagggaaagaaaaaaactgagaagccatcaaggattagaaggcaaatgggagccatcactcaagcactgtgtatcttgaagtggttgtctgtcaggtctgtgataagacctggggtgaaaaacctcatagttcatgtgattatctgaaaaataccaataaagggaagagttgattatagagttcgcctgtttagtttttttgtttgtttgtttgttttttttgaaactgtgtcttgctctgtcacacaggctggaaaacagtgacgatcgtggctcactgcagtcttgacctcctgggcgcaaacaatccctctgcttcagcctcctgagtagctgggactgcaggtgtgcatcaccacacccatctaatgttttagtttcgtagaggcagggtctcgctatattgtccaggctggtctcaaactcatggcttgtttagcttattaaactttattttgtatattggaaataattctttgtgtacagatctgttaggtgtcctcattgttacatctattgttagacagaattttatttttcttaatttcattggttgcctgaattgactatatatgtggtaccacctgttaaaagcagattttgatgaggaaggggagaaagaggataaaaataacctctccctcaagtcccatttcatgatggaagctaggattccagttcagtggccaggctaaatggtcacttgatgccagtagtgagctactgccactggatttctttcagtcagcttcacaatcgacaccaaatcctgcagctgacgtgactttactgcaattcatgttgattggaaaaatggcaaaagtcaccatctaacccaatcataatatgtttgtttcccagatatagacaggctgggttcgtcattaggcctagtgtagtcatgctccctaactactgtgagtatctggaaggattggggaggtatagtggcagcggcttgtgggacaggcatgtgacagcatccttttgcccccttgctgctcacccacctgcttcttgccacctattggctcctctttgtcttcccctcattctgtcttctctttatccttaatccagttacttttgaattttctgttaaggaaccaggagagcctcagcatgaaaataattggcttaagtattcaaagtaccagagcaacatactttataattcttggactgcctgattgttactgctgcagtggtttgttgggtattaaatgagacttagggtattttgtaaacgttttctgacatacaatttgaaagttgaattttgtcaccttacaaacttagttattcctgcaacttttaaaacccccctaaattttccttatgtgttcatgattatccccatagcagataatggccacatgcgtgctgatatgaaggatttgctccagggctaattgatgggagcagagctgcccagttgctgaattgtaaggaaacagttcatggagcgccaatgccaatttaggaaaagtatggggctgagtacttagtaagatgaaataaaaaaatatttatccagtgcttactctaaggagaaggcacttggctaggtttgctagatgctgtggggagccttaaaacaacagtgatctcttcaaggccgggcgtggtggctcatgcctgtaatcccagcactttgggaggccgaggcaggcggatcacttgaggtcaggagtttgagaccagcatggacaatatggtgaaaccccgtttctactaaaaatacaaacattagctgggtgtggtggcatctgcctgtggtcccagctactcaggaggctgaggcaggaggatcacttgaacctgggatatggaggtggcagtgagatgagattgtgccactccactccagcctgggcgacagagagagaccctgtctcaaaaaaaaaaaaaaaaaaaaagtactagcgatctcttcaagcaaagaacgcccattctaattggagaagctgttaaagacacatgaaggatgtggtggaaagagtattgaactgcatagggtgtggggagagagtcaggagttttgaatcctagcctgagttctgccactaagcattggaaactctgggcaaatcatctccccactctgggtctcagtttataaaaaggcaaatgaacgagatcatctctaagatattctgtagattgattcataaatgtggaagagattctggaaaacggaagcttgagcccaggagttccagaccagcctgggcaacatggtgagactctgtctctacaaaaaatacaaaacattagcctggtgaggtgatgtgtgtttgtagtccctgtttctcaggaggctgaggtgggaggatcacatgggcccaggaggctgcagtgagctatcacctgggagcttgttagaaatgcaactttcatgggccccactccagacctagggaatcagaaacgctggggatggggccccgccatctgtgtcctaacaaggtcctctctcaggagattttgaggcacaataaagtctgacaattacaggctataggaatttgggtcagtggttctcagcctctgccatacaatagattcatctgggggaactttgttgggggtggggcgctgactttgtttgtgctgctgtaacagaatatctgagactggataccttataaagaacagaaatctatttctcacggttctggagactgggaagtcccaagatcaaggtgcaaacaggttcgattgttaagggctgctctctgcttccaagatgacactttagttctccagcctccagaggggaggaacgccctgccctcatgtggcggaaggcagaagggcaagagagccaaaggctctgttgaagctttaatcccatccaccagggaggagctctcccggtttaatcaccccacctcttagaggccccacctctcaataccatcacattgtccattaagattcaacacctgaatcttggacacatgaaaaccgtagcaggcacccaggcatcactagttgctttggctctccaggtgccgccaattttgagaatcactggtttaggggaaagtggcatgaaccaagacttctgtcattctctagctgcaatgaacgtcagatgcagggagtcagccaaagccagaggcttgaatttcactcaaagaaacttggcctttagattacaatggagaaaggtttttggcaatgggagtgatacatccgaggtggaacatttgagagatgattctgatgctagctatgtgaagaagagggcatacccatagttaagaaatctgatgaaatagtctggtgtgaagtgataatgggccaaattaggaccttagaaatgaaattataaggaagaaaatgtatgaaagctcttttgcaggaaaaatgggcagggtttggcgatggttgctggggtgacagcaatgttagaatgtctttggttcaggagtacctctcagacttctgggagggccagtgctctctagatgcatctggcaaaattgtcatgtatggatctgtacaattctttgttttttgttgctttgatttaggagttataatgcggaggtgacccacagcaagttatagaaaaatacagaattacagtcacctcaaaagctactcatggtcatcatgtcagagggaaaaaatgctgtttttcttttaaggaaagaatgcttggagttgtgggaaagttgtagacttggcaatgagtaattcaagcctatcagtcaattaagtgagtttttattttatcatttgttttatttgggagctgctgtaatagtcattgagaggacatcagtcttcatatttttaaaacaaaacaaaaataccattgaacattagggcaaaggacaagaatttcaaggtttttaccttttgacttcagcaaatatttgctgctccatttttcttgctagattttgccatttgacttgtgtttttcctttgttccaatttgttctttgtgcttgataactgtagtgtactctatttttttttttttgagacacagtcttgctcttttgcccaggttggagtacagtggtgcaatctcggctcactgcaacctctgcctcctggattcaagtgattctcgtgtctcggcctcccaagtagctggaattacaggcacgcaccaccatgtctggctcatttttgtattttcagtagagatggggcttcaccatgttggccaggctggtctcgacctcccaaagtgctgggattacaggcgtgcatcactgctccttgcctctattctattttcgatggcttttttattcataagtattcttaaggttttaatattccagttaaaaaataaatatatttgtccctttatgtttttccccaatatacttattcttcctttatgaccaaaaattattcaaatttgcatccagaaatggctcacagaaagagctccttggtatttatttagggcatggtgggaccttttgttagtttctaggtcatgccacatctggaaggaaagacaccttttatttactaatttgaaaatctatgaaagcagactcagtattttacagggttgcatatattcctatgcaaagttgcatatattcctatgcaaagttaaaaatgactcactactccaactttggtaaatgtgtgcactttagtttttgaaagaagtgcaaaaatctgcagaaaaatctggactaatcataacttgaaatttttagtatatctggtagataacttttaaaaatataacccatcttttcccaaactggatagggataattcctctctttgcaaattgtgaggaatattatgattgtatcatataaaataaatatagaaacgtgtagaataaatgatcttccagagtatatagaggatatcaccagataatactctgtactaaatataaggacacaaaactggactttattatatttctataactggtaatatccttccagtttttgcttgtttattaaatgaatatactgttaaagatttggttatgttgtagatcttaattatgttggaattattaaaaatgaggcatctttaatctgtactgcttatttccaataaattattttgccgaatgagagccagtttaccagttcttttgttaaagaaaatgagccagtggctacctcagttgtatttatcattgccttttatggtaaacatttaaaatgtgtttttaatggtgcacatgccgatgtttctgacctctatagtagcataagtatttgaataaaagtgaggtaaatgagaagtctgtgccacccagtctcatcacaagtgtacctaattaagaagatgtttggaattcactgttctttgatttcttgggtgggagagaatattctgaaggctgtgattaaggaatcgttaccatgacaatcacattcaaagaattgagaggagacaatgagtctgtgggggatcatctcttttgattgatttgactcttcttttaagttctttcaaacagctgttgtcactggattttcttttccacgtaattcacacaattgattggtgatgtggggatcattgaagcttggttgtcagtagtgataagggtcagcagtgtccatgaccacaatacttttgctaaacctggagagtgattgtatgtgttaaatgtcactaaaaagtaactcttggcttctttctggaataatatatgtggtttgtctattttcacttattaattttgtcagggtgggatatgattatcatgatctctttgaaagcatgactaactctaaagtgtttgagctttattttggattactttgctgtcatcttacccagtgttttgtgtgctgttttgtttttattctttaacttgcacaatgttgtcaacgtaatttatatgatgttctggtcagagacacagttacacgctgcagattgaaaagtacacacaaatatacccaccatgagtgcttcagcctcacgaccccagctcatgttaagtgggacatgctagtacagatgataaagtgaaatggagatacaaaggcagttcagatctgactgtcaatttttctcctttgtggactaattctgggtggtgaaaccatgaactatggaacgaagactgctccagcatgagtctgagttgaatcccatgtgagagctttgcctcctcagcctttgggcctttctttcttctgccctctggagggtgtcagagaacatgaaatgcaaggactttctggaaaggatagccagggtttggtctggtaactagaagacactttccctgccccttccccaccaccccctccaagccggaacatgtagaggtgaggagcagacagagagatggcagggaagccattggcaaggtgggaatcttaggaaggaagtgattccggttcttgaaaaagacaaccggattccattaagtagaatcggtatgaattgtactcatctctaggaaaaatcaattccagaagggtgagtaagatgaaatatgataagactagtgtgtgacagattcaggtttgaagcttaaggtggatggaatcgaaagaaaggtatatttggtgtcaagtgtttgtggcggcatgtgaaatcattatccacgtttgataacagtttgactctttgcctgctataataatagtagtaagtatgtatttaacattcaatgcgtaccttgtgtgggggaggcactgctaaatgctttgcatggacgtacctccttacctctatgaggtaggtggccattatgatgctcatagaggctggacagctaatatgaggcggagcctgtatttgggctcaggcagtctgactctggtgcccctgctgtgaagagctgtgccctgctgcattcctcctgtagctgcacgaaagggtgtggaatcttctagaaacagtgagttctatatgagtggagtgtggtggtgggagaatagatggagtaaagccttttgtgtaaacataccatgctaagtactgggagatagaaacgaaatgagagatttttttgttttgttttttgagatggagtcttgctctgtcgctcaggctggagtgcagtggtgcgatctcagatcaccgcaacctccaccttccaggttcaagcaattctcctgcctcagcctcctgagtacctgggactacagacacacgccaccacgccggctaatttttgtatttttttggtagagacggggtttcatcatgttggccaggatggtcttgatctcatgacctcgtgatccacccaccgcagcctcccaaagtgctgggattacaggtgccagccaccacacccagccaaaataagacatttctttgcccctgccaccaagatatttaacatcttacaggactaacaaaacctaacatgaaccagtccagattcatatgatagaatatgaaaatgttttctggaaagaatagccagagtcccagtctggttactagaagacactttccctgtcctttccccacctgtagcccttccaagctggaatgtgcagaggtgaggaacagacagagagatggcagggaagctattggcaaggtgggaatcttaggaaggaagtgattccggttcttgaaaaagagaaccggattccgtcaagtagaatcggtatgaattgtacccatctctaggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 3773 - DNA, 62781 bp, human
cagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaagggcaggagatacatccttgtagcatttcgcttggttttgagaagagtagaagtagtagaataagcgtatgtatttgctggaagtccccttgtattcatttaaattatcccttcgggattatccgagccccctttgatttgggtttggaatagatccagttttcctaattggagccatcatcttgtaattgcttgtaattcttctctgggttatcaagtctatggcaagcttatagaacagcaggaataattttttccgtcatcttaagacagttttaatgtaaacgttacggtgttccttgcaaatgtgaacatttgcagaatagcacaagtttaaattatgggcccccctggaattttgtaaagcctttcctgcctcagctcatctccaagaaccgggccctcccgatccttacactgaagaagcaagagcttctgggatggtagctttgcctttacaaactcatgttcatgtttgcttaagaagaatacgtattaagcaggcatttgccttttatgtggtgagactatagtgttttcccatttttggttacataaggttccgatcaagtctttaccttcagtctttaaaaatgcttatttaacatttttaagggcaaatataatctttatgcaacaggaaattggtcagataggccatgatttgtgcaaaccacctcacgataagtacatagtctaagactatcatatagattctgtaaccatatatggtttttgaaattctaggctaccattcccatatttaattttcagaaaaggaaaatatttttttcagccaagtctagatttttgagtgaaactaagaaaaattgtgtaagatttaaattgataaaattcctcctgtataataccagtgcattggaggtaatttaatatatattaaatgaatcgaccgctaaaacaaaataattattttttttcctggaagtgttaaactggaaatgtttaaggggaaatagatttttagtcacaaagaccgacaaaaatgcatttatttacactattgtattataatgttagtatggtattcattctgtgcccccaaatagcaattgaaaaaatagcatatttttataataaaatttaagcataatgtttttttctctgaggagtagaatgcagaaagtggtaaaaaatcttttacagagagaagcatgttgataggaagtgggctttaagtttctctctggacagaaggtgtaaatggcgtatcttttacctggctttttgagaatctgttgccctctaggacatgaaagacatttcaggaattaacagaagtcggatcaaattctcttgctagatgttcttaaagattttgctgatacgcatttgaaaatttgtaaatcacgttttcatgtaagaaattaaccctcacctctaaagtttgagcattaaaaaagtttgttgaaggcatggaaggtaatctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactgaacttttttttgttaattgaactatctagttgtttggatttggggtaaaagggagtagactgtaattgttttttcttaaaagatcttttcttttagctcctgtgggacaagagcagagaaaggttcttttttggtcagtggtgtacttaattaagcagaatatatgacttttcgtttattcaacaaacatttgccgagttacctcctctgttggaggctccatgctaggtgtggagttatttggttgataagaaatggcttccacctttctggtgaagttatgaaaatgaaaaatagacagtgaatctgttgtgagtaatcaagaattgtctggagttttttggacagacaaaaaagatttcttgatgtttacattcagctttgtattactgtatagagtagggagaagtggatggccagcatcccttcctgcgacttaatgcatctctgatggcaaattgggcctccccaaaatatttttctggggtcaactttgaattatggatagtaatggatgatggagcccagaagagtggatagtcctaaatagtagctcgaataaacctttgaccttctacagggttgcttcctgagtgcctggagaaatcccctctttgtggatagtgccacactggtggttttcagccagggcgcttttgccccccggggtcactcaacaatttttgctagatgcactccactggcatccagttggtagagacagggatgctgcttaaatatccaacagcgcatagggcagtgcctggcggcaaacaaaattatccagcctgaaatgtcgatatgccgaggttgatgtaatttcctctacataatgtagcagaacataattccaggagagtagagaacaataacagcgtcttgaggtgactgagtagttggcggagctcactttattcgtctcaaaaatgactagtttcagccaggtgctgtggttcacgcctgtaatcccagtactttgggaggctgaggcaagcggatcacttgagcccaggagttcgagaccagtctggccaacatggcaaaatcctgtctctactaaaaatacaaagaattagccgggtgtggtggtgtgcgcctgtagtcccagctacttgggaggctgaggcacgagaatcgcttggacccaggaggcggaggttgctgtgagctgagattgcaccactgcactccagcctgggcgacagagtgagaccctgtctcaaaaacataaaataaataaataaaagtgactagttcctgcataccaacctgaagaattaaagaaaataacagctaccatttatggcacttactctgtgccagaggacttgtatacattatatattctcttcattttataaatgaggaaccacactcagagaggtagaagatcttgcctggagcctcacagctggtcaaggttagaagtagaaatcaagattaagattattactccttttaagttcatggttttaagcacaactatgcattatctcccttgcggcatgcatcattcaaaatcttatgtaacaaaatgaaaattactatatgtcctatataccattgggcttgcctgagagtaattaaaaccatgaatgctaaatgtgatcatacttggagtaagtgacaaggagtaggggaaaagggaaccaacattaattgaacacctactaaaatttcaggaagcacgcaaattaaatatatactcattgtctaatttgattctcagagcaactctgcagttatgatgcacattttacagatgagagtgggagatatttgttaagtaacttgtctaagattgcacaactaataagcagcaaggttgggatttgagatgatgtcccacaaccaagccactctttgctgcttactctaaaggtaggaagtaagttgagcctcttggagaaaggaaggtaactggctctgggtaaaaagtaacttcaggcagagcgcagtggcttacgcctgtaatcccagcactttgggaggccaagccgggcagatcacctgaggtcaggagttcaagaccagcctggccaacatggtgaaaccccgtcatggctaaaacacaaaaattagccaggcgtggtagtgggtgcctgtaatcccagctactcgggaggctgaggcaggaagaattgcttgaatccaggagtcggaggttgcagtgagccgagatagcgccactgtattccagcctgggcgacagagctagactccatctcaaaaaaaaaaaaaaaaaaaaaagtaatttgagaggtaacacgtagtagacgttggattatattcaggtagagaatggagagatgaattgctataccttcctcatctgataagaatcgaattctacctggaatttgttctagagatctactcaaattgaaacagtgattgtcattttgtcaaacttcattttctatctcacctgaattttccaagctgtgctttgataaccatgaacctggaagttatggaaatctgtgcttaacctttcggtagctcaccttccacctttcttagggctgtcctgtagaacttaggagtgacaacatttggtttttgtcttctttttacacaatttaaacatttgtgcttgctatggaaattgtttttataatacgcggcatcaaattcattcttgtgtttttcatatggggttgttttgttttgacaactaaatatttactttaagttttaacgtgttttgtttcggagcacaaaaagaggaaacatttaaaaaacagcccaatcacaatcattttgtctgaaaagcatttttttgcgggaggtgggggggggcaggaaaaggaccacatgtttaatttcatttgcttcaattggaaaggaattttaaccacgattctcaagggccaggatgctggaaaaaaatgttatttagataaaatgcctgttttgatatccacatagaactgtgagccatagattctgattataataataatgtcctgattctactacagcaatcagccacttgagtaatcaaccactgtgtatagacagacatgcatggtggtaccatctgatttgtcccatcacccattgattcattctagagtagacttgagagatctgatagaacttgcaagaatgaatgatccttttgaaaatcaaatttttcaataagaatggtacattttattgtaggaaaatgcagaaaatatagaaaagcttcaagaagaaaaccaaaatcagtcataatccaccaccccaaaattaatgacaatattttgtatgtcctttaaaaatggagtactttctaaaaatggtggattcaagcccattgcaaaacctccaacttatatagtgtgttatttttttttaaatgactagattttctgaacgactgctacatctctagatggaagtcatggtcataacccatgaaaagggaaagctgacaggtagttggagaactatgctatagcctcttcctggcagctatgtaaagaagcttaagggtagctccttcaaatttctcctcttccagcttgaatgatcaagtttcaatgctaaaagaggctgttagtacccaccccccattattttacagatgaggaaactgaggctcaaaggggtcaagcacctaatgtgctaacgtcagagttccagcttgaatttttagattgtcttcataggtaggtaaattttttatttcctaaagattcttcacagtcaaaaactttttcatggcctgaccctcaaaagaacaagctattgtggtgggagtatactataaaggatactaaaaggccaagtataataacttgctaatttcagaatatgttccgaacagctgtgggcagtacaggaatttttcatgttatttgctttattgtaattgaacatttagtgatggggaacctcttggatgggtctagctctcagtttaattttctctagcctatgaggcaagtgccaaggcatatgaagtatgcctataggtacaaaaatgaaagatgacattgaaagagtctttagacatggtagcctggaagatcgcaattagggcttttgctccatgaaagtatttttttcctttataaagggagatatctgttgaaattgtgggatagagattttaaagattgcatctgcttccaaactaaggtcaaaagttaaattgtagtaaatgtgtgcagtgtggtatcattaaactgtacacacatacgtgaaattgttgttttaatctggcatcttttttttttttttgagatggagtctccctgtgtcgcccaggctggagtgcagtggcgctctctcagctcactgcaacctccgcctcctagcatcaaccgattctcttgcctcagcctccctactagctgggattacaggcacgtgacaccacatcttgctaatgtttgtatttttagtagagacggggtttcaccatgttggccaggctggtctcaaactcctgacctcaggtgatccactcacctcggcctcccaaagtgctgggattacaggcgtgagccaccacgcccggccttaatctggcattcttaaaaaaatcagttatttagctttcttccccctcttctcctgccccatttcatttctttctgtagctgtgagggtcattctctctttgtatctgtttcactctcagggtgactcttttttcagtccacctgactgcactcactttcctttttccaggctctccgtggatccatatccttctatcacattcatctgccactgcatcttgcccttgtccccgtttgccagtgttaacaattaccccaccctgggctgggccagggctgtttttcagcttaggccgggcagggaagctgatctccagggcagatgtggagtgagaagagttgttgtcactctatacagaaatgtcattgacagaataggattaaacaaaatatgtacagagattacataggctatgtatacatgtaaacttgtgaacacaaaatcattccttctttacagctagggtcccagcaaatgctacagctacatgaaataatgagtatggatacctattgccgagggcttactatttgaacaagtgagagaattgtactcttgcctaggggtgtatttttaagtagtttttgctcctgttccttattattgcctgctaatggatacgtatattgtcagtaagtgaccaactctcctagcttcctgtagtacactgtatttctcttctgaaaatggattttcctctgtatttaaaccacagatttacttgtgcctcatttttgaactactatagataaaaactcacagataggaaatacctgtggactgtttgaaatgcagtgaaacctagaaaaaaaaaaacaatcaaaataataagtatctcctgtcggcattttactgcttgtagaattgatattctatttgcccacataaaatctctctggatgttattcctattgcaagacatagtagcttttcttcctgttccttattattgcctgctaatggatatgtacattgtcagtaagtgaccggctctccacagcttcctatagtacactatttctcttctgaaaatggattcctctgtatttaaactactgagatttatttgtgcctcatttttgaactactatagataaaaaaggcacagataggaaatacctgtggactgtttttgaaatgcattgaaacctagaaaaagaaaataacaatcaaaataataaatatctcttgtaagcattttactgtttctttttacccacataaaaactgtctggatgttattcctgttgcaagacattaaatgttctatagccttttttttttttttttgagacggagtttcgctcttgttgcccaggctggagtgcaatggtacaatcatggctcactacaacctctgcctccgggttcaagcgattctcctgcctcagcctcccaagtagctgggactacaggcacccaccaccatgcccagctaatttttgtatttttggtagtgacggggtttcactgtgttggtcaggctgatctcgaactcctgacatcaggtgatccgccctcctcggcctcccaaattgctgggattgcaggcgtgagctgttctgtagactttctaataacaagaatttgtaacagtcacaaggttttaaatttccttttcagtactaaggaaatgatagctgggaatgcaaaggctttattggcaagattgttttgacaaggatggcacaaaactaaatttctatacttgattaatttataagtcttgtcactcacttttagttttagagtgtggataaagctgtttgattcttgtcagatttgaaatgtatgatttatgagacattaaggattggtttttcagtgcactctgccaggtctagttttatgcgtcattctggtttgggaagctgagtgcaagtctgcctacagacataatcaatcacctgcactttcgggtggccaggtggactgaagtaacaggtttccccccaggtttctcagagactaaggaatacacacacacacacacacacacacacacacataggcagacctgcaaattatcggtccaaaaatatttatatcactaagccagagcagtggatttagacatttgacttaacaaaatttgtttttcaacacgttctagcaactaccctgtaaatgatcgtcatttcacctacaacaatgaaaagataaagtcctcagccgcatagcttctagaggctaaagaggcacgttaagttgcttgtcaaagactccacaccttcagatgccagggtcaacacaagttttcaaaccctagacccaatcccttctaggccacagaaggtctgcctcttgtaaggaaggaattttccaatgcactaagcacagctaatcacactaaggaaagaaaccaagcagccaaactaatatgaggaagtgaaagtttatacttgcatcttatagcagatggcctttgttagagccacttttaaaatatcaacttcaccgagcatgatttaggtacaaaaaccggcatccaattaaagcctccaatttgatgagtttagacagatgtatatacccatgaaaccactgccccaatcaggatgtggaatgtttttatcacctccacaagtttatccttgccccttttccagtaacattcttcccccagcccctttcccccagatatcccgttatgcttttgtgtgagagccactttcaaaactcagatttgaaagtttgtggatcttcctctataaaaagactatatttatgtccaaaatgcaattgtcttctctatgtttaaaataatactacagagaaattctaggtattgatttcctagaatctttccctcatcctctgcaagtaagctacttagtaaatagtttcattatgtacttgaattgaagagaaattacagccaagagaaaaacaattctgatagacagaaaagcagtgtatgttcttctcaagtagttacagtgaggtgttaaatccctcaagaaccagagaagtaaaatttgaattttgcttcgtacttatttgtaaagtaaaaatgaagactgagaataaaggttttatatgtatctatctgtctaatcattcatccatccacccatccctccagctagtgtgtgtatatatgtttctgtataaaattactatgtattaataaccctatcccttgaggattacaaaagatttgaaggcttcagagggaattttctgtgcatgaaaggtgtactgtctttacacacttaggtgcaaagcaagcttttcatatgctgttattactctcattgatatatttaattgaactaataattattgagcaatttaaaggctgctgcattgagatggagtttgtcccttcgtttgtcaccttctagaaaaatccaagtgtcaaaaaatatctcgctggctctctgttctgttgctattacttcggcatgcgtcgtctcctcttgccactctcgatttctactgtttctgccctatcttccttccctgattttcctcctccatgtctttcccgtatcctgatgccacttctcttgcactgctctgatttctcatgagaaagccatttttataaacatctccagaccgagagggcagcagactaattccaatgtgtcagatagcatcttggaggctgtttctcctgtgatccaacacttttttcacactcctttccagtttcgagctgtactggaaattggagagttgtgaaaggatggtttttggataatcaaagttgaatatacttgctgggctgtgttatgaccgtctttgaagccacgaatcattaaaaataagtgaatagtttacattataatattcctaggaaacttcctttgataattgtaaagcaattaaaattgtcctgagataaggtgatttattgtttttcagaatgggccataaagatattaaagaacccattcaacatttgtcaaaacccataaaatgcacaacgcaatgaatgaaccctaatgtaaaccctagactttagttcattataatgtattaacgttggcccatcaattgggacaaatgtaccacatcaatacaagatattaataataggggaaactgggagatggatgctaaggaggtatacagaaactcagtacttcctgcttagtttttctgtaaacctaaaactgctaaaaaaaaaaaaagtctactaattaaaaaaaaaaactcttcaaatgtatgggtttcagaaatacaaagactagatcaggagctttttattattaccgtgtggattaaagtctactgtttgtggccaggtacagtggctcatgcctgtaatcccagcaatctgggaggctgaggtgggtggatcacttaaggccaggagtttgagaccagcctggccaacatgatgaaaccctgtctctactgaaaatacaaaaattagccgggtgtggtggcatgtgcctgtattcccagctattcgggtggttgaggtgggagaatcacttaaacgcgggaggcagaggttgcggtgaaccgagatcacgccactgtactccaacctgggagacagagtgagaccctgtcttaaataaatacataaataaataaataaattccagtgtttgtttttcagaatgagtgaaataagagatgtgtttctccttgagtgatgtaacttgtggcacgagcccctgaaaaggggaagtatgaggttccaggagagctgcccagtacctccaatgctatgtctagttgcacaatagtcagtagataggtcagtgggagcagtgggttgggacttcgcttgccacccttgaaacatcatgccatctttgcagtggagtcccagatttggcaaattccctgccctacaacccagtgggccctcttttgacccttgcatttgtggtatcattagcaacagtgacagttggtgaacttatgccaactctgagccaatatccaggtcagagtttgattgctttgggccaaaggctattattgcatggcttgtagaagcataggcccaatgccagaacttccatgcacttactcagtatggccagctctacagtaaacgtgtgtgaaaagattcggtttttataggcattaatgtaaatagtttctttatattggacctgggtaactatgatgggcaattacaagtacccattgctttcctgagttggctatgagaacagaacattctgtggtacgtggtagtgggggtgaggggaggatcaggtctaagagggacattgcagctgcaaagggaaagaaaaaaactgagaagccatcaaggattagaaggcaaatgggagccatcactcaagcactgtgtatcttgaagtggttgtctgtcaggtctgtgataagacctggggtgaaaaacctcatagttcatgtgattatctgaaaaataccaataaagggaagagttgattatagagttcgcctgtttagtttttttgtttgtttgtttgttttttttgaaactgtgtcttgctctgtcacacaggctggaaaacagtgacgatcgtggctcactgcagtcttgacctcctgggcgcaaacaatccctctgcttcagcctcctgagtagctgggactgcaggtgtgcatcaccacacccatctaatgttttagtttcgtagaggcagggtctcgctatattgtccaggctggtctcaaactcatggcttgtttagcttattaaactttattttgtatattggaaataattctttgtgtacagatctgttaggtgtcctcattgttacatctattgttagacagaattttatttttcttaatttcattggttgcctgaattgactatatatgtggtaccacctgttaaaagcagattttgatgaggaaggggagaaagaggataaaaataacctctccctcaagtcccatttcatgatggaagctaggattccagttcagtggccaggctaaatggtcacttgatgccagtagtgagctactgccactggatttctttcagtcagcttcacaatcgacaccaaatcctgcagctgacgtgactttactgcaattcatgttgattggaaaaatggcaaaagtcaccatctaacccaatcataatatgtttgtttcccagatatagacaggctgggttcgtcattaggcctagtgtagtcatgctccctaactactgtgagtatctggaaggattggggaggtatagtggcagcggcttgtgggacaggcatgtgacagcatccttttgcccccttgctgctcacccacctgcttcttgccacctattggctcctctttgtcttcccctcattctgtcttctctttatccttaatccagttacttttgaattttctgttaaggaaccaggagagcctcagcatgaaaataattggcttaagtattcaaagtaccagagcaacatactttataattcttggactgcctgattgttactgctgcagtggtttgttgggtattaaatgagacttagggtattttgtaaacgttttctgacatacaatttgaaagttgaattttgtcaccttacaaacttagttattcctgcaacttttaaaacccccctaaattttccttatgtgttcatgattatccccatagcagataatggccacatgcgtgctgatatgaaggatttgctccagggctaattgatgggagcagagctgcccagttgctgaattgtaaggaaacagttcatggagcgccaatgccaatttaggaaaagtatggggctgagtacttagtaagatgaaataaaaaaatatttatccagtgcttactctaaggagaaggcacttggctaggtttgctagatgctgtggggagccttaaaacaacagtgatctcttcaaggccgggcgtggtggctcatgcctgtaatcccagcactttgggaggccgaggcaggcggatcacttgaggtcaggagtttgagaccagcatggacaatatggtgaaaccccgtttctactaaaaatacaaacattagctgggtgtggtggcatctgcctgtggtcccagctactcaggaggctgaggcaggaggatcacttgaacctgggatatggaggtggcagtgagatgagattgtgccactccactccagcctgggcgacagagagagaccctgtctcaaaaaaaaaaaaaaaaaaaaagtactagcgatctcttcaagcaaagaacgcccattctaattggagaagctgttaaagacacatgaaggatgtggtggaaagagtattgaactgcatagggtgtggggagagagtcaggagttttgaatcctagcctgagttctgccactaagcattggaaactctgggcaaatcatctccccactctgggtctcagtttataaaaaggcaaatgaacgagatcatctctaagatattctgtagattgattcataaatgtggaagagattctggaaaacggaagcttgagcccaggagttccagaccagcctgggcaacatggtgagactctgtctctacaaaaaatacaaaacattagcctggtgaggtgatgtgtgtttgtagtccctgtttctcaggaggctgaggtgggaggatcacatgggcccaggaggctgcagtgagctatcacctgggagcttgttagaaatgcaactttcatgggccccactccagacctagggaatcagaaacgctggggatggggccccgccatctgtgtcctaacaaggtcctctctcaggagattttgaggcacaataaagtctgacaattacaggctataggaatttgggtcagtggttctcagcctctgccatacaatagattcatctgggggaactttgttgggggtggggcgctgactttgtttgtgctgctgtaacagaatatctgagactggataccttataaagaacagaaatctatttctcacggttctggagactgggaagtcccaagatcaaggtgcaaacaggttcgattgttaagggctgctctctgcttccaagatgacactttagttctccagcctccagaggggaggaacgccctgccctcatgtggcggaaggcagaagggcaagagagccaaaggctctgttgaagctttaatcccatccaccagggaggagctctcccggtttaatcaccccacctcttagaggccccacctctcaataccatcacattgtccattaagattcaacacctgaatcttggacacatgaaaaccgtagcaggcacccaggcatcactagttgctttggctctccaggtgccgccaattttgagaatcactggtttaggggaaagtggcatgaaccaagacttctgtcattctctagctgcaatgaacgtcagatgcagggagtcagccaaagccagaggcttgaatttcactcaaagaaacttggcctttagattacaatggagaaaggtttttggcaatgggagtgatacatccgaggtggaacatttgagagatgattctgatgctagctatgtgaagaagagggcatacccatagttaagaaatctgatgaaatagtctggtgtgaagtgataatgggccaaattaggaccttagaaatgaaattataaggaagaaaatgtatgaaagctcttttgcaggaaaaatgggcagggtttggcgatggttgctggggtgacagcaatgttagaatgtctttggttcaggagtacctctcagacttctgggagggccagtgctctctagatgcatctggcaaaattgtcatgtatggatctgtacaattctttgttttttgttgctttgatttaggagttataatgcggaggtgacccacagcaagttatagaaaaatacagaattacagtcacctcaaaagctactcatggtcatcatgtcagagggaaaaaatgctgtttttcttttaaggaaagaatgcttggagttgtgggaaagttgtagacttggcaatgagtaattcaagcctatcagtcaattaagtgagtttttattttatcatttgttttatttgggagctgctgtaatagtcattgagaggacatcagtcttcatatttttaaaacaaaacaaaaataccattgaacattagggcaaaggacaagaatttcaaggtttttaccttttgacttcagcaaatatttgctgctccatttttcttgctagattttgccatttgacttgtgtttttcctttgttccaatttgttctttgtgcttgataactgtagtgtactctatttttttttttttgagacacagtcttgctcttttgcccaggttggagtacagtggtgcaatctcggctcactgcaacctctgcctcctggattcaagtgattctcgtgtctcggcctcccaagtagctggaattacaggcacgcaccaccatgtctggctcatttttgtattttcagtagagatggggcttcaccatgttggccaggctggtctcgacctcccaaagtgctgggattacaggcgtgcatcactgctccttgcctctattctattttcgatggcttttttattcataagtattcttaaggttttaatattccagttaaaaaataaatatatttgtccctttatgtttttccccaatatacttattcttcctttatgaccaaaaattattcaaatttgcatccagaaatggctcacagaaagagctccttggtatttatttagggcatggtgggaccttttgttagtttctaggtcatgccacatctggaaggaaagacaccttttatttactaatttgaaaatctatgaaagcagactcagtattttacagggttgcatatattcctatgcaaagttgcatatattcctatgcaaagttaaaaatgactcactactccaactttggtaaatgtgtgcactttagtttttgaaagaagtgcaaaaatctgcagaaaaatctggactaatcataacttgaaatttttagtatatctggtagataacttttaaaaatataacccatcttttcccaaactggatagggataattcctctctttgcaaattgtgaggaatattatgattgtatcatataaaataaatatagaaacgtgtagaataaatgatcttccagagtatatagaggatatcaccagataatactctgtactaaatataaggacacaaaactggactttattatatttctataactggtaatatccttccagtttttgcttgtttattaaatgaatatactgttaaagatttggttatgttgtagatcttaattatgttggaattattaaaaatgaggcatctttaatctgtactgcttatttccaataaattattttgccgaatgagagccagtttaccagttcttttgttaaagaaaatgagccagtggctacctcagttgtatttatcattgccttttatggtaaacatttaaaatgtgtttttaatggtgcacatgccgatgtttctgacctctatagtagcataagtatttgaataaaagtgaggtaaatgagaagtctgtgccacccagtctcatcacaagtgtacctaattaagaagatgtttggaattcactgttctttgatttcttgggtgggagagaatattctgaaggctgtgattaaggaatcgttaccatgacaatcacattcaaagaattgagaggagacaatgagtctgtgggggatcatctcttttgattgatttgactcttcttttaagttctttcaaacagctgttgtcactggattttcttttccacgtaattcacacaattgattggtgatgtggggatcattgaagcttggttgtcagtagtgataagggtcagcagtgtccatgaccacaatacttttgctaaacctggagagtgattgtatgtgttaaatgtcactaaaaagtaactcttggcttctttctggaataatatatgtggtttgtctattttcacttattaattttgtcagggtgggatatgattatcatgatctctttgaaagcatgactaactctaaagtgtttgagctttattttggattactttgctgtcatcttacccagtgttttgtgtgctgttttgtttttattctttaacttgcacaatgttgtcaacgtaatttatatgatgttctggtcagagacacagttacacgctgcagattgaaaagtacacacaaatatacccaccatgagtgcttcagcctcacgaccccagctcatgttaagtgggacatgctagtacagatgataaagtgaaatggagatacaaaggcagttcagatctgactgtcaatttttctcctttgtggactaattctgggtggtgaaaccatgaactatggaacgaagactgctccagcatgagtctgagttgaatcccatgtgagagctttgcctcctcagcctttgggcctttctttcttctgccctctggagggtgtcagagaacatgaaatgcaaggactttctggaaaggatagccagggtttggtctggtaactagaagacactttccctgccccttccccaccaccccctccaagccggaacatgtagaggtgaggagcagacagagagatggcagggaagccattggcaaggtgggaatcttaggaaggaagtgattccggttcttgaaaaagacaaccggattccattaagtagaatcggtatgaattgtactcatctctaggaaaaatcaattccagaagggtgagtaagatgaaatatgataagactagtgtgtgacagattcaggtttgaagcttaaggtggatggaatcgaaagaaaggtatatttggtgtcaagtgtttgtggcggcatgtgaaatcattatccacgtttgataacagtttgactctttgcctgctataataatagtagtaagtatgtatttaacattcaatgcgtaccttgtgtgggggaggcactgctaaatgctttgcatggacgtacctccttacctctatgaggtaggtggccattatgatgctcatagaggctggacagctaatatgaggcggagcctgtatttgggctcaggcagtctgactctggtgcccctgctgtgaagagctgtgccctgctgcattcctcctgtagctgcacgaaagggtgtggaatcttctagaaacagtgagttctatatgagtggagtgtggtggtgggagaatagatggagtaaagccttttgtgtaaacataccatgctaagtactgggagatagaaacgaaatgagagatttttttgttttgttttttgagatggagtcttgctctgtcgctcaggctggagtgcagtggtgcgatctcagatcaccgcaacctccaccttccaggttcaagcaattctcctgcctcagcctcctgagtacctgggactacagacacacgccaccacgccggctaatttttgtatttttttggtagagacggggtttcatcatgttggccaggatggtcttgatctcatgacctcgtgatccacccaccgcagcctcccaaagtgctgggattacaggtgccagccaccacacccagccaaaataagacatttctttgcccctgccaccaagatatttaacatcttacaggactaacaaaacctaacatgaaccagtccagattcatatgatagaatatgaaaatgttttctggaaagaatagccagagtcccagtctggttactagaagacactttccctgtcctttccccacctgtagcccttccaagctggaatgtgcagaggtgaggaacagacagagagatggcagggaagctattggcaaggtgggaatcttaggaaggaagtgattccggttcttgaaaaagagaaccggattccgtcaagtagaatcggtatgaattgtacccatctctaggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 3774 - DNA, 63959 bp, human
ccgcccctggctagccgcgcccgcccccgcgctcctgcttcctcccctctttccctccccgcctcccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggtgcgtgcctcggccttccctgggtttttggctcgatggggactaagaggcagtggggtggaggtgggggggatcgggagtgaaatgggggctctccatgttttcctgtgcgggggatggtggggagtgaggagggagtgaagggggggccctggttttgtcaccaaggatggcgggcagtggggggtggggcgaggtggggacacctcttggttctttcagccaggatagctagcaggggctgtggggagcgggtgaggatgaagcggtgggtcgactcccttggttttcccatcaaggatggcggggatcgtggaggggggagatgggagacctgccttgcttcgctcaacgaggatggcgggggtggcgacgaggagtagacgtgagggggcccgcctcggttttcttgactgggatgcttgtggggtggttggaggatgggggtggggtgcagaataaggagggagggggagggcccgctgtggttcttctgtccaagggggatggcgcgggtttggcgaatgggggtggggagggggtatttcagctccagcgtggaatctagagaagcacgaggaaggttctatcacgggggttgagccttagaaggtgggttttcaaaactgcagggcgtgacctctcccgcctcgaaaaacgtgaaatccttacaaggtgccgtctgttctaggctctgggacagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaagggcaggagatacatccttgtagcatttcgcttggttttgagaagagtagaagtagtagaataagcgtatgtatttgctggaagtccccttgtattcatttaaattatcccttcgggattatccgagccccctttgatttgggtttggaatagatccagttttcctaattggagccatcatcttgtaattgcttgtaattcttctctgggttatcaagtctatggcaagcttatagaacagcaggaataattttttccgtcatcttaagacagttttaatgtaaacgttacggtgttccttgcaaatgtgaacatttgcagaatagcacaagtttaaattatgggcccccctggaattttgtaaagcctttcctgcctcagctcatctccaagaaccgggccctcccgatccttacactgaagaagcaagagcttctgggatggtagctttgcctttacaaactcatgttcatgtttgcttaagaagaatacgtattaagcaggcatttgccttttatgtggtgagactatagtgttttcccatttttggttacataaggttccgatcaagtctttaccttcagtctttaaaaatgcttatttaacatttttaagggcaaatataatctttatgcaacaggaaattggtcagataggccatgatttgtgcaaaccacctcacgataagtacatagtctaagactatcatatagattctgtaaccatatatggtttttgaaattctaggctaccattcccatatttaattttcagaaaaggaaaatatttttttcagccaagtctagatttttgagtgaaactaagaaaaattgtgtaagatttaaattgataaaattcctcctgtataataccagtgcattggaggtaatttaatatatattaaatgaatcgaccgctaaaacaaaataattattttttttcctggaagtgttaaactggaaatgtttaaggggaaatagatttttagtcacaaagaccgacaaaaatgcatttatttacactattgtattataatgttagtatggtattcattctgtgcccccaaatagcaattgaaaaaatagcatatttttataataaaatttaagcataatgtttttttctctgaggagtagaatgcagaaagtggtaaaaaatcttttacagagagaagcatgttgataggaagtgggctttaagtttctctctggacagaaggtgtaaatggcgtatcttttacctggctttttgagaatctgttgccctctaggacatgaaagacatttcaggaattaacagaagtcggatcaaattctcttgctagatgttcttaaagattttgctgatacgcatttgaaaatttgtaaatcacgttttcatgtaagaaattaaccctcacctctaaagtttgagcattaaaaaagtttgttgaaggcatggaaggtaatctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactgaacttttttttgttaattgaactatctagttgtttggatttggggtaaaagggagtagactgtaattgttttttcttaaaagatcttttcttttagctcctgtgggacaagagcagagaaaggttcttttttggtcagtggtgtacttaattaagcagaatatatgacttttcgtttattcaacaaacatttgccgagttacctcctctgttggaggctccatgctaggtgtggagttatttggttgataagaaatggcttccacctttctggtgaagttatgaaaatgaaaaatagacagtgaatctgttgtgagtaatcaagaattgtctggagttttttggacagacaaaaaagatttcttgatgtttacattcagctttgtattactgtatagagtagggagaagtggatggccagcatcccttcctgcgacttaatgcatctctgatggcaaattgggcctccccaaaatatttttctggggtcaactttgaattatggatagtaatggatgatggagcccagaagagtggatagtcctaaatagtagctcgaataaacctttgaccttctacagggttgcttcctgagtgcctggagaaatcccctctttgtggatagtgccacactggtggttttcagccagggcgcttttgccccccggggtcactcaacaatttttgctagatgcactccactggcatccagttggtagagacagggatgctgcttaaatatccaacagcgcatagggcagtgcctggcggcaaacaaaattatccagcctgaaatgtcgatatgccgaggttgatgtaatttcctctacataatgtagcagaacataattccaggagagtagagaacaataacagcgtcttgaggtgactgagtagttggcggagctcactttattcgtctcaaaaatgactagtttcagccaggtgctgtggttcacgcctgtaatcccagtactttgggaggctgaggcaagcggatcacttgagcccaggagttcgagaccagtctggccaacatggcaaaatcctgtctctactaaaaatacaaagaattagccgggtgtggtggtgtgcgcctgtagtcccagctacttgggaggctgaggcacgagaatcgcttggacccaggaggcggaggttgctgtgagctgagattgcaccactgcactccagcctgggcgacagagtgagaccctgtctcaaaaacataaaataaataaataaaagtgactagttcctgcataccaacctgaagaattaaagaaaataacagctaccatttatggcacttactctgtgccagaggacttgtatacattatatattctcttcattttataaatgaggaaccacactcagagaggtagaagatcttgcctggagcctcacagctggtcaaggttagaagtagaaatcaagattaagattattactccttttaagttcatggttttaagcacaactatgcattatctcccttgcggcatgcatcattcaaaatcttatgtaacaaaatgaaaattactatatgtcctatataccattgggcttgcctgagagtaattaaaaccatgaatgctaaatgtgatcatacttggagtaagtgacaaggagtaggggaaaagggaaccaacattaattgaacacctactaaaatttcaggaagcacgcaaattaaatatatactcattgtctaatttgattctcagagcaactctgcagttatgatgcacattttacagatgagagtgggagatatttgttaagtaacttgtctaagattgcacaactaataagcagcaaggttgggatttgagatgatgtcccacaaccaagccactctttgctgcttactctaaaggtaggaagtaagttgagcctcttggagaaaggaaggtaactggctctgggtaaaaagtaacttcaggcagagcgcagtggcttacgcctgtaatcccagcactttgggaggccaagccgggcagatcacctgaggtcaggagttcaagaccagcctggccaacatggtgaaaccccgtcatggctaaaacacaaaaattagccaggcgtggtagtgggtgcctgtaatcccagctactcgggaggctgaggcaggaagaattgcttgaatccaggagtcggaggttgcagtgagccgagatagcgccactgtattccagcctgggcgacagagctagactccatctcaaaaaaaaaaaaaaaaaaaaaagtaatttgagaggtaacacgtagtagacgttggattatattcaggtagagaatggagagatgaattgctataccttcctcatctgataagaatcgaattctacctggaatttgttctagagatctactcaaattgaaacagtgattgtcattttgtcaaacttcattttctatctcacctgaattttccaagctgtgctttgataaccatgaacctggaagttatggaaatctgtgcttaacctttcggtagctcaccttccacctttcttagggctgtcctgtagaacttaggagtgacaacatttggtttttgtcttctttttacacaatttaaacatttgtgcttgctatggaaattgtttttataatacgcggcatcaaattcattcttgtgtttttcatatggggttgttttgttttgacaactaaatatttactttaagttttaacgtgttttgtttcggagcacaaaaagaggaaacatttaaaaaacagcccaatcacaatcattttgtctgaaaagcatttttttgcgggaggtgggggggggcaggaaaaggaccacatgtttaatttcatttgcttcaattggaaaggaattttaaccacgattctcaagggccaggatgctggaaaaaaatgttatttagataaaatgcctgttttgatatccacatagaactgtgagccatagattctgattataataataatgtcctgattctactacagcaatcagccacttgagtaatcaaccactgtgtatagacagacatgcatggtggtaccatctgatttgtcccatcacccattgattcattctagagtagacttgagagatctgatagaacttgcaagaatgaatgatccttttgaaaatcaaatttttcaataagaatggtacattttattgtaggaaaatgcagaaaatatagaaaagcttcaagaagaaaaccaaaatcagtcataatccaccaccccaaaattaatgacaatattttgtatgtcctttaaaaatggagtactttctaaaaatggtggattcaagcccattgcaaaacctccaacttatatagtgtgttatttttttttaaatgactagattttctgaacgactgctacatctctagatggaagtcatggtcataacccatgaaaagggaaagctgacaggtagttggagaactatgctatagcctcttcctggcagctatgtaaagaagcttaagggtagctccttcaaatttctcctcttccagcttgaatgatcaagtttcaatgctaaaagaggctgttagtacccaccccccattattttacagatgaggaaactgaggctcaaaggggtcaagcacctaatgtgctaacgtcagagttccagcttgaatttttagattgtcttcataggtaggtaaattttttatttcctaaagattcttcacagtcaaaaactttttcatggcctgaccctcaaaagaacaagctattgtggtgggagtatactataaaggatactaaaaggccaagtataataacttgctaatttcagaatatgttccgaacagctgtgggcagtacaggaatttttcatgttatttgctttattgtaattgaacatttagtgatggggaacctcttggatgggtctagctctcagtttaattttctctagcctatgaggcaagtgccaaggcatatgaagtatgcctataggtacaaaaatgaaagatgacattgaaagagtctttagacatggtagcctggaagatcgcaattagggcttttgctccatgaaagtatttttttcctttataaagggagatatctgttgaaattgtgggatagagattttaaagattgcatctgcttccaaactaaggtcaaaagttaaattgtagtaaatgtgtgcagtgtggtatcattaaactgtacacacatacgtgaaattgttgttttaatctggcatcttttttttttttttgagatggagtctccctgtgtcgcccaggctggagtgcagtggcgctctctcagctcactgcaacctccgcctcctagcatcaaccgattctcttgcctcagcctccctactagctgggattacaggcacgtgacaccacatcttgctaatgtttgtatttttagtagagacggggtttcaccatgttggccaggctggtctcaaactcctgacctcaggtgatccactcacctcggcctcccaaagtgctgggattacaggcgtgagccaccacgcccggccttaatctggcattcttaaaaaaatcagttatttagctttcttccccctcttctcctgccccatttcatttctttctgtagctgtgagggtcattctctctttgtatctgtttcactctcagggtgactcttttttcagtccacctgactgcactcactttcctttttccaggctctccgtggatccatatccttctatcacattcatctgccactgcatcttgcccttgtccccgtttgccagtgttaacaattaccccaccctgggctgggccagggctgtttttcagcttaggccgggcagggaagctgatctccagggcagatgtggagtgagaagagttgttgtcactctatacagaaatgtcattgacagaataggattaaacaaaatatgtacagagattacataggctatgtatacatgtaaacttgtgaacacaaaatcattccttctttacagctagggtcccagcaaatgctacagctacatgaaataatgagtatggatacctattgccgagggcttactatttgaacaagtgagagaattgtactcttgcctaggggtgtatttttaagtagtttttgctcctgttccttattattgcctgctaatggatacgtatattgtcagtaagtgaccaactctcctagcttcctgtagtacactgtatttctcttctgaaaatggattttcctctgtatttaaaccacagatttacttgtgcctcatttttgaactactatagataaaaactcacagataggaaatacctgtggactgtttgaaatgcagtgaaacctagaaaaaaaaaaacaatcaaaataataagtatctcctgtcggcattttactgcttgtagaattgatattctatttgcccacataaaatctctctggatgttattcctattgcaagacatagtagcttttcttcctgttccttattattgcctgctaatggatatgtacattgtcagtaagtgaccggctctccacagcttcctatagtacactatttctcttctgaaaatggattcctctgtatttaaactactgagatttatttgtgcctcatttttgaactactatagataaaaaaggcacagataggaaatacctgtggactgtttttgaaatgcattgaaacctagaaaaagaaaataacaatcaaaataataaatatctcttgtaagcattttactgtttctttttacccacataaaaactgtctggatgttattcctgttgcaagacattaaatgttctatagccttttttttttttttttgagacggagtttcgctcttgttgcccaggctggagtgcaatggtacaatcatggctcactacaacctctgcctccgggttcaagcgattctcctgcctcagcctcccaagtagctgggactacaggcacccaccaccatgcccagctaatttttgtatttttggtagtgacggggtttcactgtgttggtcaggctgatctcgaactcctgacatcaggtgatccgccctcctcggcctcccaaattgctgggattgcaggcgtgagctgttctgtagactttctaataacaagaatttgtaacagtcacaaggttttaaatttccttttcagtactaaggaaatgatagctgggaatgcaaaggctttattggcaagattgttttgacaaggatggcacaaaactaaatttctatacttgattaatttataagtcttgtcactcacttttagttttagagtgtggataaagctgtttgattcttgtcagatttgaaatgtatgatttatgagacattaaggattggtttttcagtgcactctgccaggtctagttttatgcgtcattctggtttgggaagctgagtgcaagtctgcctacagacataatcaatcacctgcactttcgggtggccaggtggactgaagtaacaggtttccccccaggtttctcagagactaaggaatacacacacacacacacacacacacacacacataggcagacctgcaaattatcggtccaaaaatatttatatcactaagccagagcagtggatttagacatttgacttaacaaaatttgtttttcaacacgttctagcaactaccctgtaaatgatcgtcatttcacctacaacaatgaaaagataaagtcctcagccgcatagcttctagaggctaaagaggcacgttaagttgcttgtcaaagactccacaccttcagatgccagggtcaacacaagttttcaaaccctagacccaatcccttctaggccacagaaggtctgcctcttgtaaggaaggaattttccaatgcactaagcacagctaatcacactaaggaaagaaaccaagcagccaaactaatatgaggaagtgaaagtttatacttgcatcttatagcagatggcctttgttagagccacttttaaaatatcaacttcaccgagcatgatttaggtacaaaaaccggcatccaattaaagcctccaatttgatgagtttagacagatgtatatacccatgaaaccactgccccaatcaggatgtggaatgtttttatcacctccacaagtttatccttgccccttttccagtaacattcttcccccagcccctttcccccagatatcccgttatgcttttgtgtgagagccactttcaaaactcagatttgaaagtttgtggatcttcctctataaaaagactatatttatgtccaaaatgcaattgtcttctctatgtttaaaataatactacagagaaattctaggtattgatttcctagaatctttccctcatcctctgcaagtaagctacttagtaaatagtttcattatgtacttgaattgaagagaaattacagccaagagaaaaacaattctgatagacagaaaagcagtgtatgttcttctcaagtagttacagtgaggtgttaaatccctcaagaaccagagaagtaaaatttgaattttgcttcgtacttatttgtaaagtaaaaatgaagactgagaataaaggttttatatgtatctatctgtctaatcattcatccatccacccatccctccagctagtgtgtgtatatatgtttctgtataaaattactatgtattaataaccctatcccttgaggattacaaaagatttgaaggcttcagagggaattttctgtgcatgaaaggtgtactgtctttacacacttaggtgcaaagcaagcttttcatatgctgttattactctcattgatatatttaattgaactaataattattgagcaatttaaaggctgctgcattgagatggagtttgtcccttcgtttgtcaccttctagaaaaatccaagtgtcaaaaaatatctcgctggctctctgttctgttgctattacttcggcatgcgtcgtctcctcttgccactctcgatttctactgtttctgccctatcttccttccctgattttcctcctccatgtctttcccgtatcctgatgccacttctcttgcactgctctgatttctcatgagaaagccatttttataaacatctccagaccgagagggcagcagactaattccaatgtgtcagatagcatcttggaggctgtttctcctgtgatccaacacttttttcacactcctttccagtttcgagctgtactggaaattggagagttgtgaaaggatggtttttggataatcaaagttgaatatacttgctgggctgtgttatgaccgtctttgaagccacgaatcattaaaaataagtgaatagtttacattataatattcctaggaaacttcctttgataattgtaaagcaattaaaattgtcctgagataaggtgatttattgtttttcagaatgggccataaagatattaaagaacccattcaacatttgtcaaaacccataaaatgcacaacgcaatgaatgaaccctaatgtaaaccctagactttagttcattataatgtattaacgttggcccatcaattgggacaaatgtaccacatcaatacaagatattaataataggggaaactgggagatggatgctaaggaggtatacagaaactcagtacttcctgcttagtttttctgtaaacctaaaactgctaaaaaaaaaaaaagtctactaattaaaaaaaaaaactcttcaaatgtatgggtttcagaaatacaaagactagatcaggagctttttattattaccgtgtggattaaagtctactgtttgtggccaggtacagtggctcatgcctgtaatcccagcaatctgggaggctgaggtgggtggatcacttaaggccaggagtttgagaccagcctggccaacatgatgaaaccctgtctctactgaaaatacaaaaattagccgggtgtggtggcatgtgcctgtattcccagctattcgggtggttgaggtgggagaatcacttaaacgcgggaggcagaggttgcggtgaaccgagatcacgccactgtactccaacctgggagacagagtgagaccctgtcttaaataaatacataaataaataaataaattccagtgtttgtttttcagaatgagtgaaataagagatgtgtttctccttgagtgatgtaacttgtggcacgagcccctgaaaaggggaagtatgaggttccaggagagctgcccagtacctccaatgctatgtctagttgcacaatagtcagtagataggtcagtgggagcagtgggttgggacttcgcttgccacccttgaaacatcatgccatctttgcagtggagtcccagatttggcaaattccctgccctacaacccagtgggccctcttttgacccttgcatttgtggtatcattagcaacagtgacagttggtgaacttatgccaactctgagccaatatccaggtcagagtttgattgctttgggccaaaggctattattgcatggcttgtagaagcataggcccaatgccagaacttccatgcacttactcagtatggccagctctacagtaaacgtgtgtgaaaagattcggtttttataggcattaatgtaaatagtttctttatattggacctgggtaactatgatgggcaattacaagtacccattgctttcctgagttggctatgagaacagaacattctgtggtacgtggtagtgggggtgaggggaggatcaggtctaagagggacattgcagctgcaaagggaaagaaaaaaactgagaagccatcaaggattagaaggcaaatgggagccatcactcaagcactgtgtatcttgaagtggttgtctgtcaggtctgtgataagacctggggtgaaaaacctcatagttcatgtgattatctgaaaaataccaataaagggaagagttgattatagagttcgcctgtttagtttttttgtttgtttgtttgttttttttgaaactgtgtcttgctctgtcacacaggctggaaaacagtgacgatcgtggctcactgcagtcttgacctcctgggcgcaaacaatccctctgcttcagcctcctgagtagctgggactgcaggtgtgcatcaccacacccatctaatgttttagtttcgtagaggcagggtctcgctatattgtccaggctggtctcaaactcatggcttgtttagcttattaaactttattttgtatattggaaataattctttgtgtacagatctgttaggtgtcctcattgttacatctattgttagacagaattttatttttcttaatttcattggttgcctgaattgactatatatgtggtaccacctgttaaaagcagattttgatgaggaaggggagaaagaggataaaaataacctctccctcaagtcccatttcatgatggaagctaggattccagttcagtggccaggctaaatggtcacttgatgccagtagtgagctactgccactggatttctttcagtcagcttcacaatcgacaccaaatcctgcagctgacgtgactttactgcaattcatgttgattggaaaaatggcaaaagtcaccatctaacccaatcataatatgtttgtttcccagatatagacaggctgggttcgtcattaggcctagtgtagtcatgctccctaactactgtgagtatctggaaggattggggaggtatagtggcagcggcttgtgggacaggcatgtgacagcatccttttgcccccttgctgctcacccacctgcttcttgccacctattggctcctctttgtcttcccctcattctgtcttctctttatccttaatccagttacttttgaattttctgttaaggaaccaggagagcctcagcatgaaaataattggcttaagtattcaaagtaccagagcaacatactttataattcttggactgcctgattgttactgctgcagtggtttgttgggtattaaatgagacttagggtattttgtaaacgttttctgacatacaatttgaaagttgaattttgtcaccttacaaacttagttattcctgcaacttttaaaacccccctaaattttccttatgtgttcatgattatccccatagcagataatggccacatgcgtgctgatatgaaggatttgctccagggctaattgatgggagcagagctgcccagttgctgaattgtaaggaaacagttcatggagcgccaatgccaatttaggaaaagtatggggctgagtacttagtaagatgaaataaaaaaatatttatccagtgcttactctaaggagaaggcacttggctaggtttgctagatgctgtggggagccttaaaacaacagtgatctcttcaaggccgggcgtggtggctcatgcctgtaatcccagcactttgggaggccgaggcaggcggatcacttgaggtcaggagtttgagaccagcatggacaatatggtgaaaccccgtttctactaaaaatacaaacattagctgggtgtggtggcatctgcctgtggtcccagctactcaggaggctgaggcaggaggatcacttgaacctgggatatggaggtggcagtgagatgagattgtgccactccactccagcctgggcgacagagagagaccctgtctcaaaaaaaaaaaaaaaaaaaaagtactagcgatctcttcaagcaaagaacgcccattctaattggagaagctgttaaagacacatgaaggatgtggtggaaagagtattgaactgcatagggtgtggggagagagtcaggagttttgaatcctagcctgagttctgccactaagcattggaaactctgggcaaatcatctccccactctgggtctcagtttataaaaaggcaaatgaacgagatcatctctaagatattctgtagattgattcataaatgtggaagagattctggaaaacggaagcttgagcccaggagttccagaccagcctgggcaacatggtgagactctgtctctacaaaaaatacaaaacattagcctggtgaggtgatgtgtgtttgtagtccctgtttctcaggaggctgaggtgggaggatcacatgggcccaggaggctgcagtgagctatcacctgggagcttgttagaaatgcaactttcatgggccccactccagacctagggaatcagaaacgctggggatggggccccgccatctgtgtcctaacaaggtcctctctcaggagattttgaggcacaataaagtctgacaattacaggctataggaatttgggtcagtggttctcagcctctgccatacaatagattcatctgggggaactttgttgggggtggggcgctgactttgtttgtgctgctgtaacagaatatctgagactggataccttataaagaacagaaatctatttctcacggttctggagactgggaagtcccaagatcaaggtgcaaacaggttcgattgttaagggctgctctctgcttccaagatgacactttagttctccagcctccagaggggaggaacgccctgccctcatgtggcggaaggcagaagggcaagagagccaaaggctctgttgaagctttaatcccatccaccagggaggagctctcccggtttaatcaccccacctcttagaggccccacctctcaataccatcacattgtccattaagattcaacacctgaatcttggacacatgaaaaccgtagcaggcacccaggcatcactagttgctttggctctccaggtgccgccaattttgagaatcactggtttaggggaaagtggcatgaaccaagacttctgtcattctctagctgcaatgaacgtcagatgcagggagtcagccaaagccagaggcttgaatttcactcaaagaaacttggcctttagattacaatggagaaaggtttttggcaatgggagtgatacatccgaggtggaacatttgagagatgattctgatgctagctatgtgaagaagagggcatacccatagttaagaaatctgatgaaatagtctggtgtgaagtgataatgggccaaattaggaccttagaaatgaaattataaggaagaaaatgtatgaaagctcttttgcaggaaaaatgggcagggtttggcgatggttgctggggtgacagcaatgttagaatgtctttggttcaggagtacctctcagacttctgggagggccagtgctctctagatgcatctggcaaaattgtcatgtatggatctgtacaattctttgttttttgttgctttgatttaggagttataatgcggaggtgacccacagcaagttatagaaaaatacagaattacagtcacctcaaaagctactcatggtcatcatgtcagagggaaaaaatgctgtttttcttttaaggaaagaatgcttggagttgtgggaaagttgtagacttggcaatgagtaattcaagcctatcagtcaattaagtgagtttttattttatcatttgttttatttgggagctgctgtaatagtcattgagaggacatcagtcttcatatttttaaaacaaaacaaaaataccattgaacattagggcaaaggacaagaatttcaaggtttttaccttttgacttcagcaaatatttgctgctccatttttcttgctagattttgccatttgacttgtgtttttcctttgttccaatttgttctttgtgcttgataactgtagtgtactctatttttttttttttgagacacagtcttgctcttttgcccaggttggagtacagtggtgcaatctcggctcactgcaacctctgcctcctggattcaagtgattctcgtgtctcggcctcccaagtagctggaattacaggcacgcaccaccatgtctggctcatttttgtattttcagtagagatggggcttcaccatgttggccaggctggtctcgacctcccaaagtgctgggattacaggcgtgcatcactgctccttgcctctattctattttcgatggcttttttattcataagtattcttaaggttttaatattccagttaaaaaataaatatatttgtccctttatgtttttccccaatatacttattcttcctttatgaccaaaaattattcaaatttgcatccagaaatggctcacagaaagagctccttggtatttatttagggcatggtgggaccttttgttagtttctaggtcatgccacatctggaaggaaagacaccttttatttactaatttgaaaatctatgaaagcagactcagtattttacagggttgcatatattcctatgcaaagttgcatatattcctatgcaaagttaaaaatgactcactactccaactttggtaaatgtgtgcactttagtttttgaaagaagtgcaaaaatctgcagaaaaatctggactaatcataacttgaaatttttagtatatctggtagataacttttaaaaatataacccatcttttcccaaactggatagggataattcctctctttgcaaattgtgaggaatattatgattgtatcatataaaataaatatagaaacgtgtagaataaatgatcttccagagtatatagaggatatcaccagataatactctgtactaaatataaggacacaaaactggactttattatatttctataactggtaatatccttccagtttttgcttgtttattaaatgaatatactgttaaagatttggttatgttgtagatcttaattatgttggaattattaaaaatgaggcatctttaatctgtactgcttatttccaataaattattttgccgaatgagagccagtttaccagttcttttgttaaagaaaatgagccagtggctacctcagttgtatttatcattgccttttatggtaaacatttaaaatgtgtttttaatggtgcacatgccgatgtttctgacctctatagtagcataagtatttgaataaaagtgaggtaaatgagaagtctgtgccacccagtctcatcacaagtgtacctaattaagaagatgtttggaattcactgttctttgatttcttgggtgggagagaatattctgaaggctgtgattaaggaatcgttaccatgacaatcacattcaaagaattgagaggagacaatgagtctgtgggggatcatctcttttgattgatttgactcttcttttaagttctttcaaacagctgttgtcactggattttcttttccacgtaattcacacaattgattggtgatgtggggatcattgaagcttggttgtcagtagtgataagggtcagcagtgtccatgaccacaatacttttgctaaacctggagagtgattgtatgtgttaaatgtcactaaaaagtaactcttggcttctttctggaataatatatgtggtttgtctattttcacttattaattttgtcagggtgggatatgattatcatgatctctttgaaagcatgactaactctaaagtgtttgagctttattttggattactttgctgtcatcttacccagtgttttgtgtgctgttttgtttttattctttaacttgcacaatgttgtcaacgtaatttatatgatgttctggtcagagacacagttacacgctgcagattgaaaagtacacacaaatatacccaccatgagtgcttcagcctcacgaccccagctcatgttaagtgggacatgctagtacagatgataaagtgaaatggagatacaaaggcagttcagatctgactgtcaatttttctcctttgtggactaattctgggtggtgaaaccatgaactatggaacgaagactgctccagcatgagtctgagttgaatcccatgtgagagctttgcctcctcagcctttgggcctttctttcttctgccctctggagggtgtcagagaacatgaaatgcaaggactttctggaaaggatagccagggtttggtctggtaactagaagacactttccctgccccttccccaccaccccctccaagccggaacatgtagaggtgaggagcagacagagagatggcagggaagccattggcaaggtgggaatcttaggaaggaagtgattccggttcttgaaaaagacaaccggattccattaagtagaatcggtatgaattgtactcatctctaggaaaaatcaattccagaagggtgagtaagatgaaatatgataagactagtgtgtgacagattcaggtttgaagcttaaggtggatggaatcgaaagaaaggtatatttggtgtcaagtgtttgtggcggcatgtgaaatcattatccacgtttgataacagtttgactctttgcctgctataataatagtagtaagtatgtatttaacattcaatgcgtaccttgtgtgggggaggcactgctaaatgctttgcatggacgtacctccttacctctatgaggtaggtggccattatgatgctcatagaggctggacagctaatatgaggcggagcctgtatttgggctcaggcagtctgactctggtgcccctgctgtgaagagctgtgccctgctgcattcctcctgtagctgcacgaaagggtgtggaatcttctagaaacagtgagttctatatgagtggagtgtggtggtgggagaatagatggagtaaagccttttgtgtaaacataccatgctaagtactgggagatagaaacgaaatgagagatttttttgttttgttttttgagatggagtcttgctctgtcgctcaggctggagtgcagtggtgcgatctcagatcaccgcaacctccaccttccaggttcaagcaattctcctgcctcagcctcctgagtacctgggactacagacacacgccaccacgccggctaatttttgtatttttttggtagagacggggtttcatcatgttggccaggatggtcttgatctcatgacctcgtgatccacccaccgcagcctcccaaagtgctgggattacaggtgccagccaccacacccagccaaaataagacatttctttgcccctgccaccaagatatttaacatcttacaggactaacaaaacctaacatgaaccagtccagattcatatgatagaatatgaaaatgttttctggaaagaatagccagagtcccagtctggttactagaagacactttccctgtcctttccccacctgtagcccttccaagctggaatgtgcagaggtgaggaacagacagagagatggcagggaagctattggcaaggtgggaatcttaggaaggaagtgattccggttcttgaaaaagagaaccggattccgtcaagtagaatcggtatgaattgtacccatctctaggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 3775 - DNA, 59814 bp, human
agcaggggctgtggggagcgggtgaggatgaagcggtgggtcgactcccttggttttcccatcaaggatggcggggatcgtggaggggggagatgggagacctgccttgcttcgctcaacgaggatggcgggggtggcgacgaggagtagacgtgagggggcccgcctcggttttcttgactgggatgcttgtggggtggttggaggatgggggtggggtgcagaataaggagggagggggagggcccgctgtggttcttctgtccaagggggatggcgcgggtttggcgaatgggggtggggagggggtatttcagctccagcgtggaatctagagaagcacgaggaaggttctatcacgggggttgagccttagaaggtgggttttcaaaactgcagggcgtgacctctcccgcctcgaaaaacgtgaaatccttacaaggtgccgtctgttctaggctctgggacagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaagggcaggagatacatccttgtagcatttcgcttggttttgagaagagtagaagtagtagaataagcgtatgtatttgctggaagtccccttgtattcatttaaattatcccttcgggattatccgagccccctttgatttgggtttggaatagatccagttttcctaattggagccatcatcttgtaattgcttgtaattcttctctgggttatcaagtctatggcaagcttatagaacagcaggaataattttttccgtcatcttaagacagttttaatgtaaacgttacggtgttccttgcaaatgtgaacatttgcagaatagcacaagtttaaattatgggcccccctggaattttgtaaagcctttcctgcctcagctcatctccaagaaccgggccctcccgatccttacactgaagaagcaagagcttctgggatggtagctttgcctttacaaactcatgttcatgtttgcttaagaagaatacgtattaagcaggcatttgccttttatgtggtgagactatagtgttttcccatttttggttacataaggttccgatcaagtctttaccttcagtctttaaaaatgcttatttaacatttttaagggcaaatataatctttatgcaacaggaaattggtcagataggccatgatttgtgcaaaccacctcacgataagtacatagtctaagactatcatatagattctgtaaccatatatggtttttgaaattctaggctaccattcccatatttaattttcagaaaaggaaaatatttttttcagccaagtctagatttttgagtgaaactaagaaaaattgtgtaagatttaaattgataaaattcctcctgtataataccagtgcattggaggtaatttaatatatattaaatgaatcgaccgctaaaacaaaataattattttttttcctggaagtgttaaactggaaatgtttaaggggaaatagatttttagtcacaaagaccgacaaaaatgcatttatttacactattgtattataatgttagtatggtattcattctgtgcccccaaatagcaattgaaaaaatagcatatttttataataaaatttaagcataatgtttttttctctgaggagtagaatgcagaaagtggtaaaaaatcttttacagagagaagcatgttgataggaagtgggctttaagtttctctctggacagaaggtgtaaatggcgtatcttttacctggctttttgagaatctgttgccctctaggacatgaaagacatttcaggaattaacagaagtcggatcaaattctcttgctagatgttcttaaagattttgctgatacgcatttgaaaatttgtaaatcacgttttcatgtaagaaattaaccctcacctctaaagtttgagcattaaaaaagtttgttgaaggcatggaaggtaatctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactgaacttttttttgttaattgaactatctagttgtttggatttggggtaaaagggagtagactgtaattgttttttcttaaaagatcttttcttttagctcctgtgggacaagagcagagaaaggttcttttttggtcagtggtgtacttaattaagcagaatatatgacttttcgtttattcaacaaacatttgccgagttacctcctctgttggaggctccatgctaggtgtggagttatttggttgataagaaatggcttccacctttctggtgaagttatgaaaatgaaaaatagacagtgaatctgttgtgagtaatcaagaattgtctggagttttttggacagacaaaaaagatttcttgatgtttacattcagctttgtattactgtatagagtagggagaagtggatggccagcatcccttcctgcgacttaatgcatctctgatggcaaattgggcctccccaaaatatttttctggggtcaactttgaattatggatagtaatggatgatggagcccagaagagtggatagtcctaaatagtagctcgaataaacctttgaccttctacagggttgcttcctgagtgcctggagaaatcccctctttgtggatagtgccacactggtggttttcagccagggcgcttttgccccccggggtcactcaacaatttttgctagatgcactccactggcatccagttggtagagacagggatgctgcttaaatatccaacagcgcatagggcagtgcctggcggcaaacaaaattatccagcctgaaatgtcgatatgccgaggttgatgtaatttcctctacataatgtagcagaacataattccaggagagtagagaacaataacagcgtcttgaggtgactgagtagttggcggagctcactttattcgtctcaaaaatgactagtttcagccaggtgctgtggttcacgcctgtaatcccagtactttgggaggctgaggcaagcggatcacttgagcccaggagttcgagaccagtctggccaacatggcaaaatcctgtctctactaaaaatacaaagaattagccgggtgtggtggtgtgcgcctgtagtcccagctacttgggaggctgaggcacgagaatcgcttggacccaggaggcggaggttgctgtgagctgagattgcaccactgcactccagcctgggcgacagagtgagaccctgtctcaaaaacataaaataaataaataaaagtgactagttcctgcataccaacctgaagaattaaagaaaataacagctaccatttatggcacttactctgtgccagaggacttgtatacattatatattctcttcattttataaatgaggaaccacactcagagaggtagaagatcttgcctggagcctcacagctggtcaaggttagaagtagaaatcaagattaagattattactccttttaagttcatggttttaagcacaactatgcattatctcccttgcggcatgcatcattcaaaatcttatgtaacaaaatgaaaattactatatgtcctatataccattgggcttgcctgagagtaattaaaaccatgaatgctaaatgtgatcatacttggagtaagtgacaaggagtaggggaaaagggaaccaacattaattgaacacctactaaaatttcaggaagcacgcaaattaaatatatactcattgtctaatttgattctcagagcaactctgcagttatgatgcacattttacagatgagagtgggagatatttgttaagtaacttgtctaagattgcacaactaataagcagcaaggttgggatttgagatgatgtcccacaaccaagccactctttgctgcttactctaaaggtaggaagtaagttgagcctcttggagaaaggaaggtaactggctctgggtaaaaagtaacttcaggcagagcgcagtggcttacgcctgtaatcccagcactttgggaggccaagccgggcagatcacctgaggtcaggagttcaagaccagcctggccaacatggtgaaaccccgtcatggctaaaacacaaaaattagccaggcgtggtagtgggtgcctgtaatcccagctactcgggaggctgaggcaggaagaattgcttgaatccaggagtcggaggttgcagtgagccgagatagcgccactgtattccagcctgggcgacagagctagactccatctcaaaaaaaaaaaaaaaaaaaaaagtaatttgagaggtaacacgtagtagacgttggattatattcaggtagagaatggagagatgaattgctataccttcctcatctgataagaatcgaattctacctggaatttgttctagagatctactcaaattgaaacagtgattgtcattttgtcaaacttcattttctatctcacctgaattttccaagctgtgctttgataaccatgaacctggaagttatggaaatctgtgcttaacctttcggtagctcaccttccacctttcttagggctgtcctgtagaacttaggagtgacaacatttggtttttgtcttctttttacacaatttaaacatttgtgcttgctatggaaattgtttttataatacgcggcatcaaattcattcttgtgtttttcatatggggttgttttgttttgacaactaaatatttactttaagttttaacgtgttttgtttcggagcacaaaaagaggaaacatttaaaaaacagcccaatcacaatcattttgtctgaaaagcatttttttgcgggaggtgggggggggcaggaaaaggaccacatgtttaatttcatttgcttcaattggaaaggaattttaaccacgattctcaagggccaggatgctggaaaaaaatgttatttagataaaatgcctgttttgatatccacatagaactgtgagccatagattctgattataataataatgtcctgattctactacagcaatcagccacttgagtaatcaaccactgtgtatagacagacatgcatggtggtaccatctgatttgtcccatcacccattgattcattctagagtagacttgagagatctgatagaacttgcaagaatgaatgatccttttgaaaatcaaatttttcaataagaatggtacattttattgtaggaaaatgcagaaaatatagaaaagcttcaagaagaaaaccaaaatcagtcataatccaccaccccaaaattaatgacaatattttgtatgtcctttaaaaatggagtactttctaaaaatggtggattcaagcccattgcaaaacctccaacttatatagtgtgttatttttttttaaatgactagattttctgaacgactgctacatctctagatggaagtcatggtcataacccatgaaaagggaaagctgacaggtagttggagaactatgctatagcctcttcctggcagctatgtaaagaagcttaagggtagctccttcaaatttctcctcttccagcttgaatgatcaagtttcaatgctaaaagaggctgttagtacccaccccccattattttacagatgaggaaactgaggctcaaaggggtcaagcacctaatgtgctaacgtcagagttccagcttgaatttttagattgtcttcataggtaggtaaattttttatttcctaaagattcttcacagtcaaaaactttttcatggcctgaccctcaaaagaacaagctattgtggtgggagtatactataaaggatactaaaaggccaagtataataacttgctaatttcagaatatgttccgaacagctgtgggcagtacaggaatttttcatgttatttgctttattgtaattgaacatttagtgatggggaacctcttggatgggtctagctctcagtttaattttctctagcctatgaggcaagtgccaaggcatatgaagtatgcctataggtacaaaaatgaaagatgacattgaaagagtctttagacatggtagcctggaagatcgcaattagggcttttgctccatgaaagtatttttttcctttataaagggagatatctgttgaaattgtgggatagagattttaaagattgcatctgcttccaaactaaggtcaaaagttaaattgtagtaaatgtgtgcagtgtggtatcattaaactgtacacacatacgtgaaattgttgttttaatctggcatcttttttttttttttgagatggagtctccctgtgtcgcccaggctggagtgcagtggcgctctctcagctcactgcaacctccgcctcctagcatcaaccgattctcttgcctcagcctccctactagctgggattacaggcacgtgacaccacatcttgctaatgtttgtatttttagtagagacggggtttcaccatgttggccaggctggtctcaaactcctgacctcaggtgatccactcacctcggcctcccaaagtgctgggattacaggcgtgagccaccacgcccggccttaatctggcattcttaaaaaaatcagttatttagctttcttccccctcttctcctgccccatttcatttctttctgtagctgtgagggtcattctctctttgtatctgtttcactctcagggtgactcttttttcagtccacctgactgcactcactttcctttttccaggctctccgtggatccatatccttctatcacattcatctgccactgcatcttgcccttgtccccgtttgccagtgttaacaattaccccaccctgggctgggccagggctgtttttcagcttaggccgggcagggaagctgatctccagggcagatgtggagtgagaagagttgttgtcactctatacagaaatgtcattgacagaataggattaaacaaaatatgtacagagattacataggctatgtatacatgtaaacttgtgaacacaaaatcattccttctttacagctagggtcccagcaaatgctacagctacatgaaataatgagtatggatacctattgccgagggcttactatttgaacaagtgagagaattgtactcttgcctaggggtgtatttttaagtagtttttgctcctgttccttattattgcctgctaatggatacgtatattgtcagtaagtgaccaactctcctagcttcctgtagtacactgtatttctcttctgaaaatggattttcctctgtatttaaaccacagatttacttgtgcctcatttttgaactactatagataaaaactcacagataggaaatacctgtggactgtttgaaatgcagtgaaacctagaaaaaaaaaaacaatcaaaataataagtatctcctgtcggcattttactgcttgtagaattgatattctatttgcccacataaaatctctctggatgttattcctattgcaagacatagtagcttttcttcctgttccttattattgcctgctaatggatatgtacattgtcagtaagtgaccggctctccacagcttcctatagtacactatttctcttctgaaaatggattcctctgtatttaaactactgagatttatttgtgcctcatttttgaactactatagataaaaaaggcacagataggaaatacctgtggactgtttttgaaatgcattgaaacctagaaaaagaaaataacaatcaaaataataaatatctcttgtaagcattttactgtttctttttacccacataaaaactgtctggatgttattcctgttgcaagacattaaatgttctatagccttttttttttttttttgagacggagtttcgctcttgttgcccaggctggagtgcaatggtacaatcatggctcactacaacctctgcctccgggttcaagcgattctcctgcctcagcctcccaagtagctgggactacaggcacccaccaccatgcccagctaatttttgtatttttggtagtgacggggtttcactgtgttggtcaggctgatctcgaactcctgacatcaggtgatccgccctcctcggcctcccaaattgctgggattgcaggcgtgagctgttctgtagactttctaataacaagaatttgtaacagtcacaaggttttaaatttccttttcagtactaaggaaatgatagctgggaatgcaaaggctttattggcaagattgttttgacaaggatggcacaaaactaaatttctatacttgattaatttataagtcttgtcactcacttttagttttagagtgtggataaagctgtttgattcttgtcagatttgaaatgtatgatttatgagacattaaggattggtttttcagtgcactctgccaggtctagttttatgcgtcattctggtttgggaagctgagtgcaagtctgcctacagacataatcaatcacctgcactttcgggtggccaggtggactgaagtaacaggtttccccccaggtttctcagagactaaggaatacacacacacacacacacacacacacacacataggcagacctgcaaattatcggtccaaaaatatttatatcactaagccagagcagtggatttagacatttgacttaacaaaatttgtttttcaacacgttctagcaactaccctgtaaatgatcgtcatttcacctacaacaatgaaaagataaagtcctcagccgcatagcttctagaggctaaagaggcacgttaagttgcttgtcaaagactccacaccttcagatgccagggtcaacacaagttttcaaaccctagacccaatcccttctaggccacagaaggtctgcctcttgtaaggaaggaattttccaatgcactaagcacagctaatcacactaaggaaagaaaccaagcagccaaactaatatgaggaagtgaaagtttatacttgcatcttatagcagatggcctttgttagagccacttttaaaatatcaacttcaccgagcatgatttaggtacaaaaaccggcatccaattaaagcctccaatttgatgagtttagacagatgtatatacccatgaaaccactgccccaatcaggatgtggaatgtttttatcacctccacaagtttatccttgccccttttccagtaacattcttcccccagcccctttcccccagatatcccgttatgcttttgtgtgagagccactttcaaaactcagatttgaaagtttgtggatcttcctctataaaaagactatatttatgtccaaaatgcaattgtcttctctatgtttaaaataatactacagagaaattctaggtattgatttcctagaatctttccctcatcctctgcaagtaagctacttagtaaatagtttcattatgtacttgaattgaagagaaattacagccaagagaaaaacaattctgatagacagaaaagcagtgtatgttcttctcaagtagttacagtgaggtgttaaatccctcaagaaccagagaagtaaaatttgaattttgcttcgtacttatttgtaaagtaaaaatgaagactgagaataaaggttttatatgtatctatctgtctaatcattcatccatccacccatccctccagctagtgtgtgtatatatgtttctgtataaaattactatgtattaataaccctatcccttgaggattacaaaagatttgaaggcttcagagggaattttctgtgcatgaaaggtgtactgtctttacacacttaggtgcaaagcaagcttttcatatgctgttattactctcattgatatatttaattgaactaataattattgagcaatttaaaggctgctgcattgagatggagtttgtcccttcgtttgtcaccttctagaaaaatccaagtgtcaaaaaatatctcgctggctctctgttctgttgctattacttcggcatgcgtcgtctcctcttgccactctcgatttctactgtttctgccctatcttccttccctgattttcctcctccatgtctttcccgtatcctgatgccacttctcttgcactgctctgatttctcatgagaaagccatttttataaacatctccagaccgagagggcagcagactaattccaatgtgtcagatagcatcttggaggctgtttctcctgtgatccaacacttttttcacactcctttccagtttcgagctgtactggaaattggagagttgtgaaaggatggtttttggataatcaaagttgaatatacttgctgggctgtgttatgaccgtctttgaagccacgaatcattaaaaataagtgaatagtttacattataatattcctaggaaacttcctttgataattgtaaagcaattaaaattgtcctgagataaggtgatttattgtttttcagaatgggccataaagatattaaagaacccattcaacatttgtcaaaacccataaaatgcacaacgcaatgaatgaaccctaatgtaaaccctagactttagttcattataatgtattaacgttggcccatcaattgggacaaatgtaccacatcaatacaagatattaataataggggaaactgggagatggatgctaaggaggtatacagaaactcagtacttcctgcttagtttttctgtaaacctaaaactgctaaaaaaaaaaaaagtctactaattaaaaaaaaaaactcttcaaatgtatgggtttcagaaatacaaagactagatcaggagctttttattattaccgtgtggattaaagtctactgtttgtggccaggtacagtggctcatgcctgtaatcccagcaatctgggaggctgaggtgggtggatcacttaaggccaggagtttgagaccagcctggccaacatgatgaaaccctgtctctactgaaaatacaaaaattagccgggtgtggtggcatgtgcctgtattcccagctattcgggtggttgaggtgggagaatcacttaaacgcgggaggcagaggttgcggtgaaccgagatcacgccactgtactccaacctgggagacagagtgagaccctgtcttaaataaatacataaataaataaataaattccagtgtttgtttttcagaatgagtgaaataagagatgtgtttctccttgagtgatgtaacttgtggcacgagcccctgaaaaggggaagtatgaggttccaggagagctgcccagtacctccaatgctatgtctagttgcacaatagtcagtagataggtcagtgggagcagtgggttgggacttcgcttgccacccttgaaacatcatgccatctttgcagtggagtcccagatttggcaaattccctgccctacaacccagtgggccctcttttgacccttgcatttgtggtatcattagcaacagtgacagttggtgaacttatgccaactctgagccaatatccaggtcagagtttgattgctttgggccaaaggctattattgcatggcttgtagaagcataggcccaatgccagaacttccatgcacttactcagtatggccagctctacagtaaacgtgtgtgaaaagattcggtttttataggcattaatgtaaatagtttctttatattggacctgggtaactatgatgggcaattacaagtacccattgctttcctgagttggctatgagaacagaacattctgtggtacgtggtagtgggggtgaggggaggatcaggtctaagagggacattgcagctgcaaagggaaagaaaaaaactgagaagccatcaaggattagaaggcaaatgggagccatcactcaagcactgtgtatcttgaagtggttgtctgtcaggtctgtgataagacctggggtgaaaaacctcatagttcatgtgattatctgaaaaataccaataaagggaagagttgattatagagttcgcctgtttagtttttttgtttgtttgtttgttttttttgaaactgtgtcttgctctgtcacacaggctggaaaacagtgacgatcgtggctcactgcagtcttgacctcctgggcgcaaacaatccctctgcttcagcctcctgagtagctgggactgcaggtgtgcatcaccacacccatctaatgttttagtttcgtagaggcagggtctcgctatattgtccaggctggtctcaaactcatggcttgtttagcttattaaactttattttgtatattggaaataattctttgtgtacagatctgttaggtgtcctcattgttacatctattgttagacagaattttatttttcttaatttcattggttgcctgaattgactatatatgtggtaccacctgttaaaagcagattttgatgaggaaggggagaaagaggataaaaataacctctccctcaagtcccatttcatgatggaagctaggattccagttcagtggccaggctaaatggtcacttgatgccagtagtgagctactgccactggatttctttcagtcagcttcacaatcgacaccaaatcctgcagctgacgtgactttactgcaattcatgttgattggaaaaatggcaaaagtcaccatctaacccaatcataatatgtttgtttcccagatatagacaggctgggttcgtcattaggcctagtgtagtcatgctccctaactactgtgagtatctggaaggattggggaggtatagtggcagcggcttgtgggacaggcatgtgacagcatccttttgcccccttgctgctcacccacctgcttcttgccacctattggctcctctttgtcttcccctcattctgtcttctctttatccttaatccagttacttttgaattttctgttaaggaaccaggagagcctcagcatgaaaataattggcttaagtattcaaagtaccagagcaacatactttataattcttggactgcctgattgttactgctgcagtggtttgttgggtattaaatgagacttagggtattttgtaaacgttttctgacatacaatttgaaagttgaattttgtcaccttacaaacttagttattcctgcaacttttaaaacccccctaaattttccttatgtgttcatgattatccccatagcagataatggccacatgcgtgctgatatgaaggatttgctccagggctaattgatgggagcagagctgcccagttgctgaattgtaaggaaacagttcatggagcgccaatgccaatttaggaaaagtatggggctgagtacttagtaagatgaaataaaaaaatatttatccagtgcttactctaaggagaaggcacttggctaggtttgctagatgctgtggggagccttaaaacaacagtgatctcttcaaggccgggcgtggtggctcatgcctgtaatcccagcactttgggaggccgaggcaggcggatcacttgaggtcaggagtttgagaccagcatggacaatatggtgaaaccccgtttctactaaaaatacaaacattagctgggtgtggtggcatctgcctgtggtcccagctactcaggaggctgaggcaggaggatcacttgaacctgggatatggaggtggcagtgagatgagattgtgccactccactccagcctgggcgacagagagagaccctgtctcaaaaaaaaaaaaaaaaaaaaagtactagcgatctcttcaagcaaagaacgcccattctaattggagaagctgttaaagacacatgaaggatgtggtggaaagagtattgaactgcatagggtgtggggagagagtcaggagttttgaatcctagcctgagttctgccactaagcattggaaactctgggcaaatcatctccccactctgggtctcagtttataaaaaggcaaatgaacgagatcatctctaagatattctgtagattgattcataaatgtggaagagattctggaaaacggaagcttgagcccaggagttccagaccagcctgggcaacatggtgagactctgtctctacaaaaaatacaaaacattagcctggtgaggtgatgtgtgtttgtagtccctgtttctcaggaggctgaggtgggaggatcacatgggcccaggaggctgcagtgagctatcacctgggagcttgttagaaatgcaactttcatgggccccactccagacctagggaatcagaaacgctggggatggggccccgccatctgtgtcctaacaaggtcctctctcaggagattttgaggcacaataaagtctgacaattacaggctataggaatttgggtcagtggttctcagcctctgccatacaatagattcatctgggggaactttgttgggggtggggcgctgactttgtttgtgctgctgtaacagaatatctgagactggataccttataaagaacagaaatctatttctcacggttctggagactgggaagtcccaagatcaaggtgcaaacaggttcgattgttaagggctgctctctgcttccaagatgacactttagttctccagcctccagaggggaggaacgccctgccctcatgtggcggaaggcagaagggcaagagagccaaaggctctgttgaagctttaatcccatccaccagggaggagctctcccggtttaatcaccccacctcttagaggccccacctctcaataccatcacattgtccattaagattcaacacctgaatcttggacacatgaaaaccgtagcaggcacccaggcatcactagttgctttggctctccaggtgccgccaattttgagaatcactggtttaggggaaagtggcatgaaccaagacttctgtcattctctagctgcaatgaacgtcagatgcagggagtcagccaaagccagaggcttgaatttcactcaaagaaacttggcctttagattacaatggagaaaggtttttggcaatgggagtgatacatccgaggtggaacatttgagagatgattctgatgctagctatgtgaagaagagggcatacccatagttaagaaatctgatgaaatagtctggtgtgaagtgataatgggccaaattaggaccttagaaatgaaattataaggaagaaaatgtatgaaagctcttttgcaggaaaaatgggcagggtttggcgatggttgctggggtgacagcaatgttagaatgtctttggttcaggagtacctctcagacttctgggagggccagtgctctctagatgcatctggcaaaattgtcatgtatggatctgtacaattctttgttttttgttgctttgatttaggagttataatgcggaggtgacccacagcaagttatagaaaaatacagaattacagtcacctcaaaagctactcatggtcatcatgtcagagggaaaaaatgctgtttttcttttaaggaaagaatgcttggagttgtgggaaagttgtagacttggcaatgagtaattcaagcctatcagtcaattaagtgagtttttattttatcatttgttttatttgggagctgctgtaatagtcattgagaggacatcagtcttcatatttttaaaacaaaacaaaaataccattgaacattagggcaaaggacaagaatttcaaggtttttaccttttgacttcagcaaatatttgctgctccatttttcttgctagattttgccatttgacttgtgtttttcctttgttccaatttgttctttgtgcttgataactgtagtgtactctatttttttttttttgagacacagtcttgctcttttgcccaggttggagtacagtggtgcaatctcggctcactgcaacctctgcctcctggattcaagtgattctcgtgtctcggcctcccaagtagctggaattacaggcacgcaccaccatgtctggctcatttttgtattttcagtagagatggggcttcaccatgttggccaggctggtctcgacctcccaaagtgctgggattacaggcgtgcatcactgctccttgcctctattctattttcgatggcttttttattcataagtattcttaaggttttaatattccagttaaaaaataaatatatttgtccctttatgtttttccccaatatacttattcttcctttatgaccaaaaattattcaaatttgcatccagaaatggctcacagaaagagctccttggtatttatttagggcatggtgggaccttttgttagtttctaggtcatgccacatctggaaggaaagacaccttttatttactaatttgaaaatctatgaaagcagactcagtattttacagggttgcatatattcctatgcaaagttgcatatattcctatgcaaagttaaaaatgactcactactccaactttggtaaatgtgtgcactttagtttttgaaagaagtgcaaaaatctgcagaaaaatctggactaatcataacttgaaatttttagtatatctggtagataacttttaaaaatataacccatcttttcccaaactggatagggataattcctctctttgcaaattgtgaggaatattatgattgtatcatataaaataaatatagaaacgtgtagaataaatgatcttccagagtatatagaggatatcaccagataatactctgtactaaatataaggacacaaaactggactttattatatttctataactggtaatatccttccagtttttgcttgtttattaaatgaatatactgttaaagatttggttatgttgtagatcttaattatgttggaattattaaaaatgaggcatctttaatctgtactgcttatttccaataaattattttgccgaatgagagccagtttaccagttcttttgttaaagaaaatgagccagtggctacctcagttgtatttatcattgccttttatggtaaacatttaaaatgtgtttttaatggtgcacatgccgatgtttctgacctctatagtagcataagtatttgaataaaagtgaggtaaatgagaagtctgtgccacccagtctcatcacaagtgtacctaattaagaagatgtttggaattcactgttctttgatttcttgggtgggagagaatattctgaaggctgtgattaaggaatcgttaccatgacaatcacattcaaagaattgagaggagacaatgagtctgtgggggatcatctcttttgattgatttgactcttcttttaagttctttcaaacagctgttgtcactggattttcttttccacgtaattcacacaattgattggtgatgtggggatcattgaagcttggttgtcagtagtgataagggtcagcagtgtccatgaccacaatacttttgctaaacctggagagtgattgtatgtgttaaatgtcactaaaaagtaactcttggcttctttctggaataatatatgtggtttgtctattttcacttattaattttgtcagggtgggatatgattatcatgatctctttgaaagcatgactaactctaaagtgtttgagctttattttggattactttgctgtcatcttacccagtgttttgtgtgctgttttgtttttattctttaacttgcacaatgttgtcaacgtaatttatatgatgttctggtcagagacacagttacacgctgcagattgaaaagtacacacaaatatacccaccatgagtgcttcagcctcacgaccccagctcatgttaagtgggacatgctagtacagatgataaagtgaaatggagatacaaaggcagttcagatctgactgtcaatttttctcctttgtggactaattctgggtggtgaaaccatgaactatggaacgaagactgctccagcatgagtctgagttgaatcccatgtgagagctttgcctcctcagcctttgggcctttctttcttctgccctctggagggtgtcagagaacatgaaatgcaaggactttctggaaaggatagccagggtttggtctggtaactagaagacactttccctgccccttccccaccaccccctccaagccggaacatgtagaggtgaggagcagacagagagatggcagggaagccattggcaaggtgggaatcttaggaaggaagtgattccggttcttgaaaaagacaaccggattccattaagtagaatcggtatgaattgtactcatctctaggaaaaatcaattccagaagggtgagtaagatgaaatatgataagactagtgtgtgacagattcaggtttgaagcttaaggtggatggaatcgaaagaaaggtatatttggtgtcaagtgtttgtggcggcatgtgaaatcattatccacgtttgataacagtttgactctttgcctgctataataatagtagtaagtatgtatttaacattcaatgcgtaccttgtgtgggggaggcactgctaaatgctttgcatggacgtacctccttacctctatgaggtaggtggccattatgatgctcatagaggctggacagctaatatgaggcggagcctgtatttgggctcaggcagtctgactctggtgcccctgctgtgaagagctgtgccctgctgcattcctcctgtagctgcacgaaagggtgtggaatcttctagaaacagtgagttctatatgagtggagtgtggtggtgggagaatagatggagtaaagccttttgtgtaaacataccatgctaagtactgggagatagaaacgaaatgagagatttttttgttttgttttttgagatggagtcttgctctgtcgctcaggctggagtgcagtggtgcgatctcagatcaccgcaacctccaccttccaggttcaagcaattctcctgcctcagcctcctgagtacctgggactacagacacacgccaccacgccggctaatttttgtatttttttggtagagacggggtttcatcatgttggccaggatggtcttgatctcatgacctcgtgatccacccaccgcagcctcccaaagtgctgggattacaggtgccagccaccacacccagccaaaataagacatttctttgcccctgccaccaagatatttaacatcttacaggactaacaaaacctaacatgaaccagtccagattcatatgatagaatatgaaaatgttttctggaaagaatagccagagtcccagtctggttactagaagacactttccctgtcctttccccacctgtagcccttccaagctggaatgtgcagaggtgaggaacagacagagagatggcagggaagctattggcaaggtgggaatcttaggaaggaagtgattccggttcttgaaaaagagaaccggattccgtcaagtagaatcggtatgaattgtacccatctctaggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgag

SEQ ID NO: 3776 - DNA, 62945 bp, human; identical to SEQ ID NO: 3770

SEQ ID NO: 3777 - DNA, 60900 bp, human; identical to SEQ ID NO: 3771

SEQ ID NO: 3778 - DNA, 63894 bp, human; identical to SEQ ID NO: 3772

SEQ ID NO: 3779 - DNA, 62781 bp, human; identical to SEQ ID NO: 3773

SEQ ID NO: 3780 - DNA, 63959 bp, human; identical to SEQ ID NO: 3774

SEQ ID NO: 3781 - DNA, 59814 bp, human; identical to SEQ ID NO: 3775

SEQ ID NO: 3782 - DNA, 41433 bp, human
aaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 3783 - DNA, 62945 bp, human; identical to SEQ ID NO: 3770

SEQ ID NO: 3784 - DNA, 40381 bp, human
ggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtatt

SEQ ID NO: 3785 - DNA, 42063 bp, human
cacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 3786 - DNA, 37992 bp, human
ttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttc

SEQ ID NO: 3787 - DNA, 60900 bp, human; identical to SEQ ID NO: 3771

SEQ ID NO: 3788 - DNA, 41571 bp, human
ggcagtctgactctggtgcccctgctgtgaagagctgtgccctgctgcattcctcctgtagctgcacgaaagggtgtggaatcttctagaaacagtgagttctatatgagtggagtgtggtggtgggagaatagatggagtaaagccttttgtgtaaacataccatgctaagtactgggagatagaaacgaaatgagagatttttttgttttgttttttgagatggagtcttgctctgtcgctcaggctggagtgcagtggtgcgatctcagatcaccgcaacctccaccttccaggttcaagcaattctcctgcctcagcctcctgagtacctgggactacagacacacgccaccacgccggctaatttttgtatttttttggtagagacggggtttcatcatgttggccaggatggtcttgatctcatgacctcgtgatccacccaccgcagcctcccaaagtgctgggattacaggtgccagccaccacacccagccaaaataagacatttctttgcccctgccaccaagatatttaacatcttacaggactaacaaaacctaacatgaaccagtccagattcatatgatagaatatgaaaatgttttctggaaagaatagccagagtcccagtctggttactagaagacactttccctgtcctttccccacctgtagcccttccaagctggaatgtgcagaggtgaggaacagacagagagatggcagggaagctattggcaaggtgggaatcttaggaaggaagtgattccggttcttgaaaaagagaaccggattccgtcaagtagaatcggtatgaattgtacccatctctaggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtatt

SEQ ID NO: 3789 - DNA, 41556 bp, human
tgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 3790 - DNA, 41722 bp, human
aacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 3791 - DNA, 63894 bp, human; identical to SEQ ID NO: 3772

SEQ ID NO: 3792 - DNA, 62781 bp, human; identical to SEQ ID NO: 3773

SEQ ID NO: 3793 - DNA, 38894 bp, human
agggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggacca

SEQ ID NO: 3794 - DNA, 63959 bp, human; identical to SEQ ID NO: 3774

SEQ ID NO: 3795 - DNA, 59814 bp, human; identical to SEQ ID NO: 3775

SEQ ID NO: 3796 - DNA, 41433 bp, human; identical to SEQ ID NO: 3782

SEQ ID NO: 3797 - DNA, 62945 bp, human; identical to SEQ ID NO: 3770

SEQ ID NO: 3798 - DNA, 40381 bp, human; identical to SEQ ID NO: 3784

SEQ ID NO: 3799 - DNA, 42063 bp, human; identical to SEQ ID NO: 3785

SEQ ID NO: 3800 - DNA, 37992 bp, human; identical to SEQ ID NO: 3786

SEQ ID NO: 3801 - DNA, 60900 bp, human; identical to SEQ ID NO: 3771

SEQ ID NO: 3802 - DNA, 41571 bp, human; identical to SEQ ID NO: 3788

SEQ ID NO: 3803 - DNA, 41556 bp, human; identical to SEQ ID NO: 3789

SEQ ID NO: 3804 - DNA, 41722 bp, human; identical to SEQ ID NO: 3790

SEQ ID NO: 3805 - DNA, 63894 bp, human; identical to SEQ ID NO: 3772

SEQ ID NO: 3806 - DNA, 62781 bp, human; identical to SEQ ID NO: 3773

SEQ ID NO: 3807 - DNA, 38894 bp, human; identical to SEQ ID NO: 3793

SEQ ID NO: 3808 - DNA, 63959 bp, human; identical to SEQ ID NO: 3774

SEQ ID NO: 3809 - DNA, 59814 bp, human; identical to SEQ ID NO: 3775

SEQ ID NO: 3810 - DNA, 41433 bp, human; identical to SEQ ID NO: 3782

SEQ ID NO: 3811 - DNA, 62945 bp, human; identical to SEQ ID NO: 3770

SEQ ID NO: 3812 - DNA, 40381 bp, human; identical to SEQ ID NO: 3784

SEQ ID NO: 3813 - DNA, 42063 bp, human; identical to SEQ ID NO: 3785

SEQ ID NO: 3814 - DNA, 37992 bp, human; identical to SEQ ID NO: 3786

SEQ ID NO: 3815 - DNA, 60900 bp, human; identical to SEQ ID NO: 3771

SEQ ID NO: 3816 - DNA, 41571 bp, human; identical to SEQ ID NO: 3788

SEQ ID NO: 3817 - DNA, 41556 bp, human; identical to SEQ ID NO: 3789

SEQ ID NO: 3818 - DNA, 41722 bp, human; identical to SEQ ID NO: 3790

SEQ ID NO: 3819 - DNA, 63894 bp, human; identical to SEQ ID NO: 3772

SEQ ID NO: 3820 - DNA, 62781 bp, human; identical to SEQ ID NO: 3773

SEQ ID NO: 3821 - DNA, 38894 bp, human; identical to SEQ ID NO: 3793

SEQ ID NO: 3822 - DNA, 63959 bp, human; identical to SEQ ID NO: 3774

SEQ ID NO: 3823 - DNA, 59814 bp, human; identical to SEQ ID NO: 3775

SEQ ID NO: 3824 - DNA, 13053 bp, human
tcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaata

SEQ ID NO: 3825 - DNA, 10488 bp, human
ttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtg

SEQ ID NO: 3826 - DNA, 13041 bp, human
tatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctc

SEQ ID NO: 3827 - DNA, 14605 bp, human
gcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 3828 - DNA, 14586 bp, human
ccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 3829 - DNA, 41433 bp, human; identical to SEQ ID NO: 3782

SEQ ID NO: 3830 - DNA, 62945 bp, human; identical to SEQ ID NO: 3770

SEQ ID NO: 3831 - DNA, 40381 bp, human; identical to SEQ ID NO: 3784

SEQ ID NO: 3832 - DNA, 42063 bp, human; identical to SEQ ID NO: 3785

SEQ ID NO: 3833 - DNA, 37992 bp, human; identical to SEQ ID NO: 3786

SEQ ID NO: 3834 - DNA, 60900 bp, human; identical to SEQ ID NO: 3771

SEQ ID NO: 3835 - DNA, 41571 bp, human; identical to SEQ ID NO: 3788

SEQ ID NO: 3836 - DNA, 41556 bp, human; identical to SEQ ID NO: 3789

SEQ ID NO: 3837 - DNA, 41722 bp, human; identical to SEQ ID NO: 3790

SEQ ID NO: 3838 - DNA, 63894 bp, human; identical to SEQ ID NO: 3772

SEQ ID NO: 3839 - DNA, 62781 bp, human; identical to SEQ ID NO: 3773

SEQ ID NO: 3840 - DNA, 38894 bp, human; identical to SEQ ID NO: 3793

SEQ ID NO: 3841 - DNA, 63959 bp, human; identical to SEQ ID NO: 3774

SEQ ID NO: 3842 - DNA, 59814 bp, human; identical to SEQ ID NO: 3775

SEQ ID NO: 3843 - DNA, 13053 bp, human; identical to SEQ ID NO: 3824

SEQ ID NO: 3844 - DNA, 10488 bp, human; identical to SEQ ID NO: 3825

SEQ ID NO: 3845 - DNA, 13041 bp, human; identical to SEQ ID NO: 3826

SEQ ID NO: 3846 - DNA, 14605 bp, human; identical to SEQ ID NO: 3827

SEQ ID NO: 3847 - DNA, 14586 bp, human; identical to SEQ ID NO: 3828

SEQ ID NO: 3848 - DNA, 41433 bp, human; identical to SEQ ID NO: 3782

SEQ ID NO: 3849 - DNA, 62945 bp, human; identical to SEQ ID NO: 3770

SEQ ID NO: 3850 - DNA, 40381 bp, human; identical to SEQ ID NO: 3784

SEQ ID NO: 3851 - DNA, 42063 bp, human; identical to SEQ ID NO: 3785

SEQ ID NO: 3852 - DNA, 37992 bp, human; identical to SEQ ID NO: 3786

SEQ ID NO: 3853 - DNA, 60900 bp, human; identical to SEQ ID NO: 3771

SEQ ID NO: 3854 - DNA, 41571 bp, human; identical to SEQ ID NO: 3788

SEQ ID NO: 3855 - DNA, 41556 bp, human; identical to SEQ ID NO: 3789

SEQ ID NO: 3856 - DNA, 41722 bp, human; identical to SEQ ID NO: 3790

SEQ ID NO: 3857 - DNA, 63894 bp, human; identical to SEQ ID NO: 3772

SEQ ID NO: 3858 - DNA, 62781 bp, human; identical to SEQ ID NO: 3773

SEQ ID NO: 3859 - DNA, 38894 bp, human; identical to SEQ ID NO: 3793

SEQ ID NO: 3860 - DNA, 63959 bp, human; identical to SEQ ID NO: 3774

SEQ ID NO: 3861 - DNA, 59814 bp, human; identical to SEQ ID NO: 3775

SEQ ID NO: 3862 - DNA, 2752 bp, human
ttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagt

SEQ ID NO: 3863 - DNA, 5233 bp, human
tttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtga

SEQ ID NO: 3864 - DNA, 13053 bp, human; identical to SEQ ID NO: 3824

SEQ ID NO: 3865 - DNA, 10488 bp, human; identical to SEQ ID NO: 3825

SEQ ID NO: 3866 - DNA, 13041 bp, human; identical to SEQ ID NO: 3826

SEQ ID NO: 3867 - DNA, 14605 bp, human; identical to SEQ ID NO: 3827

SEQ ID NO: 3868 - DNA, 14586 bp, human; identical to SEQ ID NO: 3828

SEQ ID NO: 3869 - DNA, 41433 bp, human; identical to SEQ ID NO: 3782

SEQ ID NO: 3870 - DNA, 62945 bp, human; identical to SEQ ID NO: 3770

SEQ ID NO: 3871 - DNA, 40381 bp, human; identical to SEQ ID NO: 3784

SEQ ID NO: 3872 - DNA, 42063 bp, human; identical to SEQ ID NO: 3785

SEQ ID NO: 3873 - DNA, 37992 bp, human; identical to SEQ ID NO: 3786

SEQ ID NO: 3874 - DNA, 60900 bp, human; identical to SEQ ID NO: 3771

SEQ ID NO: 3875 - DNA, 41571 bp, human; identical to SEQ ID NO: 3788

SEQ ID NO: 3876 - DNA, 41556 bp, human; identical to SEQ ID NO: 3789

SEQ ID NO: 3877 - DNA, 41722 bp, human; identical to SEQ ID NO: 3790

SEQ ID NO: 3878 - DNA, 63894 bp, human; identical to SEQ ID NO: 3772

SEQ ID NO: 3879 - DNA, 62781 bp, human; identical to SEQ ID NO: 3773

SEQ ID NO: 3880 - DNA, 38894 bp, human; identical to SEQ ID NO: 3793

SEQ ID NO: 3881 - DNA, 63959 bp, human; identical to SEQ ID NO: 3774

SEQ ID NO: 3882 - DNA, 59814 bp, human; identical to SEQ ID NO: 3775

SEQ ID NO: 3883 - DNA, 5893 bp, human
tccacctcctactcttcagtgccagatgggtaagcatttagccaagcatgctgggagacacacagaactgaagcaaaggagtatctggatgtcttggattttcttcccattctgttctgttctgttctcctaataccatctcgttactagacgtaggcattggacgtgacaatcaactgcatttgaactgagaagaagaaatattaaagacacagtcttcagaagaaatggctcaaaggcagcctcactcacctaatcagactttaatttcaatcacaaatgacacagaatcatcaagctctgtggtttctaacgataacacaaataaaggatggagcggggacaactctccaggaatagaagcattgtgtgccatctatattacttatgctgtgatcatttcagtgggcatccttggaaatgctattctcatcaaagtctttttcaagaccaaatccatgcaaacagttccaaatattttcatcaccagcctggcttttggagatcttttacttctgctaacttgtgtgccagtggatgcaactcactaccttgcagaaggatggctgttcggaagaattggttgtaaggtgctctctttcatccggctcacttctgttggtgtgtcagtgttcacattaacaattctcagcgctgacaggtgagtttcttttctccattatatttgccaggatgtgaaattgggcaaaaagaaaggaaagcttgtacttagcatttactggctactattctgcttttctcacactctgtaacgtggatgtgagattggaaaatctggtggcatttaaaataaaagttagtgtaagaatgttaaaatttctgtgttagcacggaggagaagttgaaattgcatgctttatggataatttattcttattgtttgctcggaagtatactgaacggggtttttatttttctccagtttattaagtaaagcaaattgttccaggtgtaaaggaaaaaaattcatgctttatacattagtgcagcctagtggtgcaatatagtcaacatgaaaaccaggataggtgtgaaattgaccacatatgtataactgtatattggaagagtggtaaaaagacacaggcatctaatttatttgaaattcatcaaattagctaatggcagaaaaacggtgaggttttcaactccctggtaacttagtgtaatgtcatcacgtaattctacttgttttctctgtaggcattcagtgacattatcatttccagagaaataaattaatcttggttgacttttagagctctgtggagagagcgtgtgagatcctcttgcagtcagggtgttcagattctgtgttaggatattttcagtccaagtactctgtttttctgtgttcctattgtagaataactgtaaaaacatgaaaaaatttgaggctccaaatgttaaaaatgatgctttacaaagcctgcaagattcctgtaagtaatcgatgtttggcagtaccagaaggaataacttcttcagattctagaatctgagaggaggaaaacctttccctgtgtcttttgatgatttttgctttgactggtcttatattctatttgagggcagactggcttaatgactgtagattttaaggtggatttgtttgaatgaggaggtatctctgtaccggcacaggacttctgattgcaactttgcctcgccctaaatctgtccactgatcaggttgggcaacgaattaacacttacaaacggggaagaaattaatcctctcctctttaccacataaacccttggaattctcttctaggaaggttgataactgttcactcatgaagaaaggaaaattaattcagtttaacatcagtcacttatacaaaagaagtcttttaggtaccttaagtgtattacacttaaggtaatacacaggtggtgaattactctcagtcacacataaagtcatgctgataaatgtttatttgtcctaaatagagagtctatacataaaattataaaattgcaaatctggaatatctcataggagtgaataatggaaaaggagattagcataaataaaaatattgggatgtattatgtgcatttaaaaccatagccaattctagttggttaatgttgacttggttatacacatatgcacggagggtagaactggatgaccactaaggtcacttctcaccctaaaatttggtaactttgacatttatttggacctttgcctctgattatgtgtttctagatacaaggcagttgtgaagccacttgagcgacagccctccaatgccatcctgaagacttgtgtaaaagctggctgcgtctggatcgtgtctatgatatttgctctacctgaggctatattttcaaatgtatacacttttcgagatcccaataaaaatatgacatttgaatcatgtacctcttatcctgtctctaagaagctcttgcaagaaatacattctctgctgtgcttcttagtgttctacattattccactctctattatctctgtctactattccttgattgctaggaccctttacaaaagcaccctgaacatacctactgaggaacaaagccatgcccgtaagcaggtatgtattaatcagtactcatgcaaatctagtttgaatttagaagtgaagttcctacttttgcacagtgagtaactgtgtatcttcctgtttataaatgcaatagcagtgtagtatttttgttatgagcataggctccggtttgaatcccagttctatcacgtactagctgagtaatcttgagcaagttacctaacctttctgagcctcggtttcctcatctgtaaaatgaagatgattactagatgatatagatgaaatgcttaggtgcagagtaagtatttcaataaatggtaagactactactattagagaggggacaattgaagtttgagagtagtcaaaattttttaccccatggaatagtggggaacactgcataagatgatactatgaagaaaagcatcttttgttttagaaagtgtaacagaataaaaatacatagcatatagaactggcaagaatccgtaacactattcaatgcaaaccacttacacacagatgagcaaactgaggtggggaggagtgaggggaaagagtggaatgcaagtagcacgagaacacagtgactcacagaagcttgattaagaccactgcaagagccacgtgtaccctccctctcataaatatggacagaataaaaggaatgttgccaaaacatagttccatttgattaaaaatatttttctaacctctgggaaagggggagagaggattccatttaccccttgatcggtacgcagagaactgtgccttttttagagctagtccattcagttagtttaacaatggtgctcatgagactgaagttgcatatttaatacccatgtgaaccagttacctttgctctatttgtgaccacaggctatatattcacctaacttggctcatttctcttattaatagatgtaggtaggattatcttcacataaaaaggacagcacattttggatttacttctttgactatatggttagaattcctatagagtaaaaacaattttagttaccagcttggcaactttcatagacctcaaaacaatattctgacctagtcagcttctgctgatgcagtgaaagcaattttgtatagcgtctctttgtttttaattacagtaaattttggagaattccacggcattcttcgagttaactgcagacatcctagagtatctcgaaattagggggaaaggtatctctgaattagagttaatgagcccaagatcagaggttaccatgccaattgacttgctgtgttatatagtcacaggctgacttcctgcacatcccagccagttagcatacaaatgcatgttcaaagggaaatcagctgtaattaactgtaaatttctatgtaaatttataggataactttttaaaatctctcacagctaaatgttttgttttttttgttgttgttgttttttgtgttttttttttttttttttttttttttgctatgtttcttccccctatagattgaatcccgaaagagaattgccagaacggtattggtgttggtggctctgtttgccctctgctggttgccaaatcacctcctgtacctctaccattcattcacttctcaaacctatgtagacccctctgccatgcatttcattttcaccattttctctcgggttttggctttcagcaattcttgcgtaaacccctttgctctctactggctgagcaaaagcttccagaagcattttaaagctcagttgttctgttgcaaggcggagcggcctgagcctcctgttgctgacacctctcttaccaccctggctgtgatgggaacggtcccgggcactgggagcatacagatgtctgaaattagtgtgacctcgttcactgggtgtagtgtgaagcaggcagaggacagattctagcttttcaaggaaaaatgctgcttctcctcccagcgtgtgtatccgactctaagctgtgtgcaggtgtatggtgtccagatttttgttgtttgaaaagtgtgttgaaatcttaggagtgaaggatccctataagtaagtaaaatacaaaccattactttcttcaaagtacaaatagtaatgtcatcgggctttctaaataaaatgaagccccactaagtgcagaaagacaagtttatatatgccagtgaatcgtaagggaagtcaaatgggaaggaaggtgtaataaacaagatgaaacttaaaaatctcatttgttgtttaatcacatctgtgatgcttctaactcctcatatactgtgatttgcataaaattgtgtttgtgtttactgtgtggtgtaaatctagagatactttgtatgtgaaaaggggatcacaaaagagagaaagcatctcttaggctattttcttaaaaataaaccttcacagaatggctgtccttttccattaatctgtattccattgtagctgaatctgtgcagttgaaatgaaaatgttttggagtcagcgaatataaagcactgagtaaggatctggggcacagtgcttgccttactgggtcaacacttacaactgccatggattaataactgggctaagttatcattcacaaatattgttaggaacttgccttattcataggcagaataagtggtcatgtttatggtgtcatttgaggacctctgttgaaaaatctgcaaacctgccacagtgtctgaaattcttcctttacagaaattcgtttctttctggtaagcagtgccctctttctaaaaacatgcagaagtaccatatgaaatccctaacccctgggtgtgcaattgtgatcagatcatcttcctgcttgactttattaaacccaatgggtgcctaagtcctgtaagtgtatggcctaattaatctctgcccatggaaatcagatggaaagttctgattttctatcctgtgctcctacctgctaacatcattcacttgttaataattattgttttaaaaaaaaaaactcttgtcaatagacgtgtcagatttagacctgtggtttcagaaaaatttttggagcaaatttaaacatgtttggcactataggtaaatttgtatttaaaaaaaaaaacaatgtttgagtgtgcttttggtaatgctgagctttctttaaatggcttgtggagtcgtgaacttttgctaatgatgtggctccaaaaggtaatacatattaacattagactttaactttctgtaaaattggtttacttaaagttgggcggggggtgtgatactgtattagtattgttttaaagtggacactgtaacacgtgtggaaaaacaaataaatatgaaataaagttttaaa

SEQ ID NO: 3884 - DNA, 5893 bp, human; identical to SEQ ID NO: 3883

SEQ ID NO: 3885 - DNA, 20368 bp, human
atcagcagcgtagtggatgaacacttctccagagctctgagcaatatcaagagcccccaggaattgaccccctcgagtcagagtgaaggtgtgatgctgaaaaacggtgagcatgtggggagggagggagctgggattccctatcaaggctgccacggatacaccagttctttgatgtacttgacacacttggacacttatatgtttgctaaaggcaagttgctctgactagtgagaagccacaccccttcttagaagtttaatgtcaaaatggggctgccatctactgctccaaccttacctccccagcactgtcctccagaaactggcttccttctgtccgtcatgttcgctttgatttcttcctggcctttgcacaaactgttccttgtctgcaaatctcttccctcccttctcctaattaacccacattcatcccaagatcacttctttagggcagctttccctgaccacccacacccccaagcattcaaatatcctattacagattctcctaccgttctttaactctccttcacagcccttgtcacagttgcagtttttacacttgtataattatttgactattgcatactcctccattaaatgaaagttctgtgagggcaaggaccattgctgattttgcttaatattgtatttctagcatctagaaacagtgactgtgacataggggacaaccaacaaggatttgttgaatgagtaaatgaacatacaaatatgcaaatttgtgagcactgtatctaggtacaaagaaccttgaaatttccataaaagactaaaacataaattagaatcttgctgaataagccattagagcagaagtatgttatgatagtttttaaatgttgataatatttacattttatataatttatttccataaatggaaagttcccagttgtagagaggtggttttgaaaagttttaaaatcaaagctggctgggtgtgatggttcacacctgtaattccagcactttgagaggccaaggcaagaggatcacttgaggtcaggagtttgagaccaacctggccaacatagtgagaccctgtgtctacaaaaaaatttaaagaaattattcaggtgtggtggctcatacctatatctctggctactaaggagggtgatgcagaaggatcacttgagcctgggaggttgaggctgcagtgggccatgattgcaccactgtactccagcctgagtggcaaagcaagaccctgtctcaaaagaaaaaaaaaaagtaaagctactggaaaaagaaaaaaagaagtttaatgtaaaaatgggtgctgtttaatcaaatcagttcacctattttattatttcctcaatcatgttaaatgctgggtttactgctcagcacacaatgaaactccacaactatttactgtaatcattatcagtatttttcttcatcttctgttttttagagacagggtctcactctgttgctcaggctggaatgtggtggcgcgatcataactcactgcagccacgaattcctgggctcatgaaattttcccgccttagcctcgcaagtagctagaattacaggtatgcgccaccacacccagctaatttaatttttttttttttttgtagagacaggatctcgctatgttgcccaggcaggtcttagattcctgacctcgagcgatcctcccacttcagccttccaaagtgctggtattacaggtgtgaaccaccacacccagctagtattattatcactattattattactataggcctgatggggcaggaacaccaaagcatctatgaaaagaaaacgcatgtcccatgtaggtgctcccagcctcttctcaactaatagtgcatggtttggtgagcaagggtaggggccagagggaagtagatgaatagtcttgccacatccctttcccacccttcacagggccaggtgtgtctatttgctaattgttaagaaataaacagtcgtacatctcaaaacagttacttcaagataactaagtcaaaatgtgcacatcaaaatatccaggtttgaaggaagccttaaacatcacactagcaggggctgtagtatgactttcacggaccctggacacttttgtcttcatggacctccttcctccacaaaaacattaaaagttacattttatgactgcattggtataaagatgaatataatccaagctgagttcatgttttaaatatattcagtatcactgtcatattcattttttcttctgattttaaaacatttttgtgggcccctaaaactattaatgggtcctaggcactgtgcctcctgtgcctaatggagaagtcaccctcgccagctggatgtcactcaatatggctccctttacctttttggaaagtgagcaaatatatcagggtctggtggatttcaagagctctttattggtgttggtgagtgcacatgttgaacgacttgctcccactggaagacgtacgtacctccaagtaggggcttttgtgtaaagtggacaagtggggcctctgcctccaggcaaagagctcccctgtttccagatgccatcattctggctttgctttttgggactggagagggagttgatgtgtatctgatgtattcacctttgcagaatttacttctctcttagaatttacttttgcagtcaatcaatgtggttttctcagagaatcttgtgggttaaataaatatgtggaagggcatggggtagcagcagatactaaaggaaatgatgtagagcttgctgttaaaatgggcaggagggggtgggtggggagtggggaggtgatgtctaagagtgtgctgaataatcacaacagaagcaggaatgaccatggtcttgaatcatttgggggattgacatgtggtaagagctgagaaatgtggtgtgtgggattcagaagatctaactgactccttggaagtgtcaaaatctcgggcagttaatacacagacaagtatactgacttcggctatttgactctgatttatttctgaacacattggcttggattcattataatcattcccttgtaagcatcatcaagccatggtctcactttttctattctacttgcctggtaaaacccaagctgggataaaaccaactcttggcctattgccccatttctctgcttcattttgcagcaaaactcaaaattggtatttatgtgtactctgtcctttcctctcatgctctctaaactccattccactcatgctttcaacctcatcactccttgaaatcgctcttatcaaggttacccagtgacctccactttccaaatccaatggtccctatctgtcctcatctgatttgacctatcataacatttgctgcagaagattgctctctcctcgtgaaatacctacttcgcttgcagtcagcccataacattatgctttcttggttttcctcctgcctccctggttactatttcttctcagtctcctttgctatatgtccttctctctccaacttctaaacatttcagggccccagtactcaggtcccagacaactcctttctctgtctacacttactgtcttggtcttaaatgccatctatatgttgagcaattccaaatgcatatctgcaaaccagaatggatttcagacgtgcctgtctaactgcctacttgatcttcacttaacatgcctaataggaaactcaaacaaaatagctcccaaactgaataaactcttaatttccccctcaacctgctctgcccacagtctttcccatctcaataaatgggagctgcacccttccaattccttgaagtcatgcttaacacctctctgtctcacaccccacatccaatccttttggaaattgtgtaggttctatcttcaaaatatccaagatctgaccgcatcttctcacctccgttgtcacctgggtcctagaagctatcatcaccccccgctgaattgctgcagtcacctcctaattggtctcattgcttcttcccttcctctccttcagtctattcttaggagggcagtcagaatggtagcattaaaatgaaagtcacacactagcactcttttgtttgaaaccctctgacagcttcccatgtcacttggaatcatatccaaagtctataatggggccctacctcatctgggcccccgttgtcttactgatctcatatcttaccactttctgcctcacccgctccagtctaggctccttggtattcataaactatgccaaggacaatcctgcctcaggcctgccctttgcacatggtctctcctatccctggaatgctctttccccagatacctgcatggcgtcacctttctccattcaagtctccacctggatgtcaccacttcaaacagtccttgtctgagcaacctatttaaaaaatgaaagcccccaccctctcacgtctgtcttcttaccctgcttcatttttcttcttagcatttgtcaccaccgggcacattatatgttgtagttctttctagactcctctctccccttaccctctgagctccgtggcagtagggactcaatctgttaactgctgctttctaagtacctaccacaatgcctgacacatggaggcactcaatacatacggcttgaacgaatgaaattatgattttgatcacaaggtgttgaccctacagatgggggtcaccgtagagagggagtacggtgtggtgtacagctttagaaccactcagcatggggccaagccagctccatcacttactaacagtgtgatctccagacatatcacttctcctctctgtgcctcagtttcctcatctctaaaatggaataatattgaattataggactgtgcttgtgaggagtcaatgagataatgcatgtcaagtggcacatagtaagtgcaatgtagtccaagcttgagttgagtttttgaacagctaagatagatgtgaggacctgtgttcacaacaccaggttcacagagcagcaggcatctcccataagcctccaggttttcagggggttctgtttcatggctgccatagagtttcctgtgccttctgatttcacctcgaccttctgtgaaacccctgcctgctgagggaagttgggcatggccctgttccttgcccaagccagccttcacaggccagatagagaggtggcttggttctccatcttccttcttggttgttgcattttccctataagaaccccacaaatcctttgactgtgaagatgttgtctccctcacagagtgtggtgcgggctaggcaaatatttgtccgctgattgagcaaatgaaggaaaaactgcctccctcaaagcctctcttatcaccactaggagtcaagtttctcataagctctgctgcctcaggggagggccccatgaaaggcttccagtcccacagaggttctcactggaggtgttatatgacatacatatggctttgaaaatggtgggaaatctttcaagtggcctttcattactgactgttagtatcctctcaaaccctacagaccagcaccaggccgtccagcccagctaggccattccaaggagaacaggctcccattcatgggctcccatggccgactcgcccacattctaagggctctctgttgagccaaatatgcaagtcccaaacacagagacccgtgtggctaggaaatgccgtcaaatttcctggcttctcttccccaatcagtgttgtgtttttatttacttatgtataatttatactggctgtacttcagaaaagaaaatacaagttgaaggtatctttgaattatctcccttttaaaaggacattgggaattttagaatcagtaactagagaagcttcagtaactatagtttgtagggggcatggtcctggtacgtatgccaccctgtgttcttcttgtcctgtccccagccccagtcctgaggccggcctcaggcctggcaacattgctctagggctgctgagagaaggtgagagggtatatacgtgggcctttagaggtctcaaaggatccagcctccttctctctcccctcccatctgccataatcagtaagggtagggaagaaatgctggctttttttaaaaaaaaaaagtgtaaatatctatgtgagatatagtcatgctagttgtttatggcccttgtaaatactgacagtttcctgtcttcttttcccgtaaggaagaggaatctatctgcacaaacatatatggagcttccagcgaataccagacaccacactaaaattagtgcattttacttcagtccacgaaatccactgtgatttataaagttcaaagacaggcaaatctaacctatggtgtcagaagacaggatatggttacgttttgggggtgttgtgactgagaggggtacggtgtgcttctggggtggtgatcaggttctgttactcgagctgggtgctcattacccagtttatgaaaattcccccagctgcacacttccatttgtgcgtttttctgcatgttggttgtgcttcacaaaactattttgcaatggatattattatccttattttacagagcaggaaactgcagcccagagaaggtaagtgcctagagatgggtcacacagccagtgagtgataaagattgaaacccaagtccatcgatctccagagccagtctcttgaataccccattgtcttgcctttgtacactctgacaatgccccagcaagaggatttaatacctataaggactatcgctaataatgtgtataatggctaacactttttgaacactttctgtgtgccaggccctttgctagggtctgtcacgtggattatctcactgaatcttcacaccaactctactggttaactctatgtccattttcctgatgaggaaactgaggctcagacagtcaagtgacttgcccaagatctctcagctaatatggggagtctatagtatttgccggcagatggaattgatttcggatcttagccactcagcatttcgaatactagctcatattctgtgtttgatctctgttttcagttgggaaaaggaatctggatattcatccaaagactaggtaccccagggaggcagctgtgaaagaggggaaggaactgagaggcccccctggtgccctggaacagcacaatctcctctaagctctccctccatccccagtgatattttgacctcagctaatgcaaacaatatgctttttgtacttgggggtgaatggatgaagtgcaagtgccaccagcaaagagggcagagagggaaagtcaacgcgtgcagatcatgcaggccaaggttggactttcacagtgcaaagtgtgcatgtgttcagagggttcttgatttcaacttcatcataaaatgagatttgtaggccaggcatggtggctcattcctgtaatcgcagcactttgggagggccaggcattcaaaaccagactgggcaacatagagagaccctgtctctacaaaaatatttaaaaattgtccaggtgtggtggctcacacctgtatttccagctactcaggaggctgaggctgaggcgggaggattgcttgagcctggggaaactgaggctacagtgagctatgatcttgtcagtacactccagcctgggagacagtgagaccctgtcaaaaaaaaaaaaatcccacagaatttgcattaaaagatgcagaaagagggagaagagaaggaaggaaagaagaaaggatagatggaaggaaatcaggcaatcatggattagtcgttcacagctgtgactcgttttttgggagcttcacgtgtcaagtggtttcttacgtttttgcttaaaacataatttttactatttacaaacataaaatatactcctttttggaaatttagaaaacacagataagcattcaggaaacaaaaaccacatgtacatccatggacatgtactaatttttacaacgtgacatcattttgcacagaatgggttgtaacctgcttttttaaaaaattcatcaatgtcatatccacttctccatgccattaaatgttctactacaacatcattttaatggcttaagagtatcattttatagatgtaccaaatttattaaaatttttggatatttaggttgttgctaatctttcgctatattatacaaatcactttgaacatccttgtgggtacatttttacatgcatcattgactatatccttaaaataaattgctacaagtggaatgcttgggtcaaagagtacacacaaattttagggttttgatatttaccgacaaatttcttcctagaaatgttatgccaatctgccagccctccaacccaaggagcatgtaaaagtgcccacctcactgcattctttgcaatattggggaggcatagttggtaagagcataaggtttggaatcagacacctctaccacttgctagccgtgtgtccttagacaagtcactttaaccattctgggtctcgattttctcatctgggttgctgtgaggatcacatgagatcatgtatgcagagtgctaagtaaagtgcctggcccatagtgagtactcaataaacaaaaactactatatatttacaaattgttcctgcccacctctgatgtgttattccctgggaatggccacagactgagcaaagacttctgaaatccctcttttataaccagtatctactccagcctccaaaccagccctgaagtgctgctgctgcctctgctgctgttatgggccccttggctcagtcctttctgcccctcccttctccagcactaggtgactgttggcagggagggttcttaggcctcatgcattaatgaccatcttgctttttctcacgttgattgtgctgagtgttgcaaaccagtaaagaaacccagagtggctttttaaactgaaatgatgaataataacaacagcaacagctaccacttattgagtgccaattgtgtaccaggcactgtgctaaaccttttacatggatggtctcattcaatctcataacagtctcagaggtgggaggggacttgctcagtgtcacatagctaggaagtggcagatctgggattggattccaagcctctctgacttcaaagtctgtgcttttaaccactttcatcctgctctcttcgatttagaaaggttcagtggggaagggtgtgtatgtgtgtgtgtgtgcatgtttgtgttagtgagtgtgtacatgtttgcaacggtgcatatgtatgtgtgtttgtgtgtaaataagtgtgtgcactcattagaataatactttttcagggccactatgtgctaggcactgtgcaagttcttggggatataatggtgaacaaaagagaaatgatctcagctctcgccaagcttactgaacgataaagaagaccaatagtgaatgaatgaatgtaagaattaagaaataaataaattacagtattactgccatgaaggaaataaacagggtgcagtcacagaaagtaacagggtcacaaactttagattggaagttgagggaaggcctttctgaaagggtgacatttaagtttgtatgttgaaaaactaatctggaataggaagtcagggcctccatgcaaggataaagtggagggaaggtactctggaatggcggcaaactcataagtgcctgaagatgttttctagagtgttctggggctcccaaaagtgtatatgggtggaaatgtgtggcgcctctgggtatgcatggaaagcagggggaatggcctgccagtttcaccgaaaaagggcagtgcgggaaatggagaccagctctctctggacaggttttgtctcaggaccaacagcatcaggaattctagagggatgaatgggactaagaggtagggtctagatgcccagggttgaagttagtggagtggaagccatttgtactcctgctgaaagaaaaatcctagcctgccccatgtatgcctgcatcagggtgtttcttacctgctctccactcattcatgtggtcaggggcttgagaaggcagcaaattctgccctggggctccctctctcacttctagaggtaactaatagggggcacttggatgaaaaaaatgtcaccaggatcacttttagtagcagcagcagccttgagccagtgcaggtttgtagtttaagaggtctttacccatccacagggtaggtgggagtggctgctggagcagttggcccaagaggcctgaaaaagagaggcccactcaaatccagggtctccactccatgggccactgacttccaagcctaatctggaatgatgtgtttccccaggccacccaaggcccgctgttggatcactgtgaatttggggttaggacaccctgtgcgtgcccataagctcccatccaaactgtgctctggggcacctggtgaccatataggactttgggctgtggcacaccaaaccacttcccttaacatttcagagaattctagaaaggaagcagttaagagaaatattcaaaacattctggggctctgctttccacatttcaagcattcagcccctaagtcatatgtatgagatctgtaaggcctgttcacatggaaactgcctagttgtcaggggctacgctttgtttctaatttgtgcttaggacatgcagtaccctcattcaatatgaaacacagactgtgattacaccaaattagcttaatcactctctttgtgcactgaattgcttctggcctggagatatcaattttcagaagtagcattcaccctcaccaaaacaaatcttaatatattgtcttgcctttggtttcataagaagggccaaccatcccccatcactcactgtgaatggtgtgagatgttggggagaatgtctttgccttgagggcttggacttctcttcctatcctttgtgtcacactgagtgacggcactccagtaacactgggcaggcctttcagaattttttatcttgtacacaatccagtcaaaccaaacattcaagagcgctaggagaggtttgtatgggaaagaggaccagtgtcccagacatcctctccagccggctaatcttcctttgtctccacacccaccctctctccattatcttggatagatgataggctccaggctttaagaactgtgtggaagaactctttccctcctcccttcttgcctgagtgggtgttgagaatggggaaaacattcatccttgtcctaagctatcctggacatttgagatctcagattcagcggctatcataggcacaataagaatagtgtctatgggaccaaaggacactccatccctcttaaccaatccacatgaacttcacaagaagaaactaagtcacctcttgaccctcagaattctgcttttgcaaaatggggtccaagcaactacttccctccccattacttatcgttccagctcacttcccttcttggctaatctgtttttgctaccttggttcagtctcttaacatccctgtgcctcatattactctggaaaatgtggttttagctcctagagttgtgtgagtgaccagcacaggtaagtgttaagccctttttaaagttctgtcgagtccccctatttggtgtatttaaaacaccagctgtaaaataaagctagatgatagcagcaaccaaacacaaatcaagcacatttacttccagaaaagcatccttaaggagctggttggatccgggagcaaaggtatctatacagagatgctcattgtaatgctgttagcataatagaaaaaaatggaaataaccaagcagtgcacaaatatgacatttgttaattactgccttaccatggactacttactgtacagcactttaaaaagctggtgtttggctctcccccttcccttcctttcccttcccttcctttctttttctttttttctttcttaccgagtctcactctgttgcccaggctggagtgaagtggagcaatctcggcctactgcaacatccgcctcctgggcacaagcaactctcctgccttagcatcccgagtagctgggactacaggtgtgcaccaacacacccagctaatttttgtatttttagtagagatgtggtttcacaatattggccaggctggtctcgaactcctggcttcaagtgatctgcccaactcggcctcccaagaagctgggattacaggcatgagccactgtgcctggcctattcatttctataggaggcttttcatgatattttaatgaagcaaaaatggcttgaataacaatatatgttgtgaaaacaatgcatacatgaatagaaaccaatcctagaaacagtacacctacggaggacaatggctgtttctggatattatcattaggatgattttattttagcttttctgtatttccttcaagttaaaaaaaatagagtatgtattaaaaaaaaaactacatccattttgaaaacaataaacacctaacatgtcttctaaatctttccttctcagatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacgtgagcctctcctaagtctcctccagcaagacagatgcctagcccgtcctcaggaatctgccgccagggagaatggcaaccctggccagatagctggaagcacagggttgctcttcaacctgcctcccggctcagttcactgtaaggaaatgcctacagatacttggaggggtgcctctgattggttgtggttgagagtgagttggcatgagatgaggtgccaagactaattgctgccactctggacatagggctgctgagggaagggatgttctgcttaaatgttccatacatcttcactaggcttcattgacattcacagtttaatagctaaagggttacatagatagccagccagatggacttggcccgaagtactcaccctagcctgtcaacttggccttaccttagaaaaatgatgggctgctgcgtaatatcgcagggtcctgtgtttacctcattgggagcaattaaataagccatttgcagaacagagctctgtgacgtacctacaggctcaaactgtagcctctaaacaggttggcaacttgcagtgatgtcaggctccaggcaaacaacaagggcaatctataccaaccatctgctccacacattaaaattcaaagcgactgtaggaggcagccccattgctgcttggagacctaacagtgcctgactgtccttggcttgctcctgcactctgggatcctcctgcttggtttcccttgggttcctgctccctgaccaccacccctcccctgaactaaaaacacccttaaggcttactcacctcttcattcactcattcacccagcaaatatttaatttgcgcctaccagatgcaaaatatccatcagaaaacaaggctcccttctttgtaaaaggacggggaagaattggcattaattatacttccaccaaaaaatcaacctactctgttgcaagatttgcctttaatatgaaacacttataaatatatattttatagtttcatggaaccaagtctgcatcctctgccattctgtactctggacgaattttcttttgcagcttccttgtccatacatagtgtggttctagtgttccatgcctgaaagaaattactagaagccatctttacactgaactaagcatatagtaaacaaaaggcctgttcagcatagcctacctaagtcaggcactgtgttctattctaatgtggaaaacaaatttcccattaaaataccactctgtcatttccagaatttgattaggaatgtacttaaggagtaaatcatagaagtgtcatgtttgggaaacctgtgaaatttcctacccctctactctttttcaaaagtcctttcctactggattcacagggaaaattaggccaactgtgcttgtatatatgcctgtgcatacacacagcaaagccctgtttcgacagtaggttagaacacagatggctgaaatcatcaccttccaaacttagcaactctttacagttcaagtccaattcagcaaatatttagtgagcatctactgtaagcaaggcacatcatggtgaaactaatgcaggcattgtcctattcctgaaatctcaagacacattcacaaacaaatggttatcaccaaggtcttcatgctctactcatgttgacatgagttgtattaattggtgactggaagtccaggatctgttgaggaagtcagtgacccttaatcaggaacactgccttggaaggtggtggacctttaaaacagaagcttctcagtttttgtagcatctgatatgagagaatatgctagatattcataaacttagggccaggcaatgtggggcccctggaatgctactgggcactctctaacctagtcctagaaatttcagttccaataatgttttcttcttcttttctagataagaaactatatgtatctcgtggatctgccagtaccagccttccaaatgaaagtaggtatctgggccagcctttgatggtgtgtgtctgtatcctgagaacgaacttgagaaataaggcttctgtctactactggagacactggtagtataaaacccagagtctccagtaatggacgggagccttatttctatcactcagtgttttcatagatagaatttgtttcattttagcctcaaaaaagagtatatgcacttcctatcttgtaaaattttattttgctatagaagaaactctccttagtttcttttttcttttctttctttcttttttttttaacctgagtttgacttaactgaagtagccaaggtgactcagaaaaattaagaaattcatgaggatgaggattagcttgctatgtcccagatgttcagttttcagcctagtattcttttatttatttctttttttttaacctgagctggacttaactgaaatagccaaggtgacccagaaaaattaagaaattcatgaggatgaggattagcttgctgtgtcccagatgttcagttttcagcctagtacatagggccaccccaggactctgcagtcagtgaaaatgtcaactgaggcatgaggccaggactctgagctccacactcaatttgaaagtggtgtcagtgggaacttacaaaagaggacaatctgggtggaatgacaggaggatcttcatgacctgggttcagggtcaattgccagctttattatttacttgcttcaggaacctggtcacatttcttaaccacttcatgccccagttgcttcatttttgtcaaataagcataaaatagtgcccacctcattgggtgaggtgtgaggagtaaatgaaataatgtataccaatgcttagaataatggctggcacattactctaagcgttggcatacattaaaccatcaagaattctttttggagggcatcctgtgttccccaagctgtgctctgtgtgctgtgtttaagagaggactcaagctgggtgtggtgcctcacacatgtaatcccagcactttgtgaggccaaggcgggaggaacacttgagcccaggagttagagactagcctgggcaacatagcaagaccctcatctccataaaaaataaaaatagagaggatccaaaggaagagccactaccacagcccctgatctcaggcatttgacagtctggtgtgaagtaggggtgagggcaatctatagaccccactagaatgtcaaccccatgaggactgagactttgagaggtataccactgtatccctagcaccttgcacagtggtatacaaatttgttgaataaatgaatgagtgaatgctggaaacaataaaagagcatttaacaaggaaacagtaagaaaatgtagtaatgtagtaaaaattattccaatgtagtaaaaattattctgtttgatgccttcgtgtgagagacaaacaaaacaaaaaccaaccctggtgattaattggccatgcctccatgaggagattcatttagagctggttcaaaagccttagcatagccaaggcaggcatcacataagtccctgcccaaggaaatgagttctgctggccttctaacttatgaaaggcaaggattgtggtgtttcctgagtacttgttaatagtttctacatttgtttattgtgagtctcagaattactgataacttgatgcttaaaattgttcatagactaaaactaacagcaacaacaacatgtattgggtgttgactatgagccacataccacatactccatcttgcttagtccccaccatgaccttgtgaggtgtatgtgaatatgtcctaggtgctttactcaaccgatattcagtaaatagtgattgaatgaatgaatatccccattttatagatgaagaaactggatctcaaaaaggtgaaaggacttgccttaaatcacacagcagcaagtggcagatgcagtattatctccttgctctcacagtgtcataaaattatcagaaacaattccaagttaaatcaagtatacaacagtgaaaattagtcactggtgagattattttaccacacatgagttcactgtctatctgggaccagggcactatcctaaaataaaggaagggggatgcagaaggctcagaaagcaagcaaaagagcaaagaaaaatatacctttgggaaagaaggtgggggatgttctttccttgcagagagtagttgaggaaaggtggctatgccaacaggcccaagtctgcctttctaacactgtggccctgggcagagggaggtaacatggagctgagaggaagagaagggacttcctagggctccaagtaaaaggacaatggaacccagcaaagcccatgctcttaagcatgacaccagtctcccaatcttgcctgatggtacgaaccacctggggagcttgttcactgcccagatcctgctcccccacttcctgggggagtagatttggcatgagactcagttgcctcttcatgttttattctttttttttttttttttttttgagatgaagttttgctcttgttgcccaggctggagtgcaatggcgcaatctcggctcactgcaacctccgcctcctgggttcaagtgattctcctgcctcagcctcccaagtagctgggattacaggcacccgccacaatgcctggctaattttttgtatttttagtagagatggggtttccccatgttgatcaggctggtcttgaactcctgacctcaggtgatcagcccgccttggcctcccaaagtgctgggattacaggcgtgagccactgctcctggcctcatgttttattctttatataatttatattaacctcatttaaaagtgaactacatgaacctttcagtggaaatttaggttgttctgaaagatttcctatgtgaggctccagaaaaatatttgtcaaggaagggaggcagagtctcctcctgcccctccgatatggccctagtcccctcatgtgggctgtcatgcatctatgaagcaggggcatgtggagcagaagagtcatcagagccaaaagggtagtcagagagaccttggagaaagacattctggaggttagtctcacaaatgttgttcaaaagttttagtgaatttgattttatcttttggtcggtagaaatagacatactggttatatattgcttcaatggctacaaataataataacagttgatattgctaattgccagatacaggactataatatacattggagatataacagtgaataaaattgtcttggtccctgccctcacagagttaatagtttcgtggggaagacatgcccacccccaaagggaaaatacaaaatatttgcaagttatgataagtggagtgaggaaaacacatgaggtgttgaaatagggaaaaatgggggccaactttagataaagtgttcaaaggaggcctttctgaggaagtgacatgtgatcagggacctgaatgaagtgagagagccagctctgggaagaattagggcagagatggagggaggtggaggaaattgtccctgcaaaagcccgagatgtgtgtgaagaatggaaaaaaaaaaaagaccagggtgacaggagtggagtaagaaaggagagagtgtggtacaagagaagtctggagaggtaggcaggggccaggtggtgcaggggccttatgggtcacattgggagttgagatttcatattctaagcgacattgtgagccatggaaggattttacgtgtgatccaacttgcatctgataagatcacaaaagctgttctgtagaggacacattggagaaagggaagaatgaaaacaaagaggcaagaagcatgagaggatgatagcctggattaggtggcaacagcagagacaggggtatttgagatctatgtaggagggttagctcttaggacttggtaatggattaaataggaatggcaaagaaatgggaagaatccaggttatctcctaggtttcatgtttcaacaaatggataggagaatataactgttttggccatgtcaattctgaggtgcctataagacatccaagtggatataccttttaaacagttgtatatgtaagtgaagaaagtctgggtaaacatttgggatgtatattagtcctgtacataagtggtatttaaggccattggatgtgatcacctagtcagaggacgtagacatagaagagaggagagctgcagaaagaggcctggagggtgtcaatatttagagactggggacatgaggaacaaacggaggagactgaaaaggtgtagccagtgtgataagagaagaaccagggcagtgtggtacataacagaagctaaaagaggtgaatgtttcaaaacagaaggagtgatcaactgtgttaaaggctgtggagagatcaaataagagaaggtcaaataagaagaaattcctattggatgtggcatcagagatttttgtagacgtgttaagagcagttttcattatgtgatgtggacaggagccagattgaagtgggctgaagagtgaaccagagatgagaaagtggagatagtaaattcgaggagcttcttagagaaatttaacattgaaatgataaagagaaaaaagatgttagctaaagagattaatggggtttgagaaggtctttttttaagaggcaaatattagagcctctttgcatgataatgggaatgatccaatataggaggatgaaggtaacttgaggggtgaagtcattgagaagacagaagggacatgtagaagcattgagctttcataagaacaggggctgttctgccattgaaagtatagaaaagaaagctaataaggacacagatgcaaattgattttcaggcttgcttgtgaggagactaaaaagtactaatctaatgatttctattttctcaatcaactgtggagcaagacagcaagagtgtgggatatttaaagagagtgagaaagtatgaagaagtcttcttgggcattgggaaagcaaagcctgatagtagacaaacataagtaggatttctgggtggtgatctgaagtctgagctcatgaatttcaagtgcgaactctcagttgggttgtgcaattttcatcagtgatgttagcttagtgtaatgtgcagagaaggcaaatggggacgcttatctaggggtgaggttgtggcaagtgagtatgaaggatagagaataaggaaaaggagtcaagggtgggcaagacccattgagaataggttgaggctgtgggtttcctacattttcaaagtttgaaaagaagctgaaaagtctcagtctggtcctgatgaatgacatactttcacttgaaaactttggtttctcaatcctaacaaagtgacccccaaatgcaattgttgagaaatctgataacttactcattagaaattgagtaaactgcccgtcacaagttgaataaattctgttgtggctgcaatagaatttactctgtatccagagcatttcttggatgcagtttcatgagtttctgtcttcccttcctctgaggttgaggactctggtatctgacatcccacaggtgttcatctggaccctggaggagacttacagccttccataggggcctaactggctttcattaaccatgtaacttctcctttagctctttcagagttagagacacctgggaaatactcacttacaccacc

SEQ ID NO: 3886 - DNA, 24655 bp, human
tagaggggcggaaagtaacaaggaggtgggggtacaaatcctcagctcctgcttccgcaagcactaacctgctctgaagtgagccaggcagctctggccatcttttcccagccacagaatcaggtgatggtccagaattaagaggtaagagaatctggggatttttttggggggagaagcaaagaaacttaactgggaagaaatgggggtagtcatcaaatactttgctcaatgagatacaatctggtccccttggggatttcgttccaagtgattggtttgacaaactaacccctctgacttcccaccctaccccagactgctaggtaccattttggagaagtgcggtaagtgcgtccatgcaggcagattgtggtagagttctggccaaaatgctggtttgggattctgtgctcaaatatttctttctttctttctttctttctttctttctttctttctttctttctttctttctttctttctttctttctttctttctttctttctttttctttctttcttctttctttctttcattttttgttctttcttttttttttttcagaagtgtgggcaatatttgagggagcactttctgtctttgtatcttgtgagatggggaagttgcaaactgcctgttgtttagtaattatgccgttctggcggtaccactggtaaaacttggccttggggttttgtctactacgagaggcttttgctataagccaggcactgatatggaaacatcttctctgggagacagccaccctttctttagcctcactgacatccccttctatccagctttgcagcatctctttctcctaggcgagacacaccccagcaattaattcatgaatgaagagacctcttatggagggctcatttgaggatgaagctcctcatgtttctccagaggtagagtgagatgcagttcttcataggactaagccaatgacagttctcagaattttaatattcctcaaatacagtttctctccactttggtccaagtgcagcccagggagttgcttgtgagccgatccagagaagtggcctatggctttccttttgattgtgtgcggtgtggttggggaggaaaagaagggcataggtggtacttattcagtgaatactgaatttattattcaggatgcccaattgcccacggactgagctctccaaggtgaagaggctgaaacaccacctctgactttctccatctctaatatttcctgactgtagccagttggcctggggcatctgtggattctacccaaggacactaggcacatgcttcagggccctaatgtcctcagggtcctaccagctccttcccttgtggcttcaaggggagttagcaaagagagattgcaagctgtgtcaagcctgaaccttgagcagtggccactggaaattctgagaatgagagggtgagtcctccaaagttgttcactggcccttccagcagcagacagaggcttcaaggagaagccctgagggagcagacagagttgggagttgctgcctgcgttatctgaaggaaaccagatggctggtttagggttctggcttgaggccccctagggattaggagatagatggagagactgaggcccatagaggagaagggactattagacccaatgggtagtcaataagggatggtaaaggtaggacagaagttaacgccagaaagacctaggttgaaatcccagctctgccactccccagttgtgtagcctaggcagtctatttcaccttctttaagacccaaattgctcatctgtaaaatggggataacaatacctaatttgaggattatgaagattggagaagatagctgtgtagtttctggcacacagtaggtgttctgtaaactgcagctttaaaaaagtactgcctccatgcttctcattgctttataattcataacaccttggtttttatttctgtcccttcaagtatcagaatagatcatgagctttttctctaaataaaggaataatttacctacagtgaaatgcataggtcttacgtgtaaaatttgatgagttttaacaaatttatccattcatgtagtaaccatctccctcatcaagatgtagaacctttccaacacccctgagggctccctcatgccctttcctagtcaatctctcaatctctaccctacaggcaaccacagttctgaatttcatcaccgcagattatttgtgcttgtttcatgtatgtgaaattgtacaatatgtggcctttagtgtctggattctttcactcaacatgtttttgagattcatacatgctgttgtgtagattggtagtttgtttgtttgttcttttgctgagtaacattccattgtataaatatgtcacagctaatttatttattctcctggtgataaacatgtgggtactttccatttttggttactatgaagaaagctgctgtgaacattcaagtacatgtctttgtgtggacatagtttttatttctcttggctatgtgtacctagaagtgagattgctgggtcacaagataagaatatgtttaactttataagaaattaccagtttttcaaagcatttgttcacatgtttttggaaagtaagggtgcaatggattcgtttttgagctagtacctggttacgcttagcatgactgtcaaccagaggaaacattggttacttaacacctacattatgctaggtgctaggaataaagaaatgaatatgaaatgctgttctcaaggatctcataaactagagagaaagatagtctattaaactctagtcattttcattaaattgacaagaatgaataggtcaaacccatctttagccagagcacatggcaagtcagattcggtgatcaaaggtaaagaagcatcctgacaggctacttccctagtaaaggaaggccacagcatgtcttgagggcccacggtgtgccaggacctggtctgaatgcaaatagccagcctctgcccacaaggaactctcaaggtgggatatgatgataccaatgatggaacccaagtttagggcagttcaatacacagctattgagcatctactctattccaggcactgttctagatacaaaagatgtgctggggaacagagctgacaatcttacaatctttcaggaggtttccaccaatggtgacaacattggtataaaaatgtttttttgtacatctgcattttgttcagaatatatctgttggagtccttagagatggtgttgtttgtaattgctagtttctaagatgggatgcgggtaggtgtaggacacagtcttacatagattaaggcgtcaggggagtaggagaatttgatgtgtttactcctctgcgtgcgagtggtcaagatggaaagcaatgcctactattgaaattgtcaagcaccgactggattgcctggtcaagctctccatgggagcccatggtagttctgggccaaccttggctcattcgtttaggagaaaggcacttccccaggaggcaagttactctgctatttggcctcaatgtcctcccacctccccatttcctgatgctctctctagtcaggttgcctgatcattctcatttgtaagagaaggccccttctcagcacttcatggagatttgtcatgttgtcccttgaagactgattagacaaggcttctcaacagcatcgtcattgacctttaggagctatgtggctccctggggccccagtgagcacgtgtacctggtgggagcaaattgcttgcccccaaggacactgctcacccaaaccacagccaagccacttggtaaatagtgccagtgacattttgcctttggtccacagctgtcacctgtgtcattcactcacaatggaagaaatgaagaagactgccatccggctgcccaaaggcaaacagaagcctataaagacggaatggaattcccggtgtgtccttttcacctacttccaaggggacatcagcagcgtagtggatgaacacttctccagagctctgagcaatatcaagagcccccaggaattgaccccctcgagtcagagtgaaggtgtgatgctgaaaaacggtgagcatgtggggagggagggagctgggattccctatcaaggctgccacggatacaccagttctttgatgtacttgacacacttggacacttatatgtttgctaaaggcaagttgctctgactagtgagaagccacaccccttcttagaagtttaatgtcaaaatggggctgccatctactgctccaaccttacctccccagcactgtcctccagaaactggcttccttctgtccgtcatgttcgctttgatttcttcctggcctttgcacaaactgttccttgtctgcaaatctcttccctcccttctcctaattaacccacattcatcccaagatcacttctttagggcagctttccctgaccacccacacccccaagcattcaaatatcctattacagattctcctaccgttctttaactctccttcacagcccttgtcacagttgcagtttttacacttgtataattatttgactattgcatactcctccattaaatgaaagttctgtgagggcaaggaccattgctgattttgcttaatattgtatttctagcatctagaaacagtgactgtgacataggggacaaccaacaaggatttgttgaatgagtaaatgaacatacaaatatgcaaatttgtgagcactgtatctaggtacaaagaaccttgaaatttccataaaagactaaaacataaattagaatcttgctgaataagccattagagcagaagtatgttatgatagtttttaaatgttgataatatttacattttatataatttatttccataaatggaaagttcccagttgtagagaggtggttttgaaaagttttaaaatcaaagctggctgggtgtgatggttcacacctgtaattccagcactttgagaggccaaggcaagaggatcacttgaggtcaggagtttgagaccaacctggccaacatagtgagaccctgtgtctacaaaaaaatttaaagaaattattcaggtgtggtggctcatacctatatctctggctactaaggagggtgatgcagaaggatcacttgagcctgggaggttgaggctgcagtgggccatgattgcaccactgtactccagcctgagtggcaaagcaagaccctgtctcaaaagaaaaaaaaaaagtaaagctactggaaaaagaaaaaaagaagtttaatgtaaaaatgggtgctgtttaatcaaatcagttcacctattttattatttcctcaatcatgttaaatgctgggtttactgctcagcacacaatgaaactccacaactatttactgtaatcattatcagtatttttcttcatcttctgttttttagagacagggtctcactctgttgctcaggctggaatgtggtggcgcgatcataactcactgcagccacgaattcctgggctcatgaaattttcccgccttagcctcgcaagtagctagaattacaggtatgcgccaccacacccagctaatttaatttttttttttttttgtagagacaggatctcgctatgttgcccaggcaggtcttagattcctgacctcgagcgatcctcccacttcagccttccaaagtgctggtattacaggtgtgaaccaccacacccagctagtattattatcactattattattactataggcctgatggggcaggaacaccaaagcatctatgaaaagaaaacgcatgtcccatgtaggtgctcccagcctcttctcaactaatagtgcatggtttggtgagcaagggtaggggccagagggaagtagatgaatagtcttgccacatccctttcccacccttcacagggccaggtgtgtctatttgctaattgttaagaaataaacagtcgtacatctcaaaacagttacttcaagataactaagtcaaaatgtgcacatcaaaatatccaggtttgaaggaagccttaaacatcacactagcaggggctgtagtatgactttcacggaccctggacacttttgtcttcatggacctccttcctccacaaaaacattaaaagttacattttatgactgcattggtataaagatgaatataatccaagctgagttcatgttttaaatatattcagtatcactgtcatattcattttttcttctgattttaaaacatttttgtgggcccctaaaactattaatgggtcctaggcactgtgcctcctgtgcctaatggagaagtcaccctcgccagctggatgtcactcaatatggctccctttacctttttggaaagtgagcaaatatatcagggtctggtggatttcaagagctctttattggtgttggtgagtgcacatgttgaacgacttgctcccactggaagacgtacgtacctccaagtaggggcttttgtgtaaagtggacaagtggggcctctgcctccaggcaaagagctcccctgtttccagatgccatcattctggctttgctttttgggactggagagggagttgatgtgtatctgatgtattcacctttgcagaatttacttctctcttagaatttacttttgcagtcaatcaatgtggttttctcagagaatcttgtgggttaaataaatatgtggaagggcatggggtagcagcagatactaaaggaaatgatgtagagcttgctgttaaaatgggcaggagggggtgggtggggagtggggaggtgatgtctaagagtgtgctgaataatcacaacagaagcaggaatgaccatggtcttgaatcatttgggggattgacatgtggtaagagctgagaaatgtggtgtgtgggattcagaagatctaactgactccttggaagtgtcaaaatctcgggcagttaatacacagacaagtatactgacttcggctatttgactctgatttatttctgaacacattggcttggattcattataatcattcccttgtaagcatcatcaagccatggtctcactttttctattctacttgcctggtaaaacccaagctgggataaaaccaactcttggcctattgccccatttctctgcttcattttgcagcaaaactcaaaattggtatttatgtgtactctgtcctttcctctcatgctctctaaactccattccactcatgctttcaacctcatcactccttgaaatcgctcttatcaaggttacccagtgacctccactttccaaatccaatggtccctatctgtcctcatctgatttgacctatcataacatttgctgcagaagattgctctctcctcgtgaaatacctacttcgcttgcagtcagcccataacattatgctttcttggttttcctcctgcctccctggttactatttcttctcagtctcctttgctatatgtccttctctctccaacttctaaacatttcagggccccagtactcaggtcccagacaactcctttctctgtctacacttactgtcttggtcttaaatgccatctatatgttgagcaattccaaatgcatatctgcaaaccagaatggatttcagacgtgcctgtctaactgcctacttgatcttcacttaacatgcctaataggaaactcaaacaaaatagctcccaaactgaataaactcttaatttccccctcaacctgctctgcccacagtctttcccatctcaataaatgggagctgcacccttccaattccttgaagtcatgcttaacacctctctgtctcacaccccacatccaatccttttggaaattgtgtaggttctatcttcaaaatatccaagatctgaccgcatcttctcacctccgttgtcacctgggtcctagaagctatcatcaccccccgctgaattgctgcagtcacctcctaattggtctcattgcttcttcccttcctctccttcagtctattcttaggagggcagtcagaatggtagcattaaaatgaaagtcacacactagcactcttttgtttgaaaccctctgacagcttcccatgtcacttggaatcatatccaaagtctataatggggccctacctcatctgggcccccgttgtcttactgatctcatatcttaccactttctgcctcacccgctccagtctaggctccttggtattcataaactatgccaaggacaatcctgcctcaggcctgccctttgcacatggtctctcctatccctggaatgctctttccccagatacctgcatggcgtcacctttctccattcaagtctccacctggatgtcaccacttcaaacagtccttgtctgagcaacctatttaaaaaatgaaagcccccaccctctcacgtctgtcttcttaccctgcttcatttttcttcttagcatttgtcaccaccgggcacattatatgttgtagttctttctagactcctctctccccttaccctctgagctccgtggcagtagggactcaatctgttaactgctgctttctaagtacctaccacaatgcctgacacatggaggcactcaatacatacggcttgaacgaatgaaattatgattttgatcacaaggtgttgaccctacagatgggggtcaccgtagagagggagtacggtgtggtgtacagctttagaaccactcagcatggggccaagccagctccatcacttactaacagtgtgatctccagacatatcacttctcctctctgtgcctcagtttcctcatctctaaaatggaataatattgaattataggactgtgcttgtgaggagtcaatgagataatgcatgtcaagtggcacatagtaagtgcaatgtagtccaagcttgagttgagtttttgaacagctaagatagatgtgaggacctgtgttcacaacaccaggttcacagagcagcaggcatctcccataagcctccaggttttcagggggttctgtttcatggctgccatagagtttcctgtgccttctgatttcacctcgaccttctgtgaaacccctgcctgctgagggaagttgggcatggccctgttccttgcccaagccagccttcacaggccagatagagaggtggcttggttctccatcttccttcttggttgttgcattttccctataagaaccccacaaatcctttgactgtgaagatgttgtctccctcacagagtgtggtgcgggctaggcaaatatttgtccgctgattgagcaaatgaaggaaaaactgcctccctcaaagcctctcttatcaccactaggagtcaagtttctcataagctctgctgcctcaggggagggccccatgaaaggcttccagtcccacagaggttctcactggaggtgttatatgacatacatatggctttgaaaatggtgggaaatctttcaagtggcctttcattactgactgttagtatcctctcaaaccctacagaccagcaccaggccgtccagcccagctaggccattccaaggagaacaggctcccattcatgggctcccatggccgactcgcccacattctaagggctctctgttgagccaaatatgcaagtcccaaacacagagacccgtgtggctaggaaatgccgtcaaatttcctggcttctcttccccaatcagtgttgtgtttttatttacttatgtataatttatactggctgtacttcagaaaagaaaatacaagttgaaggtatctttgaattatctcccttttaaaaggacattgggaattttagaatcagtaactagagaagcttcagtaactatagtttgtagggggcatggtcctggtacgtatgccaccctgtgttcttcttgtcctgtccccagccccagtcctgaggccggcctcaggcctggcaacattgctctagggctgctgagagaaggtgagagggtatatacgtgggcctttagaggtctcaaaggatccagcctccttctctctcccctcccatctgccataatcagtaagggtagggaagaaatgctggctttttttaaaaaaaaaaagtgtaaatatctatgtgagatatagtcatgctagttgtttatggcccttgtaaatactgacagtttcctgtcttcttttcccgtaaggaagaggaatctatctgcacaaacatatatggagcttccagcgaataccagacaccacactaaaattagtgcattttacttcagtccacgaaatccactgtgatttataaagttcaaagacaggcaaatctaacctatggtgtcagaagacaggatatggttacgttttgggggtgttgtgactgagaggggtacggtgtgcttctggggtggtgatcaggttctgttactcgagctgggtgctcattacccagtttatgaaaattcccccagctgcacacttccatttgtgcgtttttctgcatgttggttgtgcttcacaaaactattttgcaatggatattattatccttattttacagagcaggaaactgcagcccagagaaggtaagtgcctagagatgggtcacacagccagtgagtgataaagattgaaacccaagtccatcgatctccagagccagtctcttgaataccccattgtcttgcctttgtacactctgacaatgccccagcaagaggatttaatacctataaggactatcgctaataatgtgtataatggctaacactttttgaacactttctgtgtgccaggccctttgctagggtctgtcacgtggattatctcactgaatcttcacaccaactctactggttaactctatgtccattttcctgatgaggaaactgaggctcagacagtcaagtgacttgcccaagatctctcagctaatatggggagtctatagtatttgccggcagatggaattgatttcggatcttagccactcagcatttcgaatactagctcatattctgtgtttgatctctgttttcagttgggaaaaggaatctggatattcatccaaagactaggtaccccagggaggcagctgtgaaagaggggaaggaactgagaggcccccctggtgccctggaacagcacaatctcctctaagctctccctccatccccagtgatattttgacctcagctaatgcaaacaatatgctttttgtacttgggggtgaatggatgaagtgcaagtgccaccagcaaagagggcagagagggaaagtcaacgcgtgcagatcatgcaggccaaggttggactttcacagtgcaaagtgtgcatgtgttcagagggttcttgatttcaacttcatcataaaatgagatttgtaggccaggcatggtggctcattcctgtaatcgcagcactttgggagggccaggcattcaaaaccagactgggcaacatagagagaccctgtctctacaaaaatatttaaaaattgtccaggtgtggtggctcacacctgtatttccagctactcaggaggctgaggctgaggcgggaggattgcttgagcctggggaaactgaggctacagtgagctatgatcttgtcagtacactccagcctgggagacagtgagaccctgtcaaaaaaaaaaaaatcccacagaatttgcattaaaagatgcagaaagagggagaagagaaggaaggaaagaagaaaggatagatggaaggaaatcaggcaatcatggattagtcgttcacagctgtgactcgttttttgggagcttcacgtgtcaagtggtttcttacgtttttgcttaaaacataatttttactatttacaaacataaaatatactcctttttggaaatttagaaaacacagataagcattcaggaaacaaaaaccacatgtacatccatggacatgtactaatttttacaacgtgacatcattttgcacagaatgggttgtaacctgcttttttaaaaaattcatcaatgtcatatccacttctccatgccattaaatgttctactacaacatcattttaatggcttaagagtatcattttatagatgtaccaaatttattaaaatttttggatatttaggttgttgctaatctttcgctatattatacaaatcactttgaacatccttgtgggtacatttttacatgcatcattgactatatccttaaaataaattgctacaagtggaatgcttgggtcaaagagtacacacaaattttagggttttgatatttaccgacaaatttcttcctagaaatgttatgccaatctgccagccctccaacccaaggagcatgtaaaagtgcccacctcactgcattctttgcaatattggggaggcatagttggtaagagcataaggtttggaatcagacacctctaccacttgctagccgtgtgtccttagacaagtcactttaaccattctgggtctcgattttctcatctgggttgctgtgaggatcacatgagatcatgtatgcagagtgctaagtaaagtgcctggcccatagtgagtactcaataaacaaaaactactatatatttacaaattgttcctgcccacctctgatgtgttattccctgggaatggccacagactgagcaaagacttctgaaatccctcttttataaccagtatctactccagcctccaaaccagccctgaagtgctgctgctgcctctgctgctgttatgggccccttggctcagtcctttctgcccctcccttctccagcactaggtgactgttggcagggagggttcttaggcctcatgcattaatgaccatcttgctttttctcacgttgattgtgctgagtgttgcaaaccagtaaagaaacccagagtggctttttaaactgaaatgatgaataataacaacagcaacagctaccacttattgagtgccaattgtgtaccaggcactgtgctaaaccttttacatggatggtctcattcaatctcataacagtctcagaggtgggaggggacttgctcagtgtcacatagctaggaagtggcagatctgggattggattccaagcctctctgacttcaaagtctgtgcttttaaccactttcatcctgctctcttcgatttagaaaggttcagtggggaagggtgtgtatgtgtgtgtgtgtgcatgtttgtgttagtgagtgtgtacatgtttgcaacggtgcatatgtatgtgtgtttgtgtgtaaataagtgtgtgcactcattagaataatactttttcagggccactatgtgctaggcactgtgcaagttcttggggatataatggtgaacaaaagagaaatgatctcagctctcgccaagcttactgaacgataaagaagaccaatagtgaatgaatgaatgtaagaattaagaaataaataaattacagtattactgccatgaaggaaataaacagggtgcagtcacagaaagtaacagggtcacaaactttagattggaagttgagggaaggcctttctgaaagggtgacatttaagtttgtatgttgaaaaactaatctggaataggaagtcagggcctccatgcaaggataaagtggagggaaggtactctggaatggcggcaaactcataagtgcctgaagatgttttctagagtgttctggggctcccaaaagtgtatatgggtggaaatgtgtggcgcctctgggtatgcatggaaagcagggggaatggcctgccagtttcaccgaaaaagggcagtgcgggaaatggagaccagctctctctggacaggttttgtctcaggaccaacagcatcaggaattctagagggatgaatgggactaagaggtagggtctagatgcccagggttgaagttagtggagtggaagccatttgtactcctgctgaaagaaaaatcctagcctgccccatgtatgcctgcatcagggtgtttcttacctgctctccactcattcatgtggtcaggggcttgagaaggcagcaaattctgccctggggctccctctctcacttctagaggtaactaatagggggcacttggatgaaaaaaatgtcaccaggatcacttttagtagcagcagcagccttgagccagtgcaggtttgtagtttaagaggtctttacccatccacagggtaggtgggagtggctgctggagcagttggcccaagaggcctgaaaaagagaggcccactcaaatccagggtctccactccatgggccactgacttccaagcctaatctggaatgatgtgtttccccaggccacccaaggcccgctgttggatcactgtgaatttggggttaggacaccctgtgcgtgcccataagctcccatccaaactgtgctctggggcacctggtgaccatataggactttgggctgtggcacaccaaaccacttcccttaacatttcagagaattctagaaaggaagcagttaagagaaatattcaaaacattctggggctctgctttccacatttcaagcattcagcccctaagtcatatgtatgagatctgtaaggcctgttcacatggaaactgcctagttgtcaggggctacgctttgtttctaatttgtgcttaggacatgcagtaccctcattcaatatgaaacacagactgtgattacaccaaattagcttaatcactctctttgtgcactgaattgcttctggcctggagatatcaattttcagaagtagcattcaccctcaccaaaacaaatcttaatatattgtcttgcctttggtttcataagaagggccaaccatcccccatcactcactgtgaatggtgtgagatgttggggagaatgtctttgccttgagggcttggacttctcttcctatcctttgtgtcacactgagtgacggcactccagtaacactgggcaggcctttcagaattttttatcttgtacacaatccagtcaaaccaaacattcaagagcgctaggagaggtttgtatgggaaagaggaccagtgtcccagacatcctctccagccggctaatcttcctttgtctccacacccaccctctctccattatcttggatagatgataggctccaggctttaagaactgtgtggaagaactctttccctcctcccttcttgcctgagtgggtgttgagaatggggaaaacattcatccttgtcctaagctatcctggacatttgagatctcagattcagcggctatcataggcacaataagaatagtgtctatgggaccaaaggacactccatccctcttaaccaatccacatgaacttcacaagaagaaactaagtcacctcttgaccctcagaattctgcttttgcaaaatggggtccaagcaactacttccctccccattacttatcgttccagctcacttcccttcttggctaatctgtttttgctaccttggttcagtctcttaacatccctgtgcctcatattactctggaaaatgtggttttagctcctagagttgtgtgagtgaccagcacaggtaagtgttaagccctttttaaagttctgtcgagtccccctatttggtgtatttaaaacaccagctgtaaaataaagctagatgatagcagcaaccaaacacaaatcaagcacatttacttccagaaaagcatccttaaggagctggttggatccgggagcaaaggtatctatacagagatgctcattgtaatgctgttagcataatagaaaaaaatggaaataaccaagcagtgcacaaatatgacatttgttaattactgccttaccatggactacttactgtacagcactttaaaaagctggtgtttggctctcccccttcccttcctttcccttcccttcctttctttttctttttttctttcttaccgagtctcactctgttgcccaggctggagtgaagtggagcaatctcggcctactgcaacatccgcctcctgggcacaagcaactctcctgccttagcatcccgagtagctgggactacaggtgtgcaccaacacacccagctaatttttgtatttttagtagagatgtggtttcacaatattggccaggctggtctcgaactcctggcttcaagtgatctgcccaactcggcctcccaagaagctgggattacaggcatgagccactgtgcctggcctattcatttctataggaggcttttcatgatattttaatgaagcaaaaatggcttgaataacaatatatgttgtgaaaacaatgcatacatgaatagaaaccaatcctagaaacagtacacctacggaggacaatggctgtttctggatattatcattaggatgattttattttagcttttctgtatttccttcaagttaaaaaaaatagagtatgtattaaaaaaaaaactacatccattttgaaaacaataaacacctaacatgtcttctaaatctttccttctcagatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacgtgagcctctcctaagtctcctccagcaagacagatgcctagcccgtcctcaggaatctgccgccagggagaatggcaaccctggccagatagctggaagcacagggttgctcttcaacctgcctcccggctcagttcactgtaaggaaatgcctacagatacttggaggggtgcctctgattggttgtggttgagagtgagttggcatgagatgaggtgccaagactaattgctgccactctggacatagggctgctgagggaagggatgttctgcttaaatgttccatacatcttcactaggcttcattgacattcacagtttaatagctaaagggttacatagatagccagccagatggacttggcccgaagtactcaccctagcctgtcaacttggccttaccttagaaaaatgatgggctgctgcgtaatatcgcagggtcctgtgtttacctcattgggagcaattaaataagccatttgcagaacagagctctgtgacgtacctacaggctcaaactgtagcctctaaacaggttggcaacttgcagtgatgtcaggctccaggcaaacaacaagggcaatctataccaaccatctgctccacacattaaaattcaaagcgactgtaggaggcagccccattgctgcttggagacctaacagtgcctgactgtccttggcttgctcctgcactctgggatcctcctgcttggtttcccttgggttcctgctccctgaccaccacccctcccctgaactaaaaacacccttaaggcttactcacctcttcattcactcattcacccagcaaatatttaatttgcgcctaccagatgcaaaatatccatcagaaaacaaggctcccttctttgtaaaaggacggggaagaattggcattaattatacttccaccaaaaaatcaacctactctgttgcaagatttgcctttaatatgaaacacttataaatatatattttatagtttcatggaaccaagtctgcatcctctgccattctgtactctggacgaattttcttttgcagcttccttgtccatacatagtgtggttctagtgttccatgcctgaaagaaattactagaagccatctttacactgaactaagcatatagtaaacaaaaggcctgttcagcatagcctacctaagtcaggcactgtgttctattctaatgtggaaaacaaatttcccattaaaataccactctgtcatttccagaatttgattaggaatgtacttaaggagtaaatcatagaagtgtcatgtttgggaaacctgtgaaatttcctacccctctactctttttcaaaagtcctttcctactggattcacagggaaaattaggccaactgtgcttgtatatatgcctgtgcatacacacagcaaagccctgtttcgacagtaggttagaacacagatggctgaaatcatcaccttccaaacttagcaactctttacagttcaagtccaattcagcaaatatttagtgagcatctactgtaagcaaggcacatcatggtgaaactaatgcaggcattgtcctattcctgaaatctcaagacacattcacaaacaaatggttatcaccaaggtcttcatgctctactcatgttgacatgagttgtattaattggtgactggaagtccaggatctgttgaggaagtcagtgacccttaatcaggaacactgccttggaaggtggtggacctttaaaacagaagcttctcagtttttgtagcatctgatatgagagaatatgctagatattcataaacttagggccaggcaatgtggggcccctggaatgctactgggcactctctaacctagtcctagaaatttcagttccaataatgttttcttcttcttttctagataagaaactatatgtatctcgtggatctgccagtaccagccttccaaatgaaagtaggtatctgggccagcctttgatggtgtgtgtctgtatcctgagaacgaacttgagaaataaggcttctgtctactactggagacactggtagtataaaacccagagtctccagtaatggacgggagccttatttctatcactcagtgttttcatagatagaatttgtttcattttagcctcaaaaaagagtatatgcacttcctatcttgtaaaattttattttgctatagaagaaactctccttagtttcttttttcttttctttctttcttttttttttaacctgagtttgacttaactgaagtagccaaggtgactcagaaaaattaagaaattcatgaggatgaggattagcttgctatgtcccagatgttcagttttcagcctagtattcttttatttatttctttttttttaacctgagctggacttaactgaaatagccaaggtgacccagaaaaattaagaaattcatgaggatgaggattagcttgctgtgtcccagatgttcagttttcagcctagtacatagggccaccccaggactctgcagtcagtgaaaatgtcaactgaggcatgaggccaggactctgagctccacactcaatttgaaagtggtgtcagtgggaacttacaaaagaggacaatctgggtggaatgacaggaggatcttcatgacctgggttcagggtcaattgccagctttattatttacttgcttcaggaacctggtcacatttcttaaccacttcatgccccagttgcttcatttttgtcaaataagcataaaatagtgcccacctcattgggtgaggtgtgaggagtaaatgaaataatgtataccaatgcttagaataatggctggcacattactctaagcgttggcatacattaaaccatcaagaattctttttggagggcatcctgtgttccccaagctgtgctctgtgtgctgtgtttaagagaggactcaagctgggtgtggtgcctcacacatgtaatcccagcactttgtgaggccaaggcgggaggaacacttgagcccaggagttagagactagcctgggcaacatagcaagaccctcatctccataaaaaataaaaatagagaggatccaaaggaagagccactaccacagcccctgatctcaggcatttgacagtctggtgtgaagtaggggtgagggcaatctatagaccccactagaatgtcaaccccatgaggactgagactttgagaggtataccactgtatccctagcaccttgcacagtggtatacaaatttgttgaataaatgaatgagtgaatgctggaaacaataaaagagcatttaacaaggaaacagtaagaaaatgtagtaatgtagtaaaaattattccaatgtagtaaaaattattctgtttgatgccttcgtgtgagagacaaacaaaacaaaaaccaaccctggtgattaattggccatgcctccatgaggagattcatttagagctggttcaaaagccttagcatagccaaggcaggcatcacataagtccctgcccaaggaaatgagttctgctggccttctaacttatgaaaggcaaggattgtggtgtttcctgagtacttgttaatagtttctacatttgtttattgtgagtctcagaattactgataacttgatgcttaaaattgttcatagactaaaactaacagcaacaacaacatgtattgggtgttgactatgagccacataccacatactccatcttgcttagtccccaccatgaccttgtgaggtgtatgtgaatatgtcctaggtgctttactcaaccgatattcagtaaatagtgattgaatgaatgaatatccccattttatagatgaagaaactggatctcaaaaaggtgaaaggacttgccttaaatcacacagcagcaagtggcagatgcagtattatctccttgctctcacagtgtcataaaattatcagaaacaattccaagttaaatcaagtatacaacagtgaaaattagtcactggtgagattattttaccacacatgagttcactgtctatctgggaccagggcactatcctaaaataaaggaagggggatgcagaaggctcagaaagcaagcaaaagagcaaagaaaaatatacctttgggaaagaaggtgggggatgttctttccttgcagagagtagttgaggaaaggtggctatgccaacaggcccaagtctgcctttctaacactgtggccctgggcagagggaggtaacatggagctgagaggaagagaagggacttcctagggctccaagtaaaaggacaatggaacccagcaaagcccatgctcttaagcatgacaccagtctcccaatcttgcctgatggtacgaaccacctggggagcttgttcactgcccagatcctgctcccccacttcctgggggagtagatttggcatgagactcagttgcctcttcatgttttattctttttttttttttttttttttgagatgaagttttgctcttgttgcccaggctggagtgcaatggcgcaatctcggctcactgcaacctccgcctcctgggttcaagtgattctcctgcctcagcctcccaagtagctgggattacaggcacccgccacaatgcctggctaattttttgtatttttagtagagatggggtttccccatgttgatcaggctggtcttgaactcctgacctcaggtgatcagcccgccttggcctcccaaagtgctgggattacaggcgtgagccactgctcctggcctcatgttttattctttatataatttatattaacctcatttaaaagtgaactacatgaacctttcagtggaaatttaggttgttctgaaagatttcctatgtgaggctccagaaaaatatttgtcaaggaagggaggcagagtctcctcctgcccctccgatatggccctagtcccctcatgtgggctgtcatgcatctatgaagcaggggcatgtggagcagaagagtcatcagagccaaaagggtagtcagagagaccttggagaaagacattctggaggttagtctcacaaatgttgttcaaaagttttagtgaatttgattttatcttttggtcggtagaaatagacatactggttatatattgcttcaatggctacaaataataataacagttgatattgctaattgccagatacaggactataatatacattggagatataacagtgaataaaattgtcttggtccctgccctcacagagttaatagtttcgtggggaagacatgcccacccccaaagggaaaatacaaaatatttgcaagttatgataagtggagtgaggaaaacacatgaggtgttgaaatagggaaaaatgggggccaactttagataaagtgttcaaaggaggcctttctgaggaagtgacatgtgatcagggacctgaatgaagtgagagagccagctctgggaagaattagggcagagatggagggaggtggaggaaattgtccctgcaaaagcccgagatgtgtgtgaagaatggaaaaaaaaaaaagaccagggtgacaggagtggagtaagaaaggagagagtgtggtacaagagaagtctggagaggtaggcaggggccaggtggtgcaggggccttatgggtcacattgggagttgagatttcatattctaagcgacattgtgagccatggaaggattttacgtgtgatccaacttgcatctgataagatcacaaaagctgttctgtagaggacacattggagaaagggaagaatgaaaacaaagaggcaagaagcatgagaggatgatagcctggattaggtggcaacagcagagacaggggtatttgagatctatgtaggagggttagctcttaggacttggtaatggattaaataggaatggcaaagaaatgggaagaatccaggttatctcctaggtttcatgtttcaacaaatggataggagaatataactgttttggccatgtcaattctgaggtgcctataagacatccaagtggatataccttttaaacagttgtatatgtaagtgaagaaagtctgggtaaacatttgggatgtatattagtcctgtacataagtggtatttaaggccattggatgtgatcacctagtcagaggacgtagacatagaagagaggagagctgcagaaagaggcctggagggtgtcaatatttagagactggggacatgaggaacaaacggaggagactgaaaaggtgtagccagtgtgataagagaagaaccagggcagtgtggtacataacagaagctaaaagaggtgaatgtttcaaaacagaaggagtgatcaactgtgttaaaggctgtggagagatcaaataagagaaggtcaaataagaagaaattcctattggatgtggcatcagagatttttgtagacgtgttaagagcagttttcattatgtgatgtggacaggagccagattgaagtgggctgaagagtgaaccagagatgagaaagtggagatagtaaattcgaggagcttcttagagaaatttaacattgaaatgataaagagaaaaaagatgttagctaaagagattaatggggtttgagaaggtctttttttaagaggcaaatattagagcctctttgcatgataatgggaatgatccaatataggaggatgaaggtaacttgaggggtgaagtcattgagaagacagaagggacatgtagaagcattgagctttcataagaacaggggctgttctgccattgaaagtatagaaaagaaagctaataaggacacagatgcaaattgattttcaggcttgcttgtgaggagactaaaaagtactaatctaatgatttctattttctcaatcaactgtggagcaagacagcaagagtgtgggatatttaaagagagtgagaaagtatgaagaagtcttcttgggcattgggaaagcaaagcctgatagtagacaaacataagtaggatttctgggtggtgatctgaagtctgagctcatgaatttcaagtgcgaactctcagttgggttgtgcaattttcatcagtgatgttagcttagtgtaatgtgcagagaaggcaaatggggacgcttatctaggggtgaggttgtggcaagtgagtatgaaggatagagaataaggaaaaggagtcaagggtgggcaagacccattgagaataggttgaggctgtgggtttcctacattttcaaagtttgaaaagaagctgaaaagtctcagtctggtcctgatgaatgacatactttcacttgaaaactttggtttctcaatcctaacaaagtgacccccaaatgcaattgttgagaaatctgataacttactcattagaaattgagtaaactgcccgtcacaagttgaataaattctgttgtggctgcaatagaatttactctgtatccagagcatttcttggatgcagtttcatgagtttctgtcttcccttcctctgaggttgaggactctggtatctgacatcccacaggtgttcatctggaccctggaggagacttacagccttccataggggcctaactggctttcattaaccatgtaacttctcctttagctctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgcta

SEQ ID NO: 3887 - DNA, 20612 bp, human
ccccctcgagtcagagtgaaggtgtgatgctgaaaaacggtgagcatgtggggagggagggagctgggattccctatcaaggctgccacggatacaccagttctttgatgtacttgacacacttggacacttatatgtttgctaaaggcaagttgctctgactagtgagaagccacaccccttcttagaagtttaatgtcaaaatggggctgccatctactgctccaaccttacctccccagcactgtcctccagaaactggcttccttctgtccgtcatgttcgctttgatttcttcctggcctttgcacaaactgttccttgtctgcaaatctcttccctcccttctcctaattaacccacattcatcccaagatcacttctttagggcagctttccctgaccacccacacccccaagcattcaaatatcctattacagattctcctaccgttctttaactctccttcacagcccttgtcacagttgcagtttttacacttgtataattatttgactattgcatactcctccattaaatgaaagttctgtgagggcaaggaccattgctgattttgcttaatattgtatttctagcatctagaaacagtgactgtgacataggggacaaccaacaaggatttgttgaatgagtaaatgaacatacaaatatgcaaatttgtgagcactgtatctaggtacaaagaaccttgaaatttccataaaagactaaaacataaattagaatcttgctgaataagccattagagcagaagtatgttatgatagtttttaaatgttgataatatttacattttatataatttatttccataaatggaaagttcccagttgtagagaggtggttttgaaaagttttaaaatcaaagctggctgggtgtgatggttcacacctgtaattccagcactttgagaggccaaggcaagaggatcacttgaggtcaggagtttgagaccaacctggccaacatagtgagaccctgtgtctacaaaaaaatttaaagaaattattcaggtgtggtggctcatacctatatctctggctactaaggagggtgatgcagaaggatcacttgagcctgggaggttgaggctgcagtgggccatgattgcaccactgtactccagcctgagtggcaaagcaagaccctgtctcaaaagaaaaaaaaaaagtaaagctactggaaaaagaaaaaaagaagtttaatgtaaaaatgggtgctgtttaatcaaatcagttcacctattttattatttcctcaatcatgttaaatgctgggtttactgctcagcacacaatgaaactccacaactatttactgtaatcattatcagtatttttcttcatcttctgttttttagagacagggtctcactctgttgctcaggctggaatgtggtggcgcgatcataactcactgcagccacgaattcctgggctcatgaaattttcccgccttagcctcgcaagtagctagaattacaggtatgcgccaccacacccagctaatttaatttttttttttttttgtagagacaggatctcgctatgttgcccaggcaggtcttagattcctgacctcgagcgatcctcccacttcagccttccaaagtgctggtattacaggtgtgaaccaccacacccagctagtattattatcactattattattactataggcctgatggggcaggaacaccaaagcatctatgaaaagaaaacgcatgtcccatgtaggtgctcccagcctcttctcaactaatagtgcatggtttggtgagcaagggtaggggccagagggaagtagatgaatagtcttgccacatccctttcccacccttcacagggccaggtgtgtctatttgctaattgttaagaaataaacagtcgtacatctcaaaacagttacttcaagataactaagtcaaaatgtgcacatcaaaatatccaggtttgaaggaagccttaaacatcacactagcaggggctgtagtatgactttcacggaccctggacacttttgtcttcatggacctccttcctccacaaaaacattaaaagttacattttatgactgcattggtataaagatgaatataatccaagctgagttcatgttttaaatatattcagtatcactgtcatattcattttttcttctgattttaaaacatttttgtgggcccctaaaactattaatgggtcctaggcactgtgcctcctgtgcctaatggagaagtcaccctcgccagctggatgtcactcaatatggctccctttacctttttggaaagtgagcaaatatatcagggtctggtggatttcaagagctctttattggtgttggtgagtgcacatgttgaacgacttgctcccactggaagacgtacgtacctccaagtaggggcttttgtgtaaagtggacaagtggggcctctgcctccaggcaaagagctcccctgtttccagatgccatcattctggctttgctttttgggactggagagggagttgatgtgtatctgatgtattcacctttgcagaatttacttctctcttagaatttacttttgcagtcaatcaatgtggttttctcagagaatcttgtgggttaaataaatatgtggaagggcatggggtagcagcagatactaaaggaaatgatgtagagcttgctgttaaaatgggcaggagggggtgggtggggagtggggaggtgatgtctaagagtgtgctgaataatcacaacagaagcaggaatgaccatggtcttgaatcatttgggggattgacatgtggtaagagctgagaaatgtggtgtgtgggattcagaagatctaactgactccttggaagtgtcaaaatctcgggcagttaatacacagacaagtatactgacttcggctatttgactctgatttatttctgaacacattggcttggattcattataatcattcccttgtaagcatcatcaagccatggtctcactttttctattctacttgcctggtaaaacccaagctgggataaaaccaactcttggcctattgccccatttctctgcttcattttgcagcaaaactcaaaattggtatttatgtgtactctgtcctttcctctcatgctctctaaactccattccactcatgctttcaacctcatcactccttgaaatcgctcttatcaaggttacccagtgacctccactttccaaatccaatggtccctatctgtcctcatctgatttgacctatcataacatttgctgcagaagattgctctctcctcgtgaaatacctacttcgcttgcagtcagcccataacattatgctttcttggttttcctcctgcctccctggttactatttcttctcagtctcctttgctatatgtccttctctctccaacttctaaacatttcagggccccagtactcaggtcccagacaactcctttctctgtctacacttactgtcttggtcttaaatgccatctatatgttgagcaattccaaatgcatatctgcaaaccagaatggatttcagacgtgcctgtctaactgcctacttgatcttcacttaacatgcctaataggaaactcaaacaaaatagctcccaaactgaataaactcttaatttccccctcaacctgctctgcccacagtctttcccatctcaataaatgggagctgcacccttccaattccttgaagtcatgcttaacacctctctgtctcacaccccacatccaatccttttggaaattgtgtaggttctatcttcaaaatatccaagatctgaccgcatcttctcacctccgttgtcacctgggtcctagaagctatcatcaccccccgctgaattgctgcagtcacctcctaattggtctcattgcttcttcccttcctctccttcagtctattcttaggagggcagtcagaatggtagcattaaaatgaaagtcacacactagcactcttttgtttgaaaccctctgacagcttcccatgtcacttggaatcatatccaaagtctataatggggccctacctcatctgggcccccgttgtcttactgatctcatatcttaccactttctgcctcacccgctccagtctaggctccttggtattcataaactatgccaaggacaatcctgcctcaggcctgccctttgcacatggtctctcctatccctggaatgctctttccccagatacctgcatggcgtcacctttctccattcaagtctccacctggatgtcaccacttcaaacagtccttgtctgagcaacctatttaaaaaatgaaagcccccaccctctcacgtctgtcttcttaccctgcttcatttttcttcttagcatttgtcaccaccgggcacattatatgttgtagttctttctagactcctctctccccttaccctctgagctccgtggcagtagggactcaatctgttaactgctgctttctaagtacctaccacaatgcctgacacatggaggcactcaatacatacggcttgaacgaatgaaattatgattttgatcacaaggtgttgaccctacagatgggggtcaccgtagagagggagtacggtgtggtgtacagctttagaaccactcagcatggggccaagccagctccatcacttactaacagtgtgatctccagacatatcacttctcctctctgtgcctcagtttcctcatctctaaaatggaataatattgaattataggactgtgcttgtgaggagtcaatgagataatgcatgtcaagtggcacatagtaagtgcaatgtagtccaagcttgagttgagtttttgaacagctaagatagatgtgaggacctgtgttcacaacaccaggttcacagagcagcaggcatctcccataagcctccaggttttcagggggttctgtttcatggctgccatagagtttcctgtgccttctgatttcacctcgaccttctgtgaaacccctgcctgctgagggaagttgggcatggccctgttccttgcccaagccagccttcacaggccagatagagaggtggcttggttctccatcttccttcttggttgttgcattttccctataagaaccccacaaatcctttgactgtgaagatgttgtctccctcacagagtgtggtgcgggctaggcaaatatttgtccgctgattgagcaaatgaaggaaaaactgcctccctcaaagcctctcttatcaccactaggagtcaagtttctcataagctctgctgcctcaggggagggccccatgaaaggcttccagtcccacagaggttctcactggaggtgttatatgacatacatatggctttgaaaatggtgggaaatctttcaagtggcctttcattactgactgttagtatcctctcaaaccctacagaccagcaccaggccgtccagcccagctaggccattccaaggagaacaggctcccattcatgggctcccatggccgactcgcccacattctaagggctctctgttgagccaaatatgcaagtcccaaacacagagacccgtgtggctaggaaatgccgtcaaatttcctggcttctcttccccaatcagtgttgtgtttttatttacttatgtataatttatactggctgtacttcagaaaagaaaatacaagttgaaggtatctttgaattatctcccttttaaaaggacattgggaattttagaatcagtaactagagaagcttcagtaactatagtttgtagggggcatggtcctggtacgtatgccaccctgtgttcttcttgtcctgtccccagccccagtcctgaggccggcctcaggcctggcaacattgctctagggctgctgagagaaggtgagagggtatatacgtgggcctttagaggtctcaaaggatccagcctccttctctctcccctcccatctgccataatcagtaagggtagggaagaaatgctggctttttttaaaaaaaaaaagtgtaaatatctatgtgagatatagtcatgctagttgtttatggcccttgtaaatactgacagtttcctgtcttcttttcccgtaaggaagaggaatctatctgcacaaacatatatggagcttccagcgaataccagacaccacactaaaattagtgcattttacttcagtccacgaaatccactgtgatttataaagttcaaagacaggcaaatctaacctatggtgtcagaagacaggatatggttacgttttgggggtgttgtgactgagaggggtacggtgtgcttctggggtggtgatcaggttctgttactcgagctgggtgctcattacccagtttatgaaaattcccccagctgcacacttccatttgtgcgtttttctgcatgttggttgtgcttcacaaaactattttgcaatggatattattatccttattttacagagcaggaaactgcagcccagagaaggtaagtgcctagagatgggtcacacagccagtgagtgataaagattgaaacccaagtccatcgatctccagagccagtctcttgaataccccattgtcttgcctttgtacactctgacaatgccccagcaagaggatttaatacctataaggactatcgctaataatgtgtataatggctaacactttttgaacactttctgtgtgccaggccctttgctagggtctgtcacgtggattatctcactgaatcttcacaccaactctactggttaactctatgtccattttcctgatgaggaaactgaggctcagacagtcaagtgacttgcccaagatctctcagctaatatggggagtctatagtatttgccggcagatggaattgatttcggatcttagccactcagcatttcgaatactagctcatattctgtgtttgatctctgttttcagttgggaaaaggaatctggatattcatccaaagactaggtaccccagggaggcagctgtgaaagaggggaaggaactgagaggcccccctggtgccctggaacagcacaatctcctctaagctctccctccatccccagtgatattttgacctcagctaatgcaaacaatatgctttttgtacttgggggtgaatggatgaagtgcaagtgccaccagcaaagagggcagagagggaaagtcaacgcgtgcagatcatgcaggccaaggttggactttcacagtgcaaagtgtgcatgtgttcagagggttcttgatttcaacttcatcataaaatgagatttgtaggccaggcatggtggctcattcctgtaatcgcagcactttgggagggccaggcattcaaaaccagactgggcaacatagagagaccctgtctctacaaaaatatttaaaaattgtccaggtgtggtggctcacacctgtatttccagctactcaggaggctgaggctgaggcgggaggattgcttgagcctggggaaactgaggctacagtgagctatgatcttgtcagtacactccagcctgggagacagtgagaccctgtcaaaaaaaaaaaaatcccacagaatttgcattaaaagatgcagaaagagggagaagagaaggaaggaaagaagaaaggatagatggaaggaaatcaggcaatcatggattagtcgttcacagctgtgactcgttttttgggagcttcacgtgtcaagtggtttcttacgtttttgcttaaaacataatttttactatttacaaacataaaatatactcctttttggaaatttagaaaacacagataagcattcaggaaacaaaaaccacatgtacatccatggacatgtactaatttttacaacgtgacatcattttgcacagaatgggttgtaacctgcttttttaaaaaattcatcaatgtcatatccacttctccatgccattaaatgttctactacaacatcattttaatggcttaagagtatcattttatagatgtaccaaatttattaaaatttttggatatttaggttgttgctaatctttcgctatattatacaaatcactttgaacatccttgtgggtacatttttacatgcatcattgactatatccttaaaataaattgctacaagtggaatgcttgggtcaaagagtacacacaaattttagggttttgatatttaccgacaaatttcttcctagaaatgttatgccaatctgccagccctccaacccaaggagcatgtaaaagtgcccacctcactgcattctttgcaatattggggaggcatagttggtaagagcataaggtttggaatcagacacctctaccacttgctagccgtgtgtccttagacaagtcactttaaccattctgggtctcgattttctcatctgggttgctgtgaggatcacatgagatcatgtatgcagagtgctaagtaaagtgcctggcccatagtgagtactcaataaacaaaaactactatatatttacaaattgttcctgcccacctctgatgtgttattccctgggaatggccacagactgagcaaagacttctgaaatccctcttttataaccagtatctactccagcctccaaaccagccctgaagtgctgctgctgcctctgctgctgttatgggccccttggctcagtcctttctgcccctcccttctccagcactaggtgactgttggcagggagggttcttaggcctcatgcattaatgaccatcttgctttttctcacgttgattgtgctgagtgttgcaaaccagtaaagaaacccagagtggctttttaaactgaaatgatgaataataacaacagcaacagctaccacttattgagtgccaattgtgtaccaggcactgtgctaaaccttttacatggatggtctcattcaatctcataacagtctcagaggtgggaggggacttgctcagtgtcacatagctaggaagtggcagatctgggattggattccaagcctctctgacttcaaagtctgtgcttttaaccactttcatcctgctctcttcgatttagaaaggttcagtggggaagggtgtgtatgtgtgtgtgtgtgcatgtttgtgttagtgagtgtgtacatgtttgcaacggtgcatatgtatgtgtgtttgtgtgtaaataagtgtgtgcactcattagaataatactttttcagggccactatgtgctaggcactgtgcaagttcttggggatataatggtgaacaaaagagaaatgatctcagctctcgccaagcttactgaacgataaagaagaccaatagtgaatgaatgaatgtaagaattaagaaataaataaattacagtattactgccatgaaggaaataaacagggtgcagtcacagaaagtaacagggtcacaaactttagattggaagttgagggaaggcctttctgaaagggtgacatttaagtttgtatgttgaaaaactaatctggaataggaagtcagggcctccatgcaaggataaagtggagggaaggtactctggaatggcggcaaactcataagtgcctgaagatgttttctagagtgttctggggctcccaaaagtgtatatgggtggaaatgtgtggcgcctctgggtatgcatggaaagcagggggaatggcctgccagtttcaccgaaaaagggcagtgcgggaaatggagaccagctctctctggacaggttttgtctcaggaccaacagcatcaggaattctagagggatgaatgggactaagaggtagggtctagatgcccagggttgaagttagtggagtggaagccatttgtactcctgctgaaagaaaaatcctagcctgccccatgtatgcctgcatcagggtgtttcttacctgctctccactcattcatgtggtcaggggcttgagaaggcagcaaattctgccctggggctccctctctcacttctagaggtaactaatagggggcacttggatgaaaaaaatgtcaccaggatcacttttagtagcagcagcagccttgagccagtgcaggtttgtagtttaagaggtctttacccatccacagggtaggtgggagtggctgctggagcagttggcccaagaggcctgaaaaagagaggcccactcaaatccagggtctccactccatgggccactgacttccaagcctaatctggaatgatgtgtttccccaggccacccaaggcccgctgttggatcactgtgaatttggggttaggacaccctgtgcgtgcccataagctcccatccaaactgtgctctggggcacctggtgaccatataggactttgggctgtggcacaccaaaccacttcccttaacatttcagagaattctagaaaggaagcagttaagagaaatattcaaaacattctggggctctgctttccacatttcaagcattcagcccctaagtcatatgtatgagatctgtaaggcctgttcacatggaaactgcctagttgtcaggggctacgctttgtttctaatttgtgcttaggacatgcagtaccctcattcaatatgaaacacagactgtgattacaccaaattagcttaatcactctctttgtgcactgaattgcttctggcctggagatatcaattttcagaagtagcattcaccctcaccaaaacaaatcttaatatattgtcttgcctttggtttcataagaagggccaaccatcccccatcactcactgtgaatggtgtgagatgttggggagaatgtctttgccttgagggcttggacttctcttcctatcctttgtgtcacactgagtgacggcactccagtaacactgggcaggcctttcagaattttttatcttgtacacaatccagtcaaaccaaacattcaagagcgctaggagaggtttgtatgggaaagaggaccagtgtcccagacatcctctccagccggctaatcttcctttgtctccacacccaccctctctccattatcttggatagatgataggctccaggctttaagaactgtgtggaagaactctttccctcctcccttcttgcctgagtgggtgttgagaatggggaaaacattcatccttgtcctaagctatcctggacatttgagatctcagattcagcggctatcataggcacaataagaatagtgtctatgggaccaaaggacactccatccctcttaaccaatccacatgaacttcacaagaagaaactaagtcacctcttgaccctcagaattctgcttttgcaaaatggggtccaagcaactacttccctccccattacttatcgttccagctcacttcccttcttggctaatctgtttttgctaccttggttcagtctcttaacatccctgtgcctcatattactctggaaaatgtggttttagctcctagagttgtgtgagtgaccagcacaggtaagtgttaagccctttttaaagttctgtcgagtccccctatttggtgtatttaaaacaccagctgtaaaataaagctagatgatagcagcaaccaaacacaaatcaagcacatttacttccagaaaagcatccttaaggagctggttggatccgggagcaaaggtatctatacagagatgctcattgtaatgctgttagcataatagaaaaaaatggaaataaccaagcagtgcacaaatatgacatttgttaattactgccttaccatggactacttactgtacagcactttaaaaagctggtgtttggctctcccccttcccttcctttcccttcccttcctttctttttctttttttctttcttaccgagtctcactctgttgcccaggctggagtgaagtggagcaatctcggcctactgcaacatccgcctcctgggcacaagcaactctcctgccttagcatcccgagtagctgggactacaggtgtgcaccaacacacccagctaatttttgtatttttagtagagatgtggtttcacaatattggccaggctggtctcgaactcctggcttcaagtgatctgcccaactcggcctcccaagaagctgggattacaggcatgagccactgtgcctggcctattcatttctataggaggcttttcatgatattttaatgaagcaaaaatggcttgaataacaatatatgttgtgaaaacaatgcatacatgaatagaaaccaatcctagaaacagtacacctacggaggacaatggctgtttctggatattatcattaggatgattttattttagcttttctgtatttccttcaagttaaaaaaaatagagtatgtattaaaaaaaaaactacatccattttgaaaacaataaacacctaacatgtcttctaaatctttccttctcagatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacgtgagcctctcctaagtctcctccagcaagacagatgcctagcccgtcctcaggaatctgccgccagggagaatggcaaccctggccagatagctggaagcacagggttgctcttcaacctgcctcccggctcagttcactgtaaggaaatgcctacagatacttggaggggtgcctctgattggttgtggttgagagtgagttggcatgagatgaggtgccaagactaattgctgccactctggacatagggctgctgagggaagggatgttctgcttaaatgttccatacatcttcactaggcttcattgacattcacagtttaatagctaaagggttacatagatagccagccagatggacttggcccgaagtactcaccctagcctgtcaacttggccttaccttagaaaaatgatgggctgctgcgtaatatcgcagggtcctgtgtttacctcattgggagcaattaaataagccatttgcagaacagagctctgtgacgtacctacaggctcaaactgtagcctctaaacaggttggcaacttgcagtgatgtcaggctccaggcaaacaacaagggcaatctataccaaccatctgctccacacattaaaattcaaagcgactgtaggaggcagccccattgctgcttggagacctaacagtgcctgactgtccttggcttgctcctgcactctgggatcctcctgcttggtttcccttgggttcctgctccctgaccaccacccctcccctgaactaaaaacacccttaaggcttactcacctcttcattcactcattcacccagcaaatatttaatttgcgcctaccagatgcaaaatatccatcagaaaacaaggctcccttctttgtaaaaggacggggaagaattggcattaattatacttccaccaaaaaatcaacctactctgttgcaagatttgcctttaatatgaaacacttataaatatatattttatagtttcatggaaccaagtctgcatcctctgccattctgtactctggacgaattttcttttgcagcttccttgtccatacatagtgtggttctagtgttccatgcctgaaagaaattactagaagccatctttacactgaactaagcatatagtaaacaaaaggcctgttcagcatagcctacctaagtcaggcactgtgttctattctaatgtggaaaacaaatttcccattaaaataccactctgtcatttccagaatttgattaggaatgtacttaaggagtaaatcatagaagtgtcatgtttgggaaacctgtgaaatttcctacccctctactctttttcaaaagtcctttcctactggattcacagggaaaattaggccaactgtgcttgtatatatgcctgtgcatacacacagcaaagccctgtttcgacagtaggttagaacacagatggctgaaatcatcaccttccaaacttagcaactctttacagttcaagtccaattcagcaaatatttagtgagcatctactgtaagcaaggcacatcatggtgaaactaatgcaggcattgtcctattcctgaaatctcaagacacattcacaaacaaatggttatcaccaaggtcttcatgctctactcatgttgacatgagttgtattaattggtgactggaagtccaggatctgttgaggaagtcagtgacccttaatcaggaacactgccttggaaggtggtggacctttaaaacagaagcttctcagtttttgtagcatctgatatgagagaatatgctagatattcataaacttagggccaggcaatgtggggcccctggaatgctactgggcactctctaacctagtcctagaaatttcagttccaataatgttttcttcttcttttctagataagaaactatatgtatctcgtggatctgccagtaccagccttccaaatgaaagtaggtatctgggccagcctttgatggtgtgtgtctgtatcctgagaacgaacttgagaaataaggcttctgtctactactggagacactggtagtataaaacccagagtctccagtaatggacgggagccttatttctatcactcagtgttttcatagatagaatttgtttcattttagcctcaaaaaagagtatatgcacttcctatcttgtaaaattttattttgctatagaagaaactctccttagtttcttttttcttttctttctttcttttttttttaacctgagtttgacttaactgaagtagccaaggtgactcagaaaaattaagaaattcatgaggatgaggattagcttgctatgtcccagatgttcagttttcagcctagtattcttttatttatttctttttttttaacctgagctggacttaactgaaatagccaaggtgacccagaaaaattaagaaattcatgaggatgaggattagcttgctgtgtcccagatgttcagttttcagcctagtacatagggccaccccaggactctgcagtcagtgaaaatgtcaactgaggcatgaggccaggactctgagctccacactcaatttgaaagtggtgtcagtgggaacttacaaaagaggacaatctgggtggaatgacaggaggatcttcatgacctgggttcagggtcaattgccagctttattatttacttgcttcaggaacctggtcacatttcttaaccacttcatgccccagttgcttcatttttgtcaaataagcataaaatagtgcccacctcattgggtgaggtgtgaggagtaaatgaaataatgtataccaatgcttagaataatggctggcacattactctaagcgttggcatacattaaaccatcaagaattctttttggagggcatcctgtgttccccaagctgtgctctgtgtgctgtgtttaagagaggactcaagctgggtgtggtgcctcacacatgtaatcccagcactttgtgaggccaaggcgggaggaacacttgagcccaggagttagagactagcctgggcaacatagcaagaccctcatctccataaaaaataaaaatagagaggatccaaaggaagagccactaccacagcccctgatctcaggcatttgacagtctggtgtgaagtaggggtgagggcaatctatagaccccactagaatgtcaaccccatgaggactgagactttgagaggtataccactgtatccctagcaccttgcacagtggtatacaaatttgttgaataaatgaatgagtgaatgctggaaacaataaaagagcatttaacaaggaaacagtaagaaaatgtagtaatgtagtaaaaattattccaatgtagtaaaaattattctgtttgatgccttcgtgtgagagacaaacaaaacaaaaaccaaccctggtgattaattggccatgcctccatgaggagattcatttagagctggttcaaaagccttagcatagccaaggcaggcatcacataagtccctgcccaaggaaatgagttctgctggccttctaacttatgaaaggcaaggattgtggtgtttcctgagtacttgttaatagtttctacatttgtttattgtgagtctcagaattactgataacttgatgcttaaaattgttcatagactaaaactaacagcaacaacaacatgtattgggtgttgactatgagccacataccacatactccatcttgcttagtccccaccatgaccttgtgaggtgtatgtgaatatgtcctaggtgctttactcaaccgatattcagtaaatagtgattgaatgaatgaatatccccattttatagatgaagaaactggatctcaaaaaggtgaaaggacttgccttaaatcacacagcagcaagtggcagatgcagtattatctccttgctctcacagtgtcataaaattatcagaaacaattccaagttaaatcaagtatacaacagtgaaaattagtcactggtgagattattttaccacacatgagttcactgtctatctgggaccagggcactatcctaaaataaaggaagggggatgcagaaggctcagaaagcaagcaaaagagcaaagaaaaatatacctttgggaaagaaggtgggggatgttctttccttgcagagagtagttgaggaaaggtggctatgccaacaggcccaagtctgcctttctaacactgtggccctgggcagagggaggtaacatggagctgagaggaagagaagggacttcctagggctccaagtaaaaggacaatggaacccagcaaagcccatgctcttaagcatgacaccagtctcccaatcttgcctgatggtacgaaccacctggggagcttgttcactgcccagatcctgctcccccacttcctgggggagtagatttggcatgagactcagttgcctcttcatgttttattctttttttttttttttttttttgagatgaagttttgctcttgttgcccaggctggagtgcaatggcgcaatctcggctcactgcaacctccgcctcctgggttcaagtgattctcctgcctcagcctcccaagtagctgggattacaggcacccgccacaatgcctggctaattttttgtatttttagtagagatggggtttccccatgttgatcaggctggtcttgaactcctgacctcaggtgatcagcccgccttggcctcccaaagtgctgggattacaggcgtgagccactgctcctggcctcatgttttattctttatataatttatattaacctcatttaaaagtgaactacatgaacctttcagtggaaatttaggttgttctgaaagatttcctatgtgaggctccagaaaaatatttgtcaaggaagggaggcagagtctcctcctgcccctccgatatggccctagtcccctcatgtgggctgtcatgcatctatgaagcaggggcatgtggagcagaagagtcatcagagccaaaagggtagtcagagagaccttggagaaagacattctggaggttagtctcacaaatgttgttcaaaagttttagtgaatttgattttatcttttggtcggtagaaatagacatactggttatatattgcttcaatggctacaaataataataacagttgatattgctaattgccagatacaggactataatatacattggagatataacagtgaataaaattgtcttggtccctgccctcacagagttaatagtttcgtggggaagacatgcccacccccaaagggaaaatacaaaatatttgcaagttatgataagtggagtgaggaaaacacatgaggtgttgaaatagggaaaaatgggggccaactttagataaagtgttcaaaggaggcctttctgaggaagtgacatgtgatcagggacctgaatgaagtgagagagccagctctgggaagaattagggcagagatggagggaggtggaggaaattgtccctgcaaaagcccgagatgtgtgtgaagaatggaaaaaaaaaaaagaccagggtgacaggagtggagtaagaaaggagagagtgtggtacaagagaagtctggagaggtaggcaggggccaggtggtgcaggggccttatgggtcacattgggagttgagatttcatattctaagcgacattgtgagccatggaaggattttacgtgtgatccaacttgcatctgataagatcacaaaagctgttctgtagaggacacattggagaaagggaagaatgaaaacaaagaggcaagaagcatgagaggatgatagcctggattaggtggcaacagcagagacaggggtatttgagatctatgtaggagggttagctcttaggacttggtaatggattaaataggaatggcaaagaaatgggaagaatccaggttatctcctaggtttcatgtttcaacaaatggataggagaatataactgttttggccatgtcaattctgaggtgcctataagacatccaagtggatataccttttaaacagttgtatatgtaagtgaagaaagtctgggtaaacatttgggatgtatattagtcctgtacataagtggtatttaaggccattggatgtgatcacctagtcagaggacgtagacatagaagagaggagagctgcagaaagaggcctggagggtgtcaatatttagagactggggacatgaggaacaaacggaggagactgaaaaggtgtagccagtgtgataagagaagaaccagggcagtgtggtacataacagaagctaaaagaggtgaatgtttcaaaacagaaggagtgatcaactgtgttaaaggctgtggagagatcaaataagagaaggtcaaataagaagaaattcctattggatgtggcatcagagatttttgtagacgtgttaagagcagttttcattatgtgatgtggacaggagccagattgaagtgggctgaagagtgaaccagagatgagaaagtggagatagtaaattcgaggagcttcttagagaaatttaacattgaaatgataaagagaaaaaagatgttagctaaagagattaatggggtttgagaaggtctttttttaagaggcaaatattagagcctctttgcatgataatgggaatgatccaatataggaggatgaaggtaacttgaggggtgaagtcattgagaagacagaagggacatgtagaagcattgagctttcataagaacaggggctgttctgccattgaaagtatagaaaagaaagctaataaggacacagatgcaaattgattttcaggcttgcttgtgaggagactaaaaagtactaatctaatgatttctattttctcaatcaactgtggagcaagacagcaagagtgtgggatatttaaagagagtgagaaagtatgaagaagtcttcttgggcattgggaaagcaaagcctgatagtagacaaacataagtaggatttctgggtggtgatctgaagtctgagctcatgaatttcaagtgcgaactctcagttgggttgtgcaattttcatcagtgatgttagcttagtgtaatgtgcagagaaggcaaatggggacgcttatctaggggtgaggttgtggcaagtgagtatgaaggatagagaataaggaaaaggagtcaagggtgggcaagacccattgagaataggttgaggctgtgggtttcctacattttcaaagtttgaaaagaagctgaaaagtctcagtctggtcctgatgaatgacatactttcacttgaaaactttggtttctcaatcctaacaaagtgacccccaaatgcaattgttgagaaatctgataacttactcattagaaattgagtaaactgcccgtcacaagttgaataaattctgttgtggctgcaatagaatttactctgtatccagagcatttcttggatgcagtttcatgagtttctgtcttcccttcctctgaggttgaggactctggtatctgacatcccacaggtgttcatctggaccctggaggagacttacagccttccataggggcctaactggctttcattaaccatgtaacttctcctttagctctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgcta

SEQ ID NO: 3888 - DNA, 24654 bp, human
tagaggggcggaaagtaacaaggaggtgggggtacaaatcctcagctcctgcttccgcaagcactaacctgctctgaagtgagccaggcagctctggccatcttttcccagccacagaatcaggtgatggtccagaattaagaggtaagagaatctggggatttttttggggggagaagcaaagaaacttaactgggaagaaatgggggtagtcatcaaatactttgctcaatgagatacaatctggtccccttggggatttcgttccaagtgattggtttgacaaactaacccctctgacttcccaccctaccccagactgctaggtaccattttggagaagtgcggtaagtgcgtccatgcaggcagattgtggtagagttctggccaaaatgctggtttgggattctgtgctcaaatatttctttctttctttctttctttctttctttctttctttctttctttctttctttctttctttctttctttctttctttctttctttctttttctttctttcttctttctttctttcattttttgttctttcttttttttttttcagaagtgtgggcaatatttgagggagcactttctgtctttgtatcttgtgagatggggaagttgcaaactgcctgttgtttagtaattatgccgttctggcggtaccactggtaaaacttggccttggggttttgtctactacgagaggcttttgctataagccaggcactgatatggaaacatcttctctgggagacagccaccctttctttagcctcactgacatccccttctatccagctttgcagcatctctttctcctaggcgagacacaccccagcaattaattcatgaatgaagagacctcttatggagggctcatttgaggatgaagctcctcatgtttctccagaggtagagtgagatgcagttcttcataggactaagccaatgacagttctcagaattttaatattcctcaaatacagtttctctccactttggtccaagtgcagcccagggagttgcttgtgagccgatccagagaagtggcctatggctttccttttgattgtgtgcggtgtggttggggaggaaaagaagggcataggtggtacttattcagtgaatactgaatttattattcaggatgcccaattgcccacggactgagctctccaaggtgaagaggctgaaacaccacctctgactttctccatctctaatatttcctgactgtagccagttggcctggggcatctgtggattctacccaaggacactaggcacatgcttcagggccctaatgtcctcagggtcctaccagctccttcccttgtggcttcaaggggagttagcaaagagagattgcaagctgtgtcaagcctgaaccttgagcagtggccactggaaattctgagaatgagagggtgagtcctccaaagttgttcactggcccttccagcagcagacagaggcttcaaggagaagccctgagggagcagacagagttgggagttgctgcctgcgttatctgaaggaaaccagatggctggtttagggttctggcttgaggccccctagggattaggagatagatggagagactgaggcccatagaggagaagggactattagacccaatgggtagtcaataagggatggtaaaggtaggacagaagttaacgccagaaagacctaggttgaaatcccagctctgccactccccagttgtgtagcctaggcagtctatttcaccttctttaagacccaaattgctcatctgtaaaatggggataacaatacctaatttgaggattatgaagattggagaagatagctgtgtagtttctggcacacagtaggtgttctgtaaactgcagctttaaaaaagtactgcctccatgcttctcattgctttataattcataacaccttggtttttatttctgtcccttcaagtatcagaatagatcatgagctttttctctaaataaaggaataatttacctacagtgaaatgcataggtcttacgtgtaaaatttgatgagttttaacaaatttatccattcatgtagtaaccatctccctcatcaagatgtagaacctttccaacacccctgagggctccctcatgccctttcctagtcaatctctcaatctctaccctacaggcaaccacagttctgaatttcatcaccgcagattatttgtgcttgtttcatgtatgtgaaattgtacaatatgtggcctttagtgtctggattctttcactcaacatgtttttgagattcatacatgctgttgtgtagattggtagtttgtttgtttgttcttttgctgagtaacattccattgtataaatatgtcacagctaatttatttattctcctggtgataaacatgtgggtactttccatttttggttactatgaagaaagctgctgtgaacattcaagtacatgtctttgtgtggacatagtttttatttctcttggctatgtgtacctagaagtgagattgctgggtcacaagataagaatatgtttaactttataagaaattaccagtttttcaaagcatttgttcacatgtttttggaaagtaagggtgcaatggattcgtttttgagctagtacctggttacgcttagcatgactgtcaaccagaggaaacattggttacttaacacctacattatgctaggtgctaggaataaagaaatgaatatgaaatgctgttctcaaggatctcataaactagagagaaagatagtctattaaactctagtcattttcattaaattgacaagaatgaataggtcaaacccatctttagccagagcacatggcaagtcagattcggtgatcaaaggtaaagaagcatcctgacaggctacttccctagtaaaggaaggccacagcatgtcttgagggcccacggtgtgccaggacctggtctgaatgcaaatagccagcctctgcccacaaggaactctcaaggtgggatatgatgataccaatgatggaacccaagtttagggcagttcaatacacagctattgagcatctactctattccaggcactgttctagatacaaaagatgtgctggggaacagagctgacaatcttacaatctttcaggaggtttccaccaatggtgacaacattggtataaaaatgtttttttgtacatctgcattttgttcagaatatatctgttggagtccttagagatggtgttgtttgtaattgctagtttctaagatgggatgcgggtaggtgtaggacacagtcttacatagattaaggcgtcaggggagtaggagaatttgatgtgtttactcctctgcgtgcgagtggtcaagatggaaagcaatgcctactattgaaattgtcaagcaccgactggattgcctggtcaagctctccatgggagcccatggtagttctgggccaaccttggctcattcgtttaggagaaaggcacttccccaggaggcaagttactctgctatttggcctcaatgtcctcccacctccccatttcctgatgctctctctagtcaggttgcctgatcattctcatttgtaagagaaggccccttctcagcacttcatggagatttgtcatgttgtcccttgaagactgattagacaaggcttctcaacagcatcgtcattgacctttaggagctatgtggctccctggggccccagtgagcacgtgtacctggtgggagcaaattgcttgcccccaaggacactgctcacccaaaccacagccaagccacttggtaaatagtgccagtgacattttgcctttggtccacagctgtcacctgtgtcattcactcacaatggaagaaatgaagaagactgccatccggctgcccaaaggcaaacagaagcctataaagacggaatggaattcccggtgtgtccttttcacctacttccaaggggacatcagcagcgtagtggatgaacacttctccagagctctgagcaatatcaagagcccccaggaattgaccccctcgagtcagagtgaaggtgtgatgctgaaaaacggtgagcatgtggggagggagggagctgggattccctatcaaggctgccacggatacaccagttctttgatgtacttgacacacttggacacttatatgtttgctaaaggcaagttgctctgactagtgagaagccacaccccttcttagaagtttaatgtcaaaatggggctgccatctactgctccaaccttacctccccagcactgtcctccagaaactggcttccttctgtccgtcatgttcgctttgatttcttcctggcctttgcacaaactgttccttgtctgcaaatctcttccctcccttctcctaattaacccacattcatcccaagatcacttctttagggcagctttccctgaccacccacacccccaagcattcaaatatcctattacagattctcctaccgttctttaactctccttcacagcccttgtcacagttgcagtttttacacttgtataattatttgactattgcatactcctccattaaatgaaagttctgtgagggcaaggaccattgctgattttgcttaatattgtatttctagcatctagaaacagtgactgtgacataggggacaaccaacaaggatttgttgaatgagtaaatgaacatacaaatatgcaaatttgtgagcactgtatctaggtacaaagaaccttgaaatttccataaaagactaaaacataaattagaatcttgctgaataagccattagagcagaagtatgttatgatagtttttaaatgttgataatatttacattttatataatttatttccataaatggaaagttcccagttgtagagaggtggttttgaaaagttttaaaatcaaagctggctgggtgtgatggttcacacctgtaattccagcactttgagaggccaaggcaagaggatcacttgaggtcaggagtttgagaccaacctggccaacatagtgagaccctgtgtctacaaaaaaatttaaagaaattattcaggtgtggtggctcatacctatatctctggctactaaggagggtgatgcagaaggatcacttgagcctgggaggttgaggctgcagtgggccatgattgcaccactgtactccagcctgagtggcaaagcaagaccctgtctcaaaagaaaaaaaaaaagtaaagctactggaaaaagaaaaaaagaagtttaatgtaaaaatgggtgctgtttaatcaaatcagttcacctattttattatttcctcaatcatgttaaatgctgggtttactgctcagcacacaatgaaactccacaactatttactgtaatcattatcagtatttttcttcatcttctgttttttagagacagggtctcactctgttgctcaggctggaatgtggtggcgcgatcataactcactgcagccacgaattcctgggctcatgaaattttcccgccttagcctcgcaagtagctagaattacaggtatgcgccaccacacccagctaatttaatttttttttttttttgtagagacaggatctcgctatgttgcccaggcaggtcttagattcctgacctcgagcgatcctcccacttcagccttccaaagtgctggtattacaggtgtgaaccaccacacccagctagtattattatcactattattattactataggcctgatggggcaggaacaccaaagcatctatgaaaagaaaacgcatgtcccatgtaggtgctcccagcctcttctcaactaatagtgcatggtttggtgagcaagggtaggggccagagggaagtagatgaatagtcttgccacatccctttcccacccttcacagggccaggtgtgtctatttgctaattgttaagaaataaacagtcgtacatctcaaaacagttacttcaagataactaagtcaaaatgtgcacatcaaaatatccaggtttgaaggaagccttaaacatcacactagcaggggctgtagtatgactttcacggaccctggacacttttgtcttcatggacctccttcctccacaaaaacattaaaagttacattttatgactgcattggtataaagatgaatataatccaagctgagttcatgttttaaatatattcagtatcactgtcatattcattttttcttctgattttaaaacatttttgtgggcccctaaaactattaatgggtcctaggcactgtgcctcctgtgcctaatggagaagtcaccctcgccagctggatgtcactcaatatggctccctttacctttttggaaagtgagcaaatatatcagggtctggtggatttcaagagctctttattggtgttggtgagtgcacatgttgaacgacttgctcccactggaagacgtacgtacctccaagtaggggcttttgtgtaaagtggacaagtggggcctctgcctccaggcaaagagctcccctgtttccagatgccatcattctggctttgctttttgggactggagagggagttgatgtgtatctgatgtattcacctttgcagaatttacttctctcttagaatttacttttgcagtcaatcaatgtggttttctcagagaatcttgtgggttaaataaatatgtggaagggcatggggtagcagcagatactaaaggaaatgatgtagagcttgctgttaaaatgggcaggagggggtgggtggggagtggggaggtgatgtctaagagtgtgctgaataatcacaacagaagcaggaatgaccatggtcttgaatcatttgggggattgacatgtggtaagagctgagaaatgtggtgtgtgggattcagaagatctaactgactccttggaagtgtcaaaatctcgggcagttaatacacagacaagtatactgacttcggctatttgactctgatttatttctgaacacattggcttggattcattataatcattcccttgtaagcatcatcaagccatggtctcactttttctattctacttgcctggtaaaacccaagctgggataaaaccaactcttggcctattgccccatttctctgcttcattttgcagcaaaactcaaaattggtatttatgtgtactctgtcctttcctctcatgctctctaaactccattccactcatgctttcaacctcatcactccttgaaatcgctcttatcaaggttacccagtgacctccactttccaaatccaatggtccctatctgtcctcatctgatttgacctatcataacatttgctgcagaagattgctctctcctcgtgaaatacctacttcgcttgcagtcagcccataacattatgctttcttggttttcctcctgcctccctggttactatttcttctcagtctcctttgctatatgtccttctctctccaacttctaaacatttcagggccccagtactcaggtcccagacaactcctttctctgtctacacttactgtcttggtcttaaatgccatctatatgttgagcaattccaaatgcatatctgcaaaccagaatggatttcagacgtgcctgtctaactgcctacttgatcttcacttaacatgcctaataggaaactcaaacaaaatagctcccaaactgaataaactcttaatttccccctcaacctgctctgcccacagtctttcccatctcaataaatgggagctgcacccttccaattccttgaagtcatgcttaacacctctctgtctcacaccccacatccaatccttttggaaattgtgtaggttctatcttcaaaatatccaagatctgaccgcatcttctcacctccgttgtcacctgggtcctagaagctatcatcaccccccgctgaattgctgcagtcacctcctaattggtctcattgcttcttcccttcctctccttcagtctattcttaggagggcagtcagaatggtagcattaaaatgaaagtcacacactagcactcttttgtttgaaaccctctgacagcttcccatgtcacttggaatcatatccaaagtctataatggggccctacctcatctgggcccccgttgtcttactgatctcatatcttaccactttctgcctcacccgctccagtctaggctccttggtattcataaactatgccaaggacaatcctgcctcaggcctgccctttgcacatggtctctcctatccctggaatgctctttccccagatacctgcatggcgtcacctttctccattcaagtctccacctggatgtcaccacttcaaacagtccttgtctgagcaacctatttaaaaaatgaaagcccccaccctctcacgtctgtcttcttaccctgcttcatttttcttcttagcatttgtcaccaccgggcacattatatgttgtagttctttctagactcctctctccccttaccctctgagctccgtggcagtagggactcaatctgttaactgctgctttctaagtacctaccacaatgcctgacacatggaggcactcaatacatacggcttgaacgaatgaaattatgattttgatcacaaggtgttgaccctacagatgggggtcaccgtagagagggagtacggtgtggtgtacagctttagaaccactcagcatggggccaagccagctccatcacttactaacagtgtgatctccagacatatcacttctcctctctgtgcctcagtttcctcatctctaaaatggaataatattgaattataggactgtgcttgtgaggagtcaatgagataatgcatgtcaagtggcacatagtaagtgcaatgtagtccaagcttgagttgagtttttgaacagctaagatagatgtgaggacctgtgttcacaacaccaggttcacagagcagcaggcatctcccataagcctccaggttttcagggggttctgtttcatggctgccatagagtttcctgtgccttctgatttcacctcgaccttctgtgaaacccctgcctgctgagggaagttgggcatggccctgttccttgcccaagccagccttcacaggccagatagagaggtggcttggttctccatcttccttcttggttgttgcattttccctataagaaccccacaaatcctttgactgtgaagatgttgtctccctcacagagtgtggtgcgggctaggcaaatatttgtccgctgattgagcaaatgaaggaaaaactgcctccctcaaagcctctcttatcaccactaggagtcaagtttctcataagctctgctgcctcaggggagggccccatgaaaggcttccagtcccacagaggttctcactggaggtgttatatgacatacatatggctttgaaaatggtgggaaatctttcaagtggcctttcattactgactgttagtatcctctcaaaccctacagaccagcaccaggccgtccagcccagctaggccattccaaggagaacaggctcccattcatgggctcccatggccgactcgcccacattctaagggctctctgttgagccaaatatgcaagtcccaaacacagagacccgtgtggctaggaaatgccgtcaaatttcctggcttctcttccccaatcagtgttgtgtttttatttacttatgtataatttatactggctgtacttcagaaaagaaaatacaagttgaaggtatctttgaattatctcccttttaaaaggacattgggaattttagaatcagtaactagagaagcttcagtaactatagtttgtagggggcatggtcctggtacgtatgccaccctgtgttcttcttgtcctgtccccagccccagtcctgaggccggcctcaggcctggcaacattgctctagggctgctgagagaaggtgagagggtatatacgtgggcctttagaggtctcaaaggatccagcctccttctctctcccctcccatctgccataatcagtaagggtagggaagaaatgctggctttttttaaaaaaaaaaagtgtaaatatctatgtgagatatagtcatgctagttgtttatggcccttgtaaatactgacagtttcctgtcttcttttcccgtaaggaagaggaatctatctgcacaaacatatatggagcttccagcgaataccagacaccacactaaaattagtgcattttacttcagtccacgaaatccactgtgatttataaagttcaaagacaggcaaatctaacctatggtgtcagaagacaggatatggttacgttttgggggtgttgtgactgagaggggtacggtgtgcttctggggtggtgatcaggttctgttactcgagctgggtgctcattacccagtttatgaaaattcccccagctgcacacttccatttgtgcgtttttctgcatgttggttgtgcttcacaaaactattttgcaatggatattattatccttattttacagagcaggaaactgcagcccagagaaggtaagtgcctagagatgggtcacacagccagtgagtgataaagattgaaacccaagtccatcgatctccagagccagtctcttgaataccccattgtcttgcctttgtacactctgacaatgccccagcaagaggatttaatacctataaggactatcgctaataatgtgtataatggctaacactttttgaacactttctgtgtgccaggccctttgctagggtctgtcacgtggattatctcactgaatcttcacaccaactctactggttaactctatgtccattttcctgatgaggaaactgaggctcagacagtcaagtgacttgcccaagatctctcagctaatatggggagtctatagtatttgccggcagatggaattgatttcggatcttagccactcagcatttcgaatactagctcatattctgtgtttgatctctgttttcagttgggaaaaggaatctggatattcatccaaagactaggtaccccagggaggcagctgtgaaagaggggaaggaactgagaggcccccctggtgccctggaacagcacaatctcctctaagctctccctccatccccagtgatattttgacctcagctaatgcaaacaatatgctttttgtacttgggggtgaatggatgaagtgcaagtgccaccagcaaagagggcagagagggaaagtcaacgcgtgcagatcatgcaggccaaggttggactttcacagtgcaaagtgtgcatgtgttcagagggttcttgatttcaacttcatcataaaatgagatttgtaggccaggcatggtggctcattcctgtaatcgcagcactttgggagggccaggcattcaaaaccagactgggcaacatagagagaccctgtctctacaaaaatatttaaaaattgtccaggtgtggtggctcacacctgtatttccagctactcaggaggctgaggctgaggcgggaggattgcttgagcctggggaaactgaggctacagtgagctatgatcttgtcagtacactccagcctgggagacagtgagaccctgtcaaaaaaaaaaaaatcccacagaatttgcattaaaagatgcagaaagagggagaagagaaggaaggaaagaagaaaggatagatggaaggaaatcaggcaatcatggattagtcgttcacagctgtgactcgttttttgggagcttcacgtgtcaagtggtttcttacgtttttgcttaaaacataatttttactatttacaaacataaaatatactcctttttggaaatttagaaaacacagataagcattcaggaaacaaaaaccacatgtacatccatggacatgtactaatttttacaacgtgacatcattttgcacagaatgggttgtaacctgcttttttaaaaaattcatcaatgtcatatccacttctccatgccattaaatgttctactacaacatcattttaatggcttaagagtatcattttatagatgtaccaaatttattaaaatttttggatatttaggttgttgctaatctttcgctatattatacaaatcactttgaacatccttgtgggtacatttttacatgcatcattgactatatccttaaaataaattgctacaagtggaatgcttgggtcaaagagtacacacaaattttagggttttgatatttaccgacaaatttcttcctagaaatgttatgccaatctgccagccctccaacccaaggagcatgtaaaagtgcccacctcactgcattctttgcaatattggggaggcatagttggtaagagcataaggtttggaatcagacacctctaccacttgctagccgtgtgtccttagacaagtcactttaaccattctgggtctcgattttctcatctgggttgctgtgaggatcacatgagatcatgtatgcagagtgctaagtaaagtgcctggcccatagtgagtactcaataaacaaaaactactatatatttacaaattgttcctgcccacctctgatgtgttattccctgggaatggccacagactgagcaaagacttctgaaatccctcttttataaccagtatctactccagcctccaaaccagccctgaagtgctgctgctgcctctgctgctgttatgggccccttggctcagtcctttctgcccctcccttctccagcactaggtgactgttggcagggagggttcttaggcctcatgcattaatgaccatcttgctttttctcacgttgattgtgctgagtgttgcaaaccagtaaagaaacccagagtggctttttaaactgaaatgatgaataataacaacagcaacagctaccacttattgagtgccaattgtgtaccaggcactgtgctaaaccttttacatggatggtctcattcaatctcataacagtctcagaggtgggaggggacttgctcagtgtcacatagctaggaagtggcagatctgggattggattccaagcctctctgacttcaaagtctgtgcttttaaccactttcatcctgctctcttcgatttagaaaggttcagtggggaagggtgtgtatgtgtgtgtgtgtgcatgtttgtgttagtgagtgtgtacatgtttgcaacggtgcatatgtatgtgtgtttgtgtgtaaataagtgtgtgcactcattagaataatactttttcagggccactatgtgctaggcactgtgcaagttcttggggatataatggtgaacaaaagagaaatgatctcagctctcgccaagcttactgaacgataaagaagaccaatagtgaatgaatgaatgtaagaattaagaaataaataaattacagtattactgccatgaaggaaataaacagggtgcagtcacagaaagtaacagggtcacaaactttagattggaagttgagggaaggcctttctgaaagggtgacatttaagtttgtatgttgaaaaactaatctggaataggaagtcagggcctccatgcaaggataaagtggagggaaggtactctggaatggcggcaaactcataagtgcctgaagatgttttctagagtgttctggggctcccaaaagtgtatatgggtggaaatgtgtggcgcctctgggtatgcatggaaagcagggggaatggcctgccagtttcaccgaaaaagggcagtgcgggaaatggagaccagctctctctggacaggttttgtctcaggaccaacagcatcaggaattctagagggatgaatgggactaagaggtagggtctagatgcccagggttgaagttagtggagtggaagccatttgtactcctgctgaaagaaaaatcctagcctgccccatgtatgcctgcatcagggtgtttcttacctgctctccactcattcatgtggtcaggggcttgagaaggcagcaaattctgccctggggctccctctctcacttctagaggtaactaatagggggcacttggatgaaaaaaatgtcaccaggatcacttttagtagcagcagcagccttgagccagtgcaggtttgtagtttaagaggtctttacccatccacagggtaggtgggagtggctgctggagcagttggcccaagaggcctgaaaaagagaggcccactcaaatccagggtctccactccatgggccactgacttccaagcctaatctggaatgatgtgtttccccaggccacccaaggcccgctgttggatcactgtgaatttggggttaggacaccctgtgcgtgcccataagctcccatccaaactgtgctctggggcacctggtgaccatataggactttgggctgtggcacaccaaaccacttcccttaacatttcagagaattctagaaaggaagcagttaagagaaatattcaaaacattctggggctctgctttccacatttcaagcattcagcccctaagtcatatgtatgagatctgtaaggcctgttcacatggaaactgcctagttgtcaggggctacgctttgtttctaatttgtgcttaggacatgcagtaccctcattcaatatgaaacacagactgtgattacaccaaattagcttaatcactctctttgtgcactgaattgcttctggcctggagatatcaattttcagaagtagcattcaccctcaccaaaacaaatcttaatatattgtcttgcctttggtttcataagaagggccaaccatcccccatcactcactgtgaatggtgtgagatgttggggagaatgtctttgccttgagggcttggacttctcttcctatcctttgtgtcacactgagtgacggcactccagtaacactgggcaggcctttcagaattttttatcttgtacacaatccagtcaaaccaaacattcaagagcgctaggagaggtttgtatgggaaagaggaccagtgtcccagacatcctctccagccggctaatcttcctttgtctccacacccaccctctctccattatcttggatagatgataggctccaggctttaagaactgtgtggaagaactctttccctcctcccttcttgcctgagtgggtgttgagaatggggaaaacattcatccttgtcctaagctatcctggacatttgagatctcagattcagcggctatcataggcacaataagaatagtgtctatgggaccaaaggacactccatccctcttaaccaatccacatgaacttcacaagaagaaactaagtcacctcttgaccctcagaattctgcttttgcaaaatggggtccaagcaactacttccctccccattacttatcgttccagctcacttcccttcttggctaatctgtttttgctaccttggttcagtctcttaacatccctgtgcctcatattactctggaaaatgtggttttagctcctagagttgtgtgagtgaccagcacaggtaagtgttaagccctttttaaagttctgtcgagtccccctatttggtgtatttaaaacaccagctgtaaaataaagctagatgatagcagcaaccaaacacaaatcaagcacatttacttccagaaaagcatccttaaggagctggttggatccgggagcaaaggtatctatacagagatgctcattgtaatgctgttagcataatagaaaaaaatggaaataaccaagcagtgcacaaatatgacatttgttaattactgccttaccatggactacttactgtacagcactttaaaaagctggtgtttggctctcccccttcccttcctttcccttcccttcctttctttttctttttttctttcttaccgagtctcactctgttgcccaggctggagtgaagtggagcaatctcggcctactgcaacatccgcctcctgggcacaagcaactctcctgccttagcatcccgagtagctgggactacaggtgtgcaccaacacacccagctaatttttgtatttttagtagagatgtggtttcacaatattggccaggctggtctcgaactcctggcttcaagtgatctgcccaactcggcctcccaagaagctgggattacaggcatgagccactgtgcctggcctattcatttctataggaggcttttcatgatattttaatgaagcaaaaatggcttgaataacaatatatgttgtgaaaacaatgcatacatgaatagaaaccaatcctagaaacagtacacctacggaggacaatggctgtttctggatattatcattaggatgattttattttagcttttctgtatttccttcaagttaaaaaaaatagagtatgtattaaaaaaaaaactacatccattttgaaaacaataaacacctaacatgtcttctaaatctttccttctcagatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacgtgagcctctcctaagtctcctccagcaagacagatgcctagcccgtcctcaggaatctgccgccagggagaatggcaaccctggccagatagctggaagcacagggttgctcttcaacctgcctcccggctcagttcactgtaaggaaatgcctacagatacttggaggggtgcctctgattggttgtggttgagagtgagttggcatgagatgaggtgccaagactaattgctgccactctggacatagggctgctgagggaagggatgttctgcttaaatgttccatacatcttcactaggcttcattgacattcacagtttaatagctaaagggttacatagatagccagccagatggacttggcccgaagtactcaccctagcctgtcaacttggccttaccttagaaaaatgatgggctgctgcgtaatatcgcagggtcctgtgtttacctcattgggagcaattaaataagccatttgcagaacagagctctgtgacgtacctacaggctcaaactgtagcctctaaacaggttggcaacttgcagtgatgtcaggctccaggcaaacaacaagggcaatctataccaaccatctgctccacacattaaaattcaaagcgactgtaggaggcagccccattgctgcttggagacctaacagtgcctgactgtccttggcttgctcctgcactctgggatcctcctgcttggtttcccttgggttcctgctccctgaccaccacccctcccctgaactaaaaacacccttaaggcttactcacctcttcattcactcattcacccagcaaatatttaatttgcgcctaccagatgcaaaatatccatcagaaaacaaggctcccttctttgtaaaaggacggggaagaattggcattaattatacttccaccaaaaaatcaacctactctgttgcaagatttgcctttaatatgaaacacttataaatatatattttatagtttcatggaaccaagtctgcatcctctgccattctgtactctggacgaattttcttttgcagcttccttgtccatacatagtgtggttctagtgttccatgcctgaaagaaattactagaagccatctttacactgaactaagcatatagtaaacaaaaggcctgttcagcatagcctacctaagtcaggcactgtgttctattctaatgtggaaaacaaatttcccattaaaataccactctgtcatttccagaatttgattaggaatgtacttaaggagtaaatcatagaagtgtcatgtttgggaaacctgtgaaatttcctacccctctactctttttcaaaagtcctttcctactggattcacagggaaaattaggccaactgtgcttgtatatatgcctgtgcatacacacagcaaagccctgtttcgacagtaggttagaacacagatggctgaaatcatcaccttccaaacttagcaactctttacagttcaagtccaattcagcaaatatttagtgagcatctactgtaagcaaggcacatcatggtgaaactaatgcaggcattgtcctattcctgaaatctcaagacacattcacaaacaaatggttatcaccaaggtcttcatgctctactcatgttgacatgagttgtattaattggtgactggaagtccaggatctgttgaggaagtcagtgacccttaatcaggaacactgccttggaaggtggtggacctttaaaacagaagcttctcagtttttgtagcatctgatatgagagaatatgctagatattcataaacttagggccaggcaatgtggggcccctggaatgctactgggcactctctaacctagtcctagaaatttcagttccaataatgttttcttcttcttttctagataagaaactatatgtatctcgtggatctgccagtaccagccttccaaatgaaagtaggtatctgggccagcctttgatggtgtgtgtctgtatcctgagaacgaacttgagaaataaggcttctgtctactactggagacactggtagtataaaacccagagtctccagtaatggacgggagccttatttctatcactcagtgttttcatagatagaatttgtttcattttagcctcaaaaaagagtatatgcacttcctatcttgtaaaattttattttgctatagaagaaactctccttagtttcttttttcttttctttctttcttttttttttaacctgagtttgacttaactgaagtagccaaggtgactcagaaaaattaagaaattcatgaggatgaggattagcttgctatgtcccagatgttcagttttcagcctagtattcttttatttatttctttttttttaacctgagctggacttaactgaaatagccaaggtgacccagaaaaattaagaaattcatgaggatgaggattagcttgctgtgtcccagatgttcagttttcagcctagtacatagggccaccccaggactctgcagtcagtgaaaatgtcaactgaggcatgaggccaggactctgagctccacactcaatttgaaagtggtgtcagtgggaacttacaaaagaggacaatctgggtggaatgacaggaggatcttcatgacctgggttcagggtcaattgccagctttattatttacttgcttcaggaacctggtcacatttcttaaccacttcatgccccagttgcttcatttttgtcaaataagcataaaatagtgcccacctcattgggtgaggtgtgaggagtaaatgaaataatgtataccaatgcttagaataatggctggcacattactctaagcgttggcatacattaaaccatcaagaattctttttggagggcatcctgtgttccccaagctgtgctctgtgtgctgtgtttaagagaggactcaagctgggtgtggtgcctcacacatgtaatcccagcactttgtgaggccaaggcgggaggaacacttgagcccaggagttagagactagcctgggcaacatagcaagaccctcatctccataaaaaataaaaatagagaggatccaaaggaagagccactaccacagcccctgatctcaggcatttgacagtctggtgtgaagtaggggtgagggcaatctatagaccccactagaatgtcaaccccatgaggactgagactttgagaggtataccactgtatccctagcaccttgcacagtggtatacaaatttgttgaataaatgaatgagtgaatgctggaaacaataaaagagcatttaacaaggaaacagtaagaaaatgtagtaatgtagtaaaaattattccaatgtagtaaaaattattctgtttgatgccttcgtgtgagagacaaacaaaacaaaaaccaaccctggtgattaattggccatgcctccatgaggagattcatttagagctggttcaaaagccttagcatagccaaggcaggcatcacataagtccctgcccaaggaaatgagttctgctggccttctaacttatgaaaggcaaggattgtggtgtttcctgagtacttgttaatagtttctacatttgtttattgtgagtctcagaattactgataacttgatgcttaaaattgttcatagactaaaactaacagcaacaacaacatgtattgggtgttgactatgagccacataccacatactccatcttgcttagtccccaccatgaccttgtgaggtgtatgtgaatatgtcctaggtgctttactcaaccgatattcagtaaatagtgattgaatgaatgaatatccccattttatagatgaagaaactggatctcaaaaaggtgaaaggacttgccttaaatcacacagcagcaagtggcagatgcagtattatctccttgctctcacagtgtcataaaattatcagaaacaattccaagttaaatcaagtatacaacagtgaaaattagtcactggtgagattattttaccacacatgagttcactgtctatctgggaccagggcactatcctaaaataaaggaagggggatgcagaaggctcagaaagcaagcaaaagagcaaagaaaaatatacctttgggaaagaaggtgggggatgttctttccttgcagagagtagttgaggaaaggtggctatgccaacaggcccaagtctgcctttctaacactgtggccctgggcagagggaggtaacatggagctgagaggaagagaagggacttcctagggctccaagtaaaaggacaatggaacccagcaaagcccatgctcttaagcatgacaccagtctcccaatcttgcctgatggtacgaaccacctggggagcttgttcactgcccagatcctgctcccccacttcctgggggagtagatttggcatgagactcagttgcctcttcatgttttattctttttttttttttttttttttgagatgaagttttgctcttgttgcccaggctggagtgcaatggcgcaatctcggctcactgcaacctccgcctcctgggttcaagtgattctcctgcctcagcctcccaagtagctgggattacaggcacccgccacaatgcctggctaattttttgtatttttagtagagatggggtttccccatgttgatcaggctggtcttgaactcctgacctcaggtgatcagcccgccttggcctcccaaagtgctgggattacaggcgtgagccactgctcctggcctcatgttttattctttatataatttatattaacctcatttaaaagtgaactacatgaacctttcagtggaaatttaggttgttctgaaagatttcctatgtgaggctccagaaaaatatttgtcaaggaagggaggcagagtctcctcctgcccctccgatatggccctagtcccctcatgtgggctgtcatgcatctatgaagcaggggcatgtggagcagaagagtcatcagagccaaaagggtagtcagagagaccttggagaaagacattctggaggttagtctcacaaatgttgttcaaaagttttagtgaatttgattttatcttttggtcggtagaaatagacatactggttatatattgcttcaatggctacaaataataataacagttgatattgctaattgccagatacaggactataatatacattggagatataacagtgaataaaattgtcttggtccctgccctcacagagttaatagtttcgtggggaagacatgcccacccccaaagggaaaatacaaaatatttgcaagttatgataagtggagtgaggaaaacacatgaggtgttgaaatagggaaaaatgggggccaactttagataaagtgttcaaaggaggcctttctgaggaagtgacatgtgatcagggacctgaatgaagtgagagagccagctctgggaagaattagggcagagatggagggaggtggaggaaattgtccctgcaaaagcccgagatgtgtgtgaagaatggaaaaaaaaaaaagaccagggtgacaggagtggagtaagaaaggagagagtgtggtacaagagaagtctggagaggtaggcaggggccaggtggtgcaggggccttatgggtcacattgggagttgagatttcatattctaagcgacattgtgagccatggaaggattttacgtgtgatccaacttgcatctgataagatcacaaaagctgttctgtagaggacacattggagaaagggaagaatgaaaacaaagaggcaagaagcatgagaggatgatagcctggattaggtggcaacagcagagacaggggtatttgagatctatgtaggagggttagctcttaggacttggtaatggattaaataggaatggcaaagaaatgggaagaatccaggttatctcctaggtttcatgtttcaacaaatggataggagaatataactgttttggccatgtcaattctgaggtgcctataagacatccaagtggatataccttttaaacagttgtatatgtaagtgaagaaagtctgggtaaacatttgggatgtatattagtcctgtacataagtggtatttaaggccattggatgtgatcacctagtcagaggacgtagacatagaagagaggagagctgcagaaagaggcctggagggtgtcaatatttagagactggggacatgaggaacaaacggaggagactgaaaaggtgtagccagtgtgataagagaagaaccagggcagtgtggtacataacagaagctaaaagaggtgaatgtttcaaaacagaaggagtgatcaactgtgttaaaggctgtggagagatcaaataagagaaggtcaaataagaagaaattcctattggatgtggcatcagagatttttgtagacgtgttaagagcagttttcattatgtgatgtggacaggagccagattgaagtgggctgaagagtgaaccagagatgagaaagtggagatagtaaattcgaggagcttcttagagaaatttaacattgaaatgataaagagaaaaaagatgttagctaaagagattaatggggtttgagaaggtctttttttaagaggcaaatattagagcctctttgcatgataatgggaatgatccaatataggaggatgaaggtaacttgaggggtgaagtcattgagaagacagaagggacatgtagaagcattgagctttcataagaacaggggctgttctgccattgaaagtatagaaaagaaagctaataaggacacagatgcaaattgattttcaggcttgcttgtgaggagactaaaaagtactaatctaatgatttctattttctcaatcaactgtggagcaagacagcaagagtgtgggatatttaaagagagtgagaaagtatgaagaagtcttcttgggcattgggaaagcaaagcctgatagtagacaaacataagtaggatttctgggtggtgatctgaagtctgagctcatgaatttcaagtgcgaactctcagttgggttgtgcaattttcatcagtgatgttagcttagtgtaatgtgcagagaaggcaaatggggacgcttatctaggggtgaggttgtggcaagtgagtatgaaggatagagaataaggaaaaggagtcaagggtgggcaagacccattgagaataggttgaggctgtgggtttcctacattttcaaagtttgaaaagaagctgaaaagtctcagtctggtcctgatgaatgacatactttcacttgaaaactttggtttctcaatcctaacaaagtgacccccaaatgcaattgttgagaaatctgataacttactcattagaaattgagtaaactgcccgtcacaagttgaataaattctgttgtggctgcaatagaatttactctgtatccagagcatttcttggatgcagtttcatgagtttctgtcttcccttcctctgaggttgaggactctggtatctgacatcccacaggtgttcatctggaccctggaggagacttacagccttccataggggcctaactggctttcattaaccatgtaacttctcctttagctctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgct

SEQ ID NO: 3889 - DNA, 6365 bp, human
aatctcaagacacattcacaaacaaatggttatcaccaaggtcttcatgctctactcatgttgacatgagttgtattaattggtgactggaagtccaggatctgttgaggaagtcagtgacccttaatcaggaacactgccttggaaggtggtggacctttaaaacagaagcttctcagtttttgtagcatctgatatgagagaatatgctagatattcataaacttagggccaggcaatgtggggcccctggaatgctactgggcactctctaacctagtcctagaaatttcagttccaataatgttttcttcttcttttctagataagaaactatatgtatctcgtggatctgccagtaccagccttccaaatgaaagtaggtatctgggccagcctttgatggtgtgtgtctgtatcctgagaacgaacttgagaaataaggcttctgtctactactggagacactggtagtataaaacccagagtctccagtaatggacgggagccttatttctatcactcagtgttttcatagatagaatttgtttcattttagcctcaaaaaagagtatatgcacttcctatcttgtaaaattttattttgctatagaagaaactctccttagtttcttttttcttttctttctttcttttttttttaacctgagtttgacttaactgaagtagccaaggtgactcagaaaaattaagaaattcatgaggatgaggattagcttgctatgtcccagatgttcagttttcagcctagtattcttttatttatttctttttttttaacctgagctggacttaactgaaatagccaaggtgacccagaaaaattaagaaattcatgaggatgaggattagcttgctgtgtcccagatgttcagttttcagcctagtacatagggccaccccaggactctgcagtcagtgaaaatgtcaactgaggcatgaggccaggactctgagctccacactcaatttgaaagtggtgtcagtgggaacttacaaaagaggacaatctgggtggaatgacaggaggatcttcatgacctgggttcagggtcaattgccagctttattatttacttgcttcaggaacctggtcacatttcttaaccacttcatgccccagttgcttcatttttgtcaaataagcataaaatagtgcccacctcattgggtgaggtgtgaggagtaaatgaaataatgtataccaatgcttagaataatggctggcacattactctaagcgttggcatacattaaaccatcaagaattctttttggagggcatcctgtgttccccaagctgtgctctgtgtgctgtgtttaagagaggactcaagctgggtgtggtgcctcacacatgtaatcccagcactttgtgaggccaaggcgggaggaacacttgagcccaggagttagagactagcctgggcaacatagcaagaccctcatctccataaaaaataaaaatagagaggatccaaaggaagagccactaccacagcccctgatctcaggcatttgacagtctggtgtgaagtaggggtgagggcaatctatagaccccactagaatgtcaaccccatgaggactgagactttgagaggtataccactgtatccctagcaccttgcacagtggtatacaaatttgttgaataaatgaatgagtgaatgctggaaacaataaaagagcatttaacaaggaaacagtaagaaaatgtagtaatgtagtaaaaattattccaatgtagtaaaaattattctgtttgatgccttcgtgtgagagacaaacaaaacaaaaaccaaccctggtgattaattggccatgcctccatgaggagattcatttagagctggttcaaaagccttagcatagccaaggcaggcatcacataagtccctgcccaaggaaatgagttctgctggccttctaacttatgaaaggcaaggattgtggtgtttcctgagtacttgttaatagtttctacatttgtttattgtgagtctcagaattactgataacttgatgcttaaaattgttcatagactaaaactaacagcaacaacaacatgtattgggtgttgactatgagccacataccacatactccatcttgcttagtccccaccatgaccttgtgaggtgtatgtgaatatgtcctaggtgctttactcaaccgatattcagtaaatagtgattgaatgaatgaatatccccattttatagatgaagaaactggatctcaaaaaggtgaaaggacttgccttaaatcacacagcagcaagtggcagatgcagtattatctccttgctctcacagtgtcataaaattatcagaaacaattccaagttaaatcaagtatacaacagtgaaaattagtcactggtgagattattttaccacacatgagttcactgtctatctgggaccagggcactatcctaaaataaaggaagggggatgcagaaggctcagaaagcaagcaaaagagcaaagaaaaatatacctttgggaaagaaggtgggggatgttctttccttgcagagagtagttgaggaaaggtggctatgccaacaggcccaagtctgcctttctaacactgtggccctgggcagagggaggtaacatggagctgagaggaagagaagggacttcctagggctccaagtaaaaggacaatggaacccagcaaagcccatgctcttaagcatgacaccagtctcccaatcttgcctgatggtacgaaccacctggggagcttgttcactgcccagatcctgctcccccacttcctgggggagtagatttggcatgagactcagttgcctcttcatgttttattctttttttttttttttttttttgagatgaagttttgctcttgttgcccaggctggagtgcaatggcgcaatctcggctcactgcaacctccgcctcctgggttcaagtgattctcctgcctcagcctcccaagtagctgggattacaggcacccgccacaatgcctggctaattttttgtatttttagtagagatggggtttccccatgttgatcaggctggtcttgaactcctgacctcaggtgatcagcccgccttggcctcccaaagtgctgggattacaggcgtgagccactgctcctggcctcatgttttattctttatataatttatattaacctcatttaaaagtgaactacatgaacctttcagtggaaatttaggttgttctgaaagatttcctatgtgaggctccagaaaaatatttgtcaaggaagggaggcagagtctcctcctgcccctccgatatggccctagtcccctcatgtgggctgtcatgcatctatgaagcaggggcatgtggagcagaagagtcatcagagccaaaagggtagtcagagagaccttggagaaagacattctggaggttagtctcacaaatgttgttcaaaagttttagtgaatttgattttatcttttggtcggtagaaatagacatactggttatatattgcttcaatggctacaaataataataacagttgatattgctaattgccagatacaggactataatatacattggagatataacagtgaataaaattgtcttggtccctgccctcacagagttaatagtttcgtggggaagacatgcccacccccaaagggaaaatacaaaatatttgcaagttatgataagtggagtgaggaaaacacatgaggtgttgaaatagggaaaaatgggggccaactttagataaagtgttcaaaggaggcctttctgaggaagtgacatgtgatcagggacctgaatgaagtgagagagccagctctgggaagaattagggcagagatggagggaggtggaggaaattgtccctgcaaaagcccgagatgtgtgtgaagaatggaaaaaaaaaaaagaccagggtgacaggagtggagtaagaaaggagagagtgtggtacaagagaagtctggagaggtaggcaggggccaggtggtgcaggggccttatgggtcacattgggagttgagatttcatattctaagcgacattgtgagccatggaaggattttacgtgtgatccaacttgcatctgataagatcacaaaagctgttctgtagaggacacattggagaaagggaagaatgaaaacaaagaggcaagaagcatgagaggatgatagcctggattaggtggcaacagcagagacaggggtatttgagatctatgtaggagggttagctcttaggacttggtaatggattaaataggaatggcaaagaaatgggaagaatccaggttatctcctaggtttcatgtttcaacaaatggataggagaatataactgttttggccatgtcaattctgaggtgcctataagacatccaagtggatataccttttaaacagttgtatatgtaagtgaagaaagtctgggtaaacatttgggatgtatattagtcctgtacataagtggtatttaaggccattggatgtgatcacctagtcagaggacgtagacatagaagagaggagagctgcagaaagaggcctggagggtgtcaatatttagagactggggacatgaggaacaaacggaggagactgaaaaggtgtagccagtgtgataagagaagaaccagggcagtgtggtacataacagaagctaaaagaggtgaatgtttcaaaacagaaggagtgatcaactgtgttaaaggctgtggagagatcaaataagagaaggtcaaataagaagaaattcctattggatgtggcatcagagatttttgtagacgtgttaagagcagttttcattatgtgatgtggacaggagccagattgaagtgggctgaagagtgaaccagagatgagaaagtggagatagtaaattcgaggagcttcttagagaaatttaacattgaaatgataaagagaaaaaagatgttagctaaagagattaatggggtttgagaaggtctttttttaagaggcaaatattagagcctctttgcatgataatgggaatgatccaatataggaggatgaaggtaacttgaggggtgaagtcattgagaagacagaagggacatgtagaagcattgagctttcataagaacaggggctgttctgccattgaaagtatagaaaagaaagctaataaggacacagatgcaaattgattttcaggcttgcttgtgaggagactaaaaagtactaatctaatgatttctattttctcaatcaactgtggagcaagacagcaagagtgtgggatatttaaagagagtgagaaagtatgaagaagtcttcttgggcattgggaaagcaaagcctgatagtagacaaacataagtaggatttctgggtggtgatctgaagtctgagctcatgaatttcaagtgcgaactctcagttgggttgtgcaattttcatcagtgatgttagcttagtgtaatgtgcagagaaggcaaatggggacgcttatctaggggtgaggttgtggcaagtgagtatgaaggatagagaataaggaaaaggagtcaagggtgggcaagacccattgagaataggttgaggctgtgggtttcctacattttcaaagtttgaaaagaagctgaaaagtctcagtctggtcctgatgaatgacatactttcacttgaaaactttggtttctcaatcctaacaaagtgacccccaaatgcaattgttgagaaatctgataacttactcattagaaattgagtaaactgcccgtcacaagttgaataaattctgttgtggctgcaatagaatttactctgtatccagagcatttcttggatgcagtttcatgagtttctgtcttcccttcctctgaggttgaggactctggtatctgacatcccacaggtgttcatctggaccctggaggagacttacagccttccataggggcctaactggctttcattaaccatgtaacttctcctttagctctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgcta

SEQ ID NO: 3890 - DNA, 20368 bp, human; identical to SEQ ID NO: 3885

SEQ ID NO: 3891 - DNA, 24655 bp, human; identical to SEQ ID NO: 3886

SEQ ID NO: 3892 - DNA, 20612 bp, human; identical to SEQ ID NO: 3887

SEQ ID NO: 3893 - DNA, 24654 bp, human; identical to SEQ ID NO: 3888

SEQ ID NO: 3894 - DNA, 12163 bp, human
ccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaaggtaagatgaaccacaagcctttattaactaaatttggggtccttactaattcataggttggttctacccaaatgatggatgatggtagaaaccaaatagaagaatggtcttgtggcataatgtttgttgcctagtcaatgaagtctcatattcttgtctctggttaggatcttgggatctggagtcagactgcctgggttcaaatcttggctctgcccataccatctctgttatcctggggcaagtgcctcagtttccacatctgagaaatggggatggtattggtgtccatttcatagattaagtgagtttagccttgtaaaaagcttaggagggggtctgatacatagtaagcactatgtacgcactagctataattatttgctaaagttctgctttaaaagtaagctatttttttatggagacagcttttttcttttaaatttccagctaggcaagaagagcgtcaatttgatctaaaatttcataatgcttcagattaacatagacatggataagtcccagaatttgcagtcttttagtaaaagtagcattttctgtgtaattcttcacaagcactgattgtagttgcaggatgctcagtctccctctgagatgttttacatttttaaatggttagacttgcaggaacaaaagagcagagtaacttagtaggctgttttgcattcttaggaaaagaaaaccatcaggacttattttgttttcatgtattttttcacttccactgaggagtataattggctggtgttgacaaaataccaatcatagatgtaaaggagaaagttgattagttttctggctgttcctaaaattctggatgcaggaactgtggctagaaagcatctggatgattgcactttatcagggatacttgagtgtcctctcttaggatctggacctagaattaatgtcatgagatttttctaacaggataaggtgaggtagtgagggctgaagtcatccactgggttatccaaatattaggtttcactgctgacaaaagagggggcttctggtctggttggttatttgtgtttggcctgatgtgctctgtcaatcaaatgtatggacataggcctagcttctaaaggggcaatagtgacctcagtggactgatatttaccgtactatttacatgtgctcttaattacagcagaagctgccagctaactgaatcttgttttgaatctaaaaaatctactcttaaagcaagaaaatggtataaaattagttgataatgcaagtgaattctgtacatttaattattctaagacattggaaaataaaatatcttgttactttgaggataaaagatgatttctttaaaaatgcaaatgttttctacaaatactaaagttaaaagggagagagatgtaattagaactcgttaactgacacattgcaaattaacttctttttataaagcactgcatcacaaacactaaaatgaagtgggcaaattagctctgcagaaaactattttctaggctgatgtttataatgaccaatcattactgaagcaatgagaaatgtgacaattacagaatattgctgctatagtatgttgaaaaaatatgcattttgtagtgaacatttagtagaatagctctgatttctacctggagtttctgataacatgacatcttaattgctgtcttttatagatttttaaactgcaaatacaaaatagcaatcagccaatataataacttattattctccatttatgcctgaaagtcctcctcttgttgatgccgtggaaatgaatgtagaggcagatatcattagctgtattctccttccgaatgacatttatcatatccttgttattccaaaatagatagaagatgaaaggaatcttcatgaagattttgtattcatgaaaacgatacagagatgcaacacaggagaaagatccttatccttactgaactgtgaggagattaaaagccagtttgaaggctttgtgaaggtaagcagcttaattactggtaaaagtgtcattgaaatattttactacatttgctagatcgggaaactgacaatgccaatgtttaaagattggttatagacacagacacacagacacacacacacatatatatgcatgcagatatacacacatacatgggtgtgtgtgtgggggttaaaaaaaaaaaacacaaagacactctctggggaaaatacacccttaggggcacagtcacacatatttgtcagcttacatatgcagctaccactaggcaaaatgatgaagtccaccaagcttggtttttgcattgctgtgtctccccatccaaaccttgatgctctcgcactggggacccagagtctgatccccatttcccagggaagcaatagccgtcaacagctgccgtggcagcaggccacaagtgaagggacacctgaagactggtaacagtctctggtgcttctctgatgatggaattttaggtgtcctgacagtgagatctttcccttttactggggagagaggtgcagggaataagtaatagacattctcagtgtcgctcaaaccagactccatataatatcacttgctcatgaagcccgcccactctatggccggtcatgaccagaggcacagagggttcaaagccttttagcccaccaggctggtagctagcatgaagtcactgcagtgactgtggcttataacagatacctaaaacaagaatttttagaacctttacattaattccatcatcacagacatagggtctaggggctctttctcctgaggcagaacatcaagagttctttctgcctatgtccctttcagaacactgagtcaaatacccttgggcctcggctcacttaggggtcatttctaggaggcagcactccacattgaggacagttctgggccaggtgggtgggtatctgggtaaaccaacaggaattagttctcacatatagatgatgtgtaatttaatgcaggcgtaaaagggttaagatcttatttctgatcttatttctgccctcctgtactgtcaccgaggtgccatttaattcattagtgaagactctaacagcttattcctgagtcacctacggagaacagaatgtggctcaaatccgctgcttgctttcaggttctttacactaatctaggctttagatgaaactcctaaaccctttctttgcaagactggccagctaggaaaatgatttgagtttcttcggttcttcgaggatttgggccagtattacagagtattggaagatgttaccagtttaaatgtgaataaaggcactttcaaaacaatggctaataatccaaataacagactgaatgtgcttggctatgtgactttgggtaaataacttcacctttctgggcctcagttttgtcatctataacatgagaagacagattatctgtaagggcactatcagctctgacattctacaattatgtgataagccttcagttccctccaatggcagtgagagtggcttgtcagtccccctcgtttcttacggagacttttacggttgaattgtcaattcctcacgtcattatttcaggttggctatgtatgtaaagctcccaaaatcagctaccgaggataggagtaaagaaaacagtcagtttggcctccctgcttatgcttgtatgaaaaaagtgacagctccaaagtttcatattcttaaaaggcagatcttctcaggcatgtcagccagggccccagggatctcctccttacatgcaactaaggaggctccttgtctctactgcagcaggtgtggaaccctagtcaacaccacctatacctaggattacgtacaatgagtagatacaaagtcctccagctacccaatcctcccccaatgacggatcccctttccaatacgctttcccccaaatttctcaccctaaaacaaaattcgagactttgaaaaaactcaataggacaattatagaatagctccagattagattcatattttcttagctaatgttagtaggctttctttccgggccacagtctggctgcacctaagcaacctcaagtttgaatttggagtctttgaatcaggtcttgatggggtcttagaagtcatcagatccaattctcaatccacaacttcagtcttctctccacctcctgactaagtggtcatccaatctctgtttgaacatctctagtgacaaggaactcattatctctggaggcaggtagcactaatctgtcattttgggggaaagatggtattcagggctcaagtgagggtaagcagaggtattattttgaatagtataatttcatattaaaacttacaacccaccacacctctgctagatgttcagttccatgattatttgcccaccaatgcctgcgatgcctttgagagagccaaagcatttctatttcaagttaaagggcaacctgtccatacctgccacatggaactcccactaagagagaaataacccattctggattttctgaaagtccactttaaaaagtatttcagttgaggtggggagtgaagcaagaaaaaaaaaaggctctggggagtgtggttgggcgaaagttcacggaaaggctaggctgggctcatgaaacacgagctttgctgacttcatgttttcatcttggccaggcctcaacaccaatgcaacaacttagcctaaaagtatctcaaccttgatcaccacactctactttttgaaaagacactaaatagtcatttgtttacttgtgatctcacaaacattttcctgtcaccacatcttcatagtgccgcgcttcagctcaaatggaaagttgaagctctggggcccatgtgagtgttctgaggctcaggttcccctggaggctctatgaactacgcccttaaatctggcaactgagctgggcctacagccagcactcaacagtgacagcacaaattccttctggaggaggaaataaaaggaagggtcctatagacaactgattccaggagtgggaaggagcacaggactttgattatcataagatgtgaaaatactactgtcttcttcccttgtgtgcagaggatagacagatggaattagctaagcccagcctatgaatgccatctcacagtttccactcttggtttaaacctcagcttctttgggtgacctcataatgaccagttaagccctccaggccttttgttcagtctctttaaaatggcagcaacagcctttatcatcttccaacctgtgttgatggaagttcctgttagcttctttaaatacctctagacttccttcagtttataagtgaaaagaaaccttttaagaagtgtcgcacttgcctttgaacatcaacaccattgggagatggcctgtgtttccgaaatgctgattattctaagtaaatacagtgcaactatcaataagagaatctcttcagcccattgaaagggatagcaaaattaaaaatgtctgagggtcttttcatagtctggcatttctccccaaggtcaaacttactattatcttttcctacaggatttcagaccaaatttattctaatagatacacaccatgctttatgtttaataatattccatataccagttcccagggtagaatcatctccccattcggcattatttgtcaatatctgtcaaagccaaggaggttgaggtcataggaagggtcaggatcacagcctctggtctggagagagcactggaatggagataataaggcctggattttacttccagattctcccctgggctttctgggttgttggctcatctgtcagatccatggactcccaattggcatgatggaattaatgacaggatctgagtctatatgataatcctcaccagaaacagacaacagagtaatgacagatgcaaaacgaatgataattttaaaaccccacagcagagcccctgtcaaaatgacctcttgcaatgcttcttattttaggatataatgttaaacaaagaggagacgaagaaagaaaacagctttgaaatgcaaaaaggtaggtttgctatttgctaatttctatgaatgcctaaaaactaaaaggaagctttaggctgatcatattgaacaacccagtgttgttgcatcagggaacttttagccctggaaataaaacaggaacacaattgtcaaattgacaccttctctggtccctgtgatttggaaagactttgtacatatatatttatgaaaaaaggatgtgttcctttaatgccgatgataccaaatctgaagaaatcccattatgttcaataccttaatagaagcaaccatacagcctgataccacctacagtggaataagaagacaggaaagtcatcatttggtaacagtggcattcatcactcattgataacagtttttcatggggcacagtggccggtggagcctctgggatcaaggagtgacaatgtcacagtgttctattatttgcccggttcttaaagtgagagcatcctgaacatctcagggttggaagagaacttgagagttctcaaatccagcaccatccccacaacaaaaatctccttcacaataacactgaccgtccagcctctgatcaaacatgtcgagggatgaggcaccttccacctcataaggcagcctgatccgtctttgaatggctctaataataccaagattactatactactccagagaagtctttcctcctcaagtcaaactttgttcctataatctccactcattggtcccagttctgctctttgaggccctagtaaacaaagtataattgctctcctacccagcagctgtccagatatggaagacagcaatcatggtggccaagccttgactgagctttttcttctccaggctaaagatccctgatgtcttccactgtttctcctatgaccctttccaggacctttcttctgccactcacctccttttcttggacacactaacgttttcctgttcttttagaatgtggcatcgcaaaccaatacaataatgcgtgaagtgacttcagcagcagattatgggaaagacggggtgttgttagagagaattttatatcacaaagttggtgaacatgatgttatggcttctgcaaatttaatacacacaaaaacatacatacatacagggatagagatactattttctgaggcaaagagagtactcagaccttgccttaactgttgttctggatactaaatggtcatccgacttccatgaaggttttatcttcagaatgactgcaagatatgttgagtaatagtaccacgctgtctgttaattacagagaaatctgaggaaacagtttatgtagatgctgcctagaagtcttcagggaaatgataatattaaccaaactggtcatttaggtcatgcaatttaactcaacatttatagggcacttacaaagtgcccaatatcaggctcataactggacaaaaagaaacttccacacagtctctgcccttagaagattgacacatctcattagggagcagggctttaacacaagaaataattaaagacagatacaatagttcagccagttgcttgaccaattcagaaaccataagaatcttactaagtgtgcagactttggagcccactaaaatccccagtgtatggagttgttcctaaaagcaagattcacggtatgtttaatgaagaccagtgtttttagcctgtgtcaatctatgcaaaatggaatcgagtattgatcaactgttaggagaatgagaccgatggaaacagccaattcaattactcagatattagaaaccaacttttccttcagtgggagagatgtcagaccattttatctttccttttatataatctatttttgcacagtctctattacacagttgtagaactggaccagatagttttgtgggcagtttttgcattattttagcctgacagtttttggttccatttcaggtgatcagaatcctcaaattgcggcacatgtcataagtgaggccagcagtaaaacaacatctggtaagtcacacagcatctgagcggtagccacccaaggggaaaggctgggatgccgaagtcatgttacctaatggttaaactcctcttttcccctgggacccaatttacaaacctacccctacacttctcctattcccttctttgtcttcaaagtgagttcaaatgcacagatgggacttagagggacaaaaggaggtggaatgcaatctggatgttctcattatgttcttgctcaatggctgattctaaatgatgaattactgggtggagggaccattgttctgacaacatagaagaaatggcatgtagtgacctcctgactgggagcatccctcctcctaacccatcttcactgtgtggaaatgggcctcatggggtatttcctgccatctgtcaatccctgtatgattaagctcagcctcactgaggccaacctcagggaaagtaaaggtaaaatcattctgtaaagatcaataggtcccaagacgttacattttccaatgaagtaacaacagacgacatattgtgatcttttcaactctgaacgattttatttccatatacgttctgccaccattctagcctttagatattttttcccaaatgtgcatcttgcgataactggtgccaaagaatatgtcgtatctgataaatggatggaaacatgcacgctaacataaagtctcccatcaacataaaggcaagagcgtcagaggagtctttgaaaaattctacagagtgctccggaatggagttctaagcagtgcatgtgtgtgtgcatatgtgtatgtgtgtgacagggagagaaagagagatggacagagagagaaaaaagacactgcttcatctctgaagtggcttgggcttctcagtaggcgtaacacatggacagttatcattatcatggatcatggtaccaaagtaagagcactgaatagggagtttttgaacactgggattcaaggaccatgaccactgcttgctgggtgaccttgagcaagaccctttacctatgcagcagttttctacttcacctactttacagggtggctttgagcatcaaatcagctaatgtggccgaaagtgatgctgtcgagtgctgtacaaccgtaaggtgacactacttagtttacttcaccatggcttagatgtcaaaagggtgacataaagcccctcactaataccagttagttacacaatatttaataattttgtcaagtaccccttctctcttctggatcagatgacaacaacagagaaatctcctagaagaatagcttcccactggtctttttttgcctgtatctaaacccttgatcttggatatatttcatagagctcagattctcccaaaaggcttgtaatggatatcagtcctacaatatcttacagtctgcatcacaataggtttccaggggatcagatgggaagacagtaacattccacccccaccccagtcccaaacctcttcttcctacctagccatgctgctaaaatcttgccctacatcccacagcaagtactaaaattaggtaaggacgtaccaaagtaaacttactgaactaaaagattgagaacctgccctttttttctcaataaaatggttcaaaagggcaaacattctaatgaagcattgtttctggagtggtctggagggcccggatctgtcaggcatttcaggatgcctccctattagtaaagggcgagtcttaccaggtgggatcttgtgccctgatagacctaagactatcgaataggaattattttttaaaaagctcaaggaagcaaacacatcagtactttcacttttcctcaaccctcacccccatcagtcagtctagctttctgtgggagctgagatttcaagtcgggtgcacacactactttgaacccactcaacatctcagccgagaaaatggcacactgttggtgggtactctggcttagccacaagaatactggtactttcaagttggtggcgcccactacaatgggagatcaaaacataccgtgaaatgagcacacagtttattttcatacttccttgcctaattttagtccttgctgggggaggcagatcaggtttgcaacagcatgatcaggtaggaagaaatggggtcttttctctgtgctgaggctgagctaggtagactgacaactctctgactttgtaaaattcaaggcaagcaaggtattcatggtaatattagcaaaaatttggtccgagtaatttggtatgtataatttatgatgtcaaattttgaaatcatttgtgccttcttaagttcaaggcaaattggctataagaactctaacgagagaaagaaactcactgtgatctcttactttatttaatcttcacaagtctctgaaatatgctccaatatgagccccgtgttgcagatgaggaactgaagctcatggagatttagagacttgcccaagcttaaatagagcctagattggaacatggctctgtctgactctgaagcccatggaaggggccttgagaatccatccctatacaaagccaatatccaacattaaactatattttttgtcagaatgtgaaccatgctctgcttcacctcaccacaaactttccctttctttgtaacagtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 3895 - DNA, 12197 bp, human
atgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaaggtaagatgaaccacaagcctttattaactaaatttggggtccttactaattcataggttggttctacccaaatgatggatgatggtagaaaccaaatagaagaatggtcttgtggcataatgtttgttgcctagtcaatgaagtctcatattcttgtctctggttaggatcttgggatctggagtcagactgcctgggttcaaatcttggctctgcccataccatctctgttatcctggggcaagtgcctcagtttccacatctgagaaatggggatggtattggtgtccatttcatagattaagtgagtttagccttgtaaaaagcttaggagggggtctgatacatagtaagcactatgtacgcactagctataattatttgctaaagttctgctttaaaagtaagctatttttttatggagacagcttttttcttttaaatttccagctaggcaagaagagcgtcaatttgatctaaaatttcataatgcttcagattaacatagacatggataagtcccagaatttgcagtcttttagtaaaagtagcattttctgtgtaattcttcacaagcactgattgtagttgcaggatgctcagtctccctctgagatgttttacatttttaaatggttagacttgcaggaacaaaagagcagagtaacttagtaggctgttttgcattcttaggaaaagaaaaccatcaggacttattttgttttcatgtattttttcacttccactgaggagtataattggctggtgttgacaaaataccaatcatagatgtaaaggagaaagttgattagttttctggctgttcctaaaattctggatgcaggaactgtggctagaaagcatctggatgattgcactttatcagggatacttgagtgtcctctcttaggatctggacctagaattaatgtcatgagatttttctaacaggataaggtgaggtagtgagggctgaagtcatccactgggttatccaaatattaggtttcactgctgacaaaagagggggcttctggtctggttggttatttgtgtttggcctgatgtgctctgtcaatcaaatgtatggacataggcctagcttctaaaggggcaatagtgacctcagtggactgatatttaccgtactatttacatgtgctcttaattacagcagaagctgccagctaactgaatcttgttttgaatctaaaaaatctactcttaaagcaagaaaatggtataaaattagttgataatgcaagtgaattctgtacatttaattattctaagacattggaaaataaaatatcttgttactttgaggataaaagatgatttctttaaaaatgcaaatgttttctacaaatactaaagttaaaagggagagagatgtaattagaactcgttaactgacacattgcaaattaacttctttttataaagcactgcatcacaaacactaaaatgaagtgggcaaattagctctgcagaaaactattttctaggctgatgtttataatgaccaatcattactgaagcaatgagaaatgtgacaattacagaatattgctgctatagtatgttgaaaaaatatgcattttgtagtgaacatttagtagaatagctctgatttctacctggagtttctgataacatgacatcttaattgctgtcttttatagatttttaaactgcaaatacaaaatagcaatcagccaatataataacttattattctccatttatgcctgaaagtcctcctcttgttgatgccgtggaaatgaatgtagaggcagatatcattagctgtattctccttccgaatgacatttatcatatccttgttattccaaaatagatagaagatgaaaggaatcttcatgaagattttgtattcatgaaaacgatacagagatgcaacacaggagaaagatccttatccttactgaactgtgaggagattaaaagccagtttgaaggctttgtgaaggtaagcagcttaattactggtaaaagtgtcattgaaatattttactacatttgctagatcgggaaactgacaatgccaatgtttaaagattggttatagacacagacacacagacacacacacacatatatatgcatgcagatatacacacatacatgggtgtgtgtgtgggggttaaaaaaaaaaaacacaaagacactctctggggaaaatacacccttaggggcacagtcacacatatttgtcagcttacatatgcagctaccactaggcaaaatgatgaagtccaccaagcttggtttttgcattgctgtgtctccccatccaaaccttgatgctctcgcactggggacccagagtctgatccccatttcccagggaagcaatagccgtcaacagctgccgtggcagcaggccacaagtgaagggacacctgaagactggtaacagtctctggtgcttctctgatgatggaattttaggtgtcctgacagtgagatctttcccttttactggggagagaggtgcagggaataagtaatagacattctcagtgtcgctcaaaccagactccatataatatcacttgctcatgaagcccgcccactctatggccggtcatgaccagaggcacagagggttcaaagccttttagcccaccaggctggtagctagcatgaagtcactgcagtgactgtggcttataacagatacctaaaacaagaatttttagaacctttacattaattccatcatcacagacatagggtctaggggctctttctcctgaggcagaacatcaagagttctttctgcctatgtccctttcagaacactgagtcaaatacccttgggcctcggctcacttaggggtcatttctaggaggcagcactccacattgaggacagttctgggccaggtgggtgggtatctgggtaaaccaacaggaattagttctcacatatagatgatgtgtaatttaatgcaggcgtaaaagggttaagatcttatttctgatcttatttctgccctcctgtactgtcaccgaggtgccatttaattcattagtgaagactctaacagcttattcctgagtcacctacggagaacagaatgtggctcaaatccgctgcttgctttcaggttctttacactaatctaggctttagatgaaactcctaaaccctttctttgcaagactggccagctaggaaaatgatttgagtttcttcggttcttcgaggatttgggccagtattacagagtattggaagatgttaccagtttaaatgtgaataaaggcactttcaaaacaatggctaataatccaaataacagactgaatgtgcttggctatgtgactttgggtaaataacttcacctttctgggcctcagttttgtcatctataacatgagaagacagattatctgtaagggcactatcagctctgacattctacaattatgtgataagccttcagttccctccaatggcagtgagagtggcttgtcagtccccctcgtttcttacggagacttttacggttgaattgtcaattcctcacgtcattatttcaggttggctatgtatgtaaagctcccaaaatcagctaccgaggataggagtaaagaaaacagtcagtttggcctccctgcttatgcttgtatgaaaaaagtgacagctccaaagtttcatattcttaaaaggcagatcttctcaggcatgtcagccagggccccagggatctcctccttacatgcaactaaggaggctccttgtctctactgcagcaggtgtggaaccctagtcaacaccacctatacctaggattacgtacaatgagtagatacaaagtcctccagctacccaatcctcccccaatgacggatcccctttccaatacgctttcccccaaatttctcaccctaaaacaaaattcgagactttgaaaaaactcaataggacaattatagaatagctccagattagattcatattttcttagctaatgttagtaggctttctttccgggccacagtctggctgcacctaagcaacctcaagtttgaatttggagtctttgaatcaggtcttgatggggtcttagaagtcatcagatccaattctcaatccacaacttcagtcttctctccacctcctgactaagtggtcatccaatctctgtttgaacatctctagtgacaaggaactcattatctctggaggcaggtagcactaatctgtcattttgggggaaagatggtattcagggctcaagtgagggtaagcagaggtattattttgaatagtataatttcatattaaaacttacaacccaccacacctctgctagatgttcagttccatgattatttgcccaccaatgcctgcgatgcctttgagagagccaaagcatttctatttcaagttaaagggcaacctgtccatacctgccacatggaactcccactaagagagaaataacccattctggattttctgaaagtccactttaaaaagtatttcagttgaggtggggagtgaagcaagaaaaaaaaaaggctctggggagtgtggttgggcgaaagttcacggaaaggctaggctgggctcatgaaacacgagctttgctgacttcatgttttcatcttggccaggcctcaacaccaatgcaacaacttagcctaaaagtatctcaaccttgatcaccacactctactttttgaaaagacactaaatagtcatttgtttacttgtgatctcacaaacattttcctgtcaccacatcttcatagtgccgcgcttcagctcaaatggaaagttgaagctctggggcccatgtgagtgttctgaggctcaggttcccctggaggctctatgaactacgcccttaaatctggcaactgagctgggcctacagccagcactcaacagtgacagcacaaattccttctggaggaggaaataaaaggaagggtcctatagacaactgattccaggagtgggaaggagcacaggactttgattatcataagatgtgaaaatactactgtcttcttcccttgtgtgcagaggatagacagatggaattagctaagcccagcctatgaatgccatctcacagtttccactcttggtttaaacctcagcttctttgggtgacctcataatgaccagttaagccctccaggccttttgttcagtctctttaaaatggcagcaacagcctttatcatcttccaacctgtgttgatggaagttcctgttagcttctttaaatacctctagacttccttcagtttataagtgaaaagaaaccttttaagaagtgtcgcacttgcctttgaacatcaacaccattgggagatggcctgtgtttccgaaatgctgattattctaagtaaatacagtgcaactatcaataagagaatctcttcagcccattgaaagggatagcaaaattaaaaatgtctgagggtcttttcatagtctggcatttctccccaaggtcaaacttactattatcttttcctacaggatttcagaccaaatttattctaatagatacacaccatgctttatgtttaataatattccatataccagttcccagggtagaatcatctccccattcggcattatttgtcaatatctgtcaaagccaaggaggttgaggtcataggaagggtcaggatcacagcctctggtctggagagagcactggaatggagataataaggcctggattttacttccagattctcccctgggctttctgggttgttggctcatctgtcagatccatggactcccaattggcatgatggaattaatgacaggatctgagtctatatgataatcctcaccagaaacagacaacagagtaatgacagatgcaaaacgaatgataattttaaaaccccacagcagagcccctgtcaaaatgacctcttgcaatgcttcttattttaggatataatgttaaacaaagaggagacgaagaaagaaaacagctttgaaatgcaaaaaggtaggtttgctatttgctaatttctatgaatgcctaaaaactaaaaggaagctttaggctgatcatattgaacaacccagtgttgttgcatcagggaacttttagccctggaaataaaacaggaacacaattgtcaaattgacaccttctctggtccctgtgatttggaaagactttgtacatatatatttatgaaaaaaggatgtgttcctttaatgccgatgataccaaatctgaagaaatcccattatgttcaataccttaatagaagcaaccatacagcctgataccacctacagtggaataagaagacaggaaagtcatcatttggtaacagtggcattcatcactcattgataacagtttttcatggggcacagtggccggtggagcctctgggatcaaggagtgacaatgtcacagtgttctattatttgcccggttcttaaagtgagagcatcctgaacatctcagggttggaagagaacttgagagttctcaaatccagcaccatccccacaacaaaaatctccttcacaataacactgaccgtccagcctctgatcaaacatgtcgagggatgaggcaccttccacctcataaggcagcctgatccgtctttgaatggctctaataataccaagattactatactactccagagaagtctttcctcctcaagtcaaactttgttcctataatctccactcattggtcccagttctgctctttgaggccctagtaaacaaagtataattgctctcctacccagcagctgtccagatatggaagacagcaatcatggtggccaagccttgactgagctttttcttctccaggctaaagatccctgatgtcttccactgtttctcctatgaccctttccaggacctttcttctgccactcacctccttttcttggacacactaacgttttcctgttcttttagaatgtggcatcgcaaaccaatacaataatgcgtgaagtgacttcagcagcagattatgggaaagacggggtgttgttagagagaattttatatcacaaagttggtgaacatgatgttatggcttctgcaaatttaatacacacaaaaacatacatacatacagggatagagatactattttctgaggcaaagagagtactcagaccttgccttaactgttgttctggatactaaatggtcatccgacttccatgaaggttttatcttcagaatgactgcaagatatgttgagtaatagtaccacgctgtctgttaattacagagaaatctgaggaaacagtttatgtagatgctgcctagaagtcttcagggaaatgataatattaaccaaactggtcatttaggtcatgcaatttaactcaacatttatagggcacttacaaagtgcccaatatcaggctcataactggacaaaaagaaacttccacacagtctctgcccttagaagattgacacatctcattagggagcagggctttaacacaagaaataattaaagacagatacaatagttcagccagttgcttgaccaattcagaaaccataagaatcttactaagtgtgcagactttggagcccactaaaatccccagtgtatggagttgttcctaaaagcaagattcacggtatgtttaatgaagaccagtgtttttagcctgtgtcaatctatgcaaaatggaatcgagtattgatcaactgttaggagaatgagaccgatggaaacagccaattcaattactcagatattagaaaccaacttttccttcagtgggagagatgtcagaccattttatctttccttttatataatctatttttgcacagtctctattacacagttgtagaactggaccagatagttttgtgggcagtttttgcattattttagcctgacagtttttggttccatttcaggtgatcagaatcctcaaattgcggcacatgtcataagtgaggccagcagtaaaacaacatctggtaagtcacacagcatctgagcggtagccacccaaggggaaaggctgggatgccgaagtcatgttacctaatggttaaactcctcttttcccctgggacccaatttacaaacctacccctacacttctcctattcccttctttgtcttcaaagtgagttcaaatgcacagatgggacttagagggacaaaaggaggtggaatgcaatctggatgttctcattatgttcttgctcaatggctgattctaaatgatgaattactgggtggagggaccattgttctgacaacatagaagaaatggcatgtagtgacctcctgactgggagcatccctcctcctaacccatcttcactgtgtggaaatgggcctcatggggtatttcctgccatctgtcaatccctgtatgattaagctcagcctcactgaggccaacctcagggaaagtaaaggtaaaatcattctgtaaagatcaataggtcccaagacgttacattttccaatgaagtaacaacagacgacatattgtgatcttttcaactctgaacgattttatttccatatacgttctgccaccattctagcctttagatattttttcccaaatgtgcatcttgcgataactggtgccaaagaatatgtcgtatctgataaatggatggaaacatgcacgctaacataaagtctcccatcaacataaaggcaagagcgtcagaggagtctttgaaaaattctacagagtgctccggaatggagttctaagcagtgcatgtgtgtgtgcatatgtgtatgtgtgtgacagggagagaaagagagatggacagagagagaaaaaagacactgcttcatctctgaagtggcttgggcttctcagtaggcgtaacacatggacagttatcattatcatggatcatggtaccaaagtaagagcactgaatagggagtttttgaacactgggattcaaggaccatgaccactgcttgctgggtgaccttgagcaagaccctttacctatgcagcagttttctacttcacctactttacagggtggctttgagcatcaaatcagctaatgtggccgaaagtgatgctgtcgagtgctgtacaaccgtaaggtgacactacttagtttacttcaccatggcttagatgtcaaaagggtgacataaagcccctcactaataccagttagttacacaatatttaataattttgtcaagtaccccttctctcttctggatcagatgacaacaacagagaaatctcctagaagaatagcttcccactggtctttttttgcctgtatctaaacccttgatcttggatatatttcatagagctcagattctcccaaaaggcttgtaatggatatcagtcctacaatatcttacagtctgcatcacaataggtttccaggggatcagatgggaagacagtaacattccacccccaccccagtcccaaacctcttcttcctacctagccatgctgctaaaatcttgccctacatcccacagcaagtactaaaattaggtaaggacgtaccaaagtaaacttactgaactaaaagattgagaacctgccctttttttctcaataaaatggttcaaaagggcaaacattctaatgaagcattgtttctggagtggtctggagggcccggatctgtcaggcatttcaggatgcctccctattagtaaagggcgagtcttaccaggtgggatcttgtgccctgatagacctaagactatcgaataggaattattttttaaaaagctcaaggaagcaaacacatcagtactttcacttttcctcaaccctcacccccatcagtcagtctagctttctgtgggagctgagatttcaagtcgggtgcacacactactttgaacccactcaacatctcagccgagaaaatggcacactgttggtgggtactctggcttagccacaagaatactggtactttcaagttggtggcgcccactacaatgggagatcaaaacataccgtgaaatgagcacacagtttattttcatacttccttgcctaattttagtccttgctgggggaggcagatcaggtttgcaacagcatgatcaggtaggaagaaatggggtcttttctctgtgctgaggctgagctaggtagactgacaactctctgactttgtaaaattcaaggcaagcaaggtattcatggtaatattagcaaaaatttggtccgagtaatttggtatgtataatttatgatgtcaaattttgaaatcatttgtgccttcttaagttcaaggcaaattggctataagaactctaacgagagaaagaaactcactgtgatctcttactttatttaatcttcacaagtctctgaaatatgctccaatatgagccccgtgttgcagatgaggaactgaagctcatggagatttagagacttgcccaagcttaaatagagcctagattggaacatggctctgtctgactctgaagcccatggaaggggccttgagaatccatccctatacaaagccaatatccaacattaaactatattttttgtcagaatgtgaaccatgctctgcttcacctcaccacaaactttccctttctttgtaacagtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 3896 - DNA, 1526 bp, human
atgacgtccacctgcaccaacagcacgcgcgagagtaacagcagccacacgtgcatgcccctctccaaaatgcccatcagcctggcccacggcatcatccgctcaaccgtgctggttatcttcctcgccgcctctttcgtcggcaacatagtgctggcgctagtgttgcagcgcaagccgcagctgctgcaggtgaccaaccgttttatctttaacctcctcgtcaccgacctgctgcagatttcgctcgtggccccctgggtggtggccacctctgtgcctctcttctggcccctcaacagccacttctgcacggccctggttagcctcacccacctgttcgccttcgccagcgtcaacaccattgtcgtggtgtcagtggatcgctacttgtccatcatccaccctctctcctacccgtccaagatgacccagcgccgcggttacctgctcctctatggcacctggattgtggccatcctgcagagcactcctccactctacggctggggccaggctgcctttgatgagcgcaatgctctctgctccatgatctggggggccagccccagctacactattctcagcgtggtgtccttcatcgtcattccactgattgtcatgattgcctgctactccgtggtgttctgtgcagcccggaggcagcatgctctgctgtacaatgtcaagagacacagcttggaagtgcgagtcaaggactgtgtggagaatgaggatgaagagggagcagagaagaaggaggagttccaggatgagagtgagtttcgccgccagcatgaaggtgaggtcaaggccaaggagggcagaatggaagccaaggacggcagcctgaaggccaaggaaggaagcacggggaccagtgagagtagtgtagaggccaggggcagcgaggaggtcagagagagcagcacggtggccagcgacggcagcatggagggtaaggaaggcagcaccaaagttgaggagaacagcatgaaggcagacaagggtcgcacagaggtcaaccagtgcagcattgacttgggtgaagatgacatggagtttggtgaagacgacatcaatttcagtgaggatgacgtcgaggcagtgaacatcccggagagcctcccacccagtcgtcgtaacagcaacagcaaccctcctctgcccaggtgctaccagtgcaaagctgctaaagtgatcttcatcatcattttctcctatgtgctatccctggggccctactgctttttagcagtcctggccgtgtgggtggatgtcgaaacccaggtaccccagtgggtgatcaccataatcatctggcttttcttcctgcagtgctgcatccacccctatgtctatggctacatgcacaagaccattaagaaggaaatccaggacatgctgaagaagttcttctgcaaggaaaagcccccgaaagaagatagccacccagacctgcccggaacagagggtgggactgaaggcaagattgtcccttcctacgattctgctacttttccttg

SEQ ID NO: 3897 - DNA, 5443 bp, human
tactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtaagggaaaaaagcaggcgggcgtgggttccactggcgataccccgtcacgcagcggacttagagcgcgagggagagaggtggcggccagggaaaggggcgacgccccgcaacggccgctcgaaaaagaagcgctgtcagtgaccatccacccctagccctccccgtcccgtggcgcctttgccgagttctaacttcccgggcagactgctctgcggtctcaggaactaattgggaccttctcgcgcccaggaacaaactggcgccgcctctttttgtctccctttctgggttaccgtgaagggactccgaatgtgttgagagcatattgcttacaagcgacttagctctcggcacacattcgtggaaggcaaccatacaaatgctaatgaaaactaactttcggttacttccgcttttttttacacttgattggcacatctcctaattaaatgactgatacttttgtcaaactatttttatttggagttccaggttcaattcagtcctccgggaggaaagctaaagcagtttcgtggtttgttcagaacatcttgtaaaactgtctggagccccctggatcgatcgatctatctatctatctatctatctatctatctatctatctatctatatttttttcctcaaacattaactacgactacccaggctttttaatatcgggcttagccaaaccgctgcatttgaaagaggcaaataaaaaggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttctagacatcggtaatacggattttttttaagcagcatttttcttttaagtgggtcactgggcggtcttgttgttacagtgctcgaattctgctcttgtttttgcttgcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataaggtaacctactgaattttatgtcccttagttctttattaccttacataaaaatgaaaattgcggcaggatgcatgtctgtctgttctatctagagatcacccatatacctatatatgtttgtatctatgacttatctaatctgcctatcaatctatctagtagctatctatatattttcaaaagatagcttatgtctaaaacagtggtgatgagtaaggccagttgagcattgcttacttatggttaaagtgcttcttaaaagaaccatagtccatttacaattttggaaggcaaaggctgatttgtttgctgtatatagttcaattcataattatcgcaattatccataacatttatatagcggtgtaataactgc

SEQ ID NO: 3898 - DNA, 1190 bp, human
gggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttctagacatcggtaatacggattttttttaagcagcatttttcttttaagtgggtcactgggcggtcttgttgttacagtgctcgaattctgctcttgtttttgcttgcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaa

SEQ ID NO: 3899 - DNA, 11173 bp, human
caggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtaagggaaaaaagcaggcgggcgtgggttccactggcgataccccgtcacgcagcggacttagagcgcgagggagagaggtggcggccagggaaaggggcgacgccccgcaacggccgctcgaaaaagaagcgctgtcagtgaccatccacccctagccctccccgtcccgtggcgcctttgccgagttctaacttcccgggcagactgctctgcggtctcaggaactaattgggaccttctcgcgcccaggaacaaactggcgccgcctctttttgtctccctttctgggttaccgtgaagggactccgaatgtgttgagagcatattgcttacaagcgacttagctctcggcacacattcgtggaaggcaaccatacaaatgctaatgaaaactaactttcggttacttccgcttttttttacacttgattggcacatctcctaattaaatgactgatacttttgtcaaactatttttatttggagttccaggttcaattcagtcctccgggaggaaagctaaagcagtttcgtggtttgttcagaacatcttgtaaaactgtctggagccccctggatcgatcgatctatctatctatctatctatctatctatctatctatctatctatatttttttcctcaaacattaactacgactacccaggctttttaatatcgggcttagccaaaccgctgcatttgaaagaggcaaataaaaaggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttctagacatcggtaatacggattttttttaagcagcatttttcttttaagtgggtcactgggcggtcttgttgttacagtgctcgaattctgctcttgtttttgcttgcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataaggtaacctactgaattttatgtcccttagttctttattaccttacataaaaatgaaaattgcggcaggatgcatgtctgtctgttctatctagagatcacccatatacctatatatgtttgtatctatgacttatctaatctgcctatcaatctatctagtagctatctatatattttcaaaagatagcttatgtctaaaacagtggtgatgagtaaggccagttgagcattgcttacttatggttaaagtgcttcttaaaagaaccatagtccatttacaattttggaaggcaaaggctgatttgtttgctgtatatagttcaattcataattatcgcaattatccataacatttatatagcggtgtaataactgcagcagttctgaaatgatgctatgggaaaaaaattgcaaaatatgtatttttaaagttcatgatttgtaggcaaagatgttaagagcattgtttccattaaaatcaataacaatgaaaaacggttgtttgctttgtgataaaatgttaacaatccatttaatcttcagtgaagcaactcatttggacaaacagttcttttacagtggttatatggaaaagaaattgattgctattttggggggctggagtgggtagagtattgagaccttttttattagggtgctgtttgttattgagagcccaatctctgcatgaataacagaaaggtggacataaggaattgtaaagtatttagaatgtattgaataggcttaagtacctcctttaaggggcaatgctctaggtttttggtggcagtcaatttggtattatatatgatcattttcaattctagaattttgtttattgttctttttgaagaaataaagtcttggcacatcttatttatgttataacatttttgtatttggtgcctgattttttttcatgttcaaataaatcaatctaaaattgaaatgcttacagaacttctgatgattaaaagaaactttgattctgtgaatgcggttgaagcagtctatttaagttatctactgatctttgtcaacagacaattagttattgacagtttctaattgcaaattgctttggaggctattttttgttagtggagaataatggggtcttttgcattttcttccaccaatatccaagcctgaatgccatgaacagagattgggatgactacacatgtgatgagcaggtaacctggtcagtctatcactcccaacccagacattccgatcttgaccttgacattgagggtgctggaccagattcctatttcaggctttttccttcacctcaaaccagagaccattttaaatgctcagcaagttctcagaaagtatatattcataagactggctctaagtgtgttccattgtgaaatctaaatagtgtatttttcttctgaactgtacaatgaacttccataatttaccactttctccatgagttccctcccccaccctcaatctaacctaactttacgtggaagtagagccatgggttggatacaggattcaaccaaaaacctgcctccctttcaattaaatgtattaaatatctcctgagacaaagagcagtttgatcttttcttagttacctgaaattattctaccataaaattttacaggaaagtacttgagggtcctaagaggggaagatatcaattaaatgaaaaacaattatgataaccaatattaggagaatataaaagttttgcccctgtacatgattacctctaatttgggtgtagcatggtatttctcaaaatcacgtcctccacccttgtcatctgtggtaaagaaaactccttattttgatagaaagcttttcacagatttcccccctataatctggctctgggagtgcacatttacactcttgaatattcagtaaacaaccttagagagtaagtaccccccccaaaaaaaaaaaaaaaaaaaaaaaccaaacaaaccaaaatcatcaatgctcaagcccgaggcatgggccaggctcttaggaatcaacttgttactttccctcttgcaccttgtaagatctttgttcaaagtccctttttcaaaatgagtgattttgcataagattcccactgttaggcaaaagggaggtggctatttccacgcaagacagaagtttggccttcatccagctttagaaggttaaagatcaggacagggtccacgctaagcaggccggtcgatctaaattactaaagttggacatgagtgagcaaagacctccgctcacaaagcatcccaggaaagttggagtgttcaggacttcctcgctcctcccccttctcccttctccccgcctgatgtctctgcctcttcgccctggctctctctcccccttcttaaaaaactccctaaaacagaggagcaaagtcgaagggcctcttaacatgtaagtttgtggaagaatcgccagcagcgtgcccatcgcctgaaaagagaggttatcttggcacctagactgctttcctctcacaggtttctgtccctcgagtcccaagcctccagtggatccttggccggggccggggcggaggcggcgaggccaggcgtttcggaagtcggggctccagctcagctgtcctcgggcccctcgtcggggctcccagggtccctgtccacacaccaagttcttgcaagtctctgtcgaggctcgggcggggggggaagggacctcatttcctagggtcaattctctcgcggtctctgcccgctgaccctttgacctccacctacagggcccttggcggccgtaagccggcggtcgcccgggctccgaggacgcttcgcgccccatcgcctcccagcctcattaggccggcggggctgtaaagcaggaatcagcctctgcctaatccggacctggggtcaatacgagcccaaacaatggtgagctccgaaggccactgcgtagcgctggccgcaaactttgtgttcaattcaattttctaaagcggtgggggttgggggcagggaggcattcgtccacccgaaagccgcttgcggctcccggggctcatcagcgaacgtcctctctcgctcggcccctccagccttttcgcagcgcctgggatagagggggcggcgaggcctggggactggttgtcggcccgcgcgggtgcccaggggctggcgcaaaaggggccgcccccgtgccgggaacagactttgaagtgggtttttagcgcgcacgtgtgagagccgggccagggccggagcggggacccgctgggaggaaagaggaggctccggccggggccccaacccctcccccgcttccccgtggctccggccttttcaagccgcggccgggggcccgtaggcctcccacacccacccccactcccgcgccctgcccgcgccgcgcgcaggcgcacacttcgcagccgtcgagtcggattttgcagcgagggggttggggatagagttgaaagccgctttgcagtgccgcggcctcggtcgagctgggagggaggggaggggaggtatgtgggaaggggggctggttttggggcggctctcgagtcgtgaacatggcggccggatgcgaacccccgcggagcgcagcaaagcgcagcaaaggctgcagaactgttgcgtagtttaaactcccttgttattcctcagttctgggcgcctcgcgggggaatgtaggtcgtggcggttgagcgcaaaattgttaaaaaaacggaagcgaagaagttcttcctgggcattctcctgggaagttggcgtgtgctttttgggtttggggttcccatgggacttggacaaaaaacccgccagaggcctccccacccacctggcccgacctaaaacgccccctccgggagctgccatggctaggggatgccatttcgagttatcaggccccggtcgggattccacagaaccttgagtccctaaaaatgccccaagagcggacagtatgttctcttccaggacagtggcgaagcctatgaacacgtaagcaccattttccaagaaaatgccccggctgttagacaaatgtgccattgcgagttcgacccctacacgttgcccaggctccgttttctgtatatctcatttaaacgtgagcctatgaaaattggcactgtagctttggtgtgtgccttaacagctggtgatcttatgttaaggggaaaaaaggccagaattccgaaaactttaattcagcttttgcttaactgccttaatgctggcgttgaaagaacccctggtagctctgggatctcgagctcgtgttttgtccgtagaaaaatgcttcggattcaccttcagatgtgtcttttgtgaggaaaaaaaaaatgtaagattttaaaaagtgtagtaattgaacctcagctcctctaggaaaataagcggcacgaactcttccaggttgggtcttcgtggagaccaacggccaaacggaaaagtcagccctcttggggttgtccagtgtcacgcatttgggctcctgaaggtgtggggcagttcccgtgggccaccttgggaagggccccaggtgggtgggcaggtcattagcaaggctggcccagatctggggggaaatctgcaaaacagtgcctttatctgcagagaacaattgatggggttgtctttcctccttttcagtgcacaaagaagacggctttggagcaagaatttggaatatgcatttaagttgtcgtgctttgcattggaaacccatgggcaattaaaataagcatgccctgtagtattttctgtccttttcttatgtgtgattcctgcaagtcaaaggaggccggagcctcttcagtagtttggaaacttgttttgaaattgccaccaagccgatttttttttttttttctgtgggtgaagtttccttccccggttcactcactcccccattccccaccccctcgctggaatagagtattgacatctttgagagatcaaaggaagtaaatggtgcttgctgtatactctatttttccattctgtagtgtgaaccctgaggtttgagcttttttctggttaaatctcttggtaccaaaagtgtggaaaataaaaagttcattaagttaaaaaagctttagccaatggttagacgggtttgtccctttaagagctacagagcccagatcgtctcttaaattgactttaaagtcgagctaagatgcattggtggactgtttcccctggatacctgcggtgttctttgggtcatttgacatggtaaaactggttgatttttatagaagttatgtgaatggaatttctgcaaaaccgggcaagtgataaattggtagagctcttgtatttgtttggatgacgactccaaagggtactgcttttttaccgaggtttgattctgtcataaccattgaaatttacagcttggaaaacactaagtttgctggaagcatttaaaccagggaatgttcagagcacttggactaatggtaacttttaacagacgaacataaatcctttgaatattagagaaacttgtttcaaaaaatctgttgaaactgaagaaaatctctttcattaacatttaacaaaccaagcagttttgtatatttttaatctgatgacagttcaacctatttacacatctgatgaatggagagaaatgtaagctttatagtaactataataatagctttcaccagatggcaaattataatatttgatctctaatagggtgtgtgtcttgtgtcatatattttattaaaatacaacctgcgtcaagaccatttgaatttgaggtgttaaaaataaaacattccatcgtgttttattataaaccagagtttaaaacaacatattcatgtgacattttatgacattcttttctaagaggaaatgtggcctgttttgacctatctgcagttcactttttgtttttttgccagtgttgtcctgcttggtatccgggacagtctctaattcctgacgaagaacttgatactgacgttggtatgcagcagccagccctccataacactacctatcctaaatgcagggttaatgccgaacctactgtgcaagaaatgatttactgatgaggtttcaaagaaaaccacatcaatttggatgtctgttaccttgaagtgatcattttaagagtagtagcttcttccctaggtataaaaagactattttcttcttttggtgtatttcatcctgtgttgagcaatcatttgtgaaatgaaaaagcaaaaaaactccccccactttaggatttataaatgggaagatggaggtgaagactggcctaattcataacccagtatgcattatctcatgcattgtgttgaccttggtgaaaatctttttcaaataccagcattctatatgtagaactaaagtgtttaaaactagaaacatgaattgttgttttgttaattttatgtttgtgttcagaaagcaatacccaggatccctttaatttttgtttgacttaaataaaaccatttaaatta

SEQ ID NO: 3900 - DNA, 332 bp, human
tttttatcatctgagataggaataatagagggctttttcaagtgaagatattactatagtcttaagaccttagtgtaacatcctggcccctaaggaaaaacaagttctggttcatacatataataactttgcatgttatctgccactgagatgtgtcctaatcgaacagaaaggattgaatctctgtagctagctgtacagggcaagagctgtacagggtacctttaaagatagcttcaggccaaagctgaggaaagtggatggagactggggaaaatgctaagacattttaaagattttctttaggtcaaaaatagaataagaaatagacc

SEQ ID NO: 3901 - DNA, 32700 bp, human
aaggttatgcagcgcgtgaacatgatcatggcagaatcaccaggcctcatcaccatctgccttttaggatatctactcagtgctgaatgtacaggtttgtttccttttttaaaatacattgagtatgcttgccttttagatatagaaatatctgatgctgtcttcttcactaaattttgattacatgatttgacagcaatattgaagagtctaacagccagcacgcaggttggtaagtactggttctttgttagctaggttttcttcttcttcatttttaaaactaaatagatcgacaatgcttatgatgcatttatgtttaataaacactgttcagttcatgatttggtcatgtaattcctgttagaaaacattcatctccttggtttaaaaaaattaaaagtgggaaaacaaagaaatagcagaatatagtgaaaaaaaataaccacattatttttgtttggacttaccactttgaaatcaaaatgggaaacaaaagcacaaacaatggccttatttacacaaaaagtctgattttaagatatatgacatttcaaggtttcagaagtatgtaatgaggtgtgtctctaattttttaaattatatatcttcaatttaaagttttagttaaaacataaagattaacctttcattagcaagctgttagttatcaccaaagcttttcatggattaggaaaaaatcattttgtctctatgtcaaacatcttggagttgatatttggggaaacacaatactcagttgagttccctaggggagaaaagcaagcttaagaattgacataaagagtaggaagttagctaatgcaacatatatcactttgttttttcacaactacagtgactttatgtatttcccagaggaaggcatacagggaagaaattatcccatttggacaaacagcatgttctcacaggaagcatttatcacacttacttgtcaactttctagaatcaaatctagtagctgacagtaccaggatcaggggtgccaaccctaagcacccccagaaagctgactggccctgtggttcccactccagacatgatgtcagctgtgaaatcagactgaaatgctgaaataacgataaaaaaaaatacagaggttaaactagcaaagtgagtaaagtcaagggataaagaaaatttgttggaaaactcacaaagcaggacataaagcaaggccattagatatatctcattagtgtgacatctgggaggacaaagcatccaaaccctttcttctatataagtggtgagatgatgaaggttgtaagagggcttctgcccccttgaagacttcagatgctggggaaaggatagataagaataaggatgaaccaggcttttggagcctgggaaataatgactagcgataaacctgaagggaagttaagtatacgatccccagataatactaaggagaaaggcaatgtgattctgcagccattgtagccagagataataagcccttgaggaaggggccaggggaatttttctaaggatagacagtattaatgcagcactctcttctgctattaaactctcattggcttctaaaaggagtttcggtgagtgatttgctgagatgttgcattttcatggctgctgcctttaggtattattgcaacagtttggaattttgaaattaaaacagttctgtaaaaccagtttagttttgtaaagtgtatgcatcaaagatgtccttcattcagacattactgagttacaactatggtgccaggtactgtgtcagggtactaggggtatggggataaaccagactccctctttgatctaaagcagcatgaggccaggtgagaggtttcaatataatgtgataaaatgtgcactaggtactaagggatcatagagaaaggaacacattaaatggggaaacaattgatagagagagaatattttcatctgggtcttaaaagatgagtaggcgttctctctctttaaatgtctgatataagggcattttatgcaaagaggatcactcgtgcaaagactcagatttgcaagaacgtgaggtatttcaggagttttgtatggttccatatggactatgacaagtgagacaggtaaactaggcagagctggtcatcagataatgaagtcattaacctaaggagattggacaataaaatgcaatatggaggtatcgaagtataaacataaggagtaccactgatggctgatttaggatgcccagtctggcaacacgctaatgaaatgatagtgggggagggggccgtaccaagactaggagagagcagtcctgagactattgcaattatctgcgggagacataaaggctagaacctgaacagtagcagtacaaaaaaagaggggagttcaaatgatattaaggaagtagaagtggtatgacttaaccatctgggtatggaaggggaaatggctagagtcttggggactttgtgtttgatgtgattatggaccacagaataatgtctaagagaactggctctttagtctgactgccagagtctgaatcctgaatgttttagtatgttaccttgggcaaagcccttagcctctatgaatctatcttcctcattcataaaaataagatgacagtgcctatctcgtgggacttttgtgaggatgaagtgagataatggatgcaaagttactgagcacagtgtccaacacagcagaagcattacatatacattagctattactggctacattatgatatacagttagggagttggaaagataatctgaaattcaggagacgtatctgactataggtgagtatttggaactcattgttctgtaaacagtagttacagccacgtgtgtgggcatctggagagtgagcatggatattgtgatacctagtacagtgcctggcagtagtggttgtatgctcagtaaattttgttgacagggtcagggccggactagactgtggtaagcaaggcctgtagggcataaatatacttgtatgccccgagaagtgaggacctcttaaatattgtgccctacatgccttgtttggttcactcttgtcccagccctagcaagtatatataaggtgaaaaaggaaaaagctgaggctggagcctgggagaaccctggacatttaagggccatggagaggaacaggagttaatcaattcaagtgctggatggataacaggagttagagcaaagcggggaaccagaatagagtgattattataaaaagagtttcctaaaaagggagagatcaacaattagaaattatttagagcagccagtaaatacataaactcaaaattattctttaggtcattcctgattgtgacaatagtcatttcattatataaatgtgattaaggaaggaaaagagctacacagaagttattaaagagctaaagagaattgagaaatttaaaacagaagaaagtagggccaacatgaaaggagtagggagaaaaagagataaccagcatattgtctcactgatcctgccaacacctgtgagatagatattcttattatactactgttaaacctaatttacatttgacaaagttaaggttcagagcttgtgtgacttgtccaaggtcacaggtctagaggaggcagatacttgattcaaacctatttctgtctgatctgattctaaagtctgttttttcactcaaccacactgtacagtcagctctccttgtgagttccacagccacagattcaattaactgcagatcaaaaatattcaagaaaaaaatggatggttgcatctctactgaacatgtacagactcttttatctttcattattccctaaacaatacagcataacaactatttacatagcatttacattgtattagctattaagagaaacctagagatgatttaaagtacaaaggaggatgtgtttaggttatatgcaaatagtaagccatttttatatcggagacttgagcatccacagatcttgatatttgcagggggtcttgccaccaattttccatggatactgaggaacgactgtaaatggatgcaggcatggatgctatttaggagtgtccagggccaagtaaatgagttgctgagcagagaggtgggtggaggctgtgaggcatcaatatgtggtggcatccatctgcattttggtgatttttttccttcacagtcctcggctgtctgggaagagaaggatgaaggcagatggctgctccaatttaggggctaggattgcagggtgggcacagcattgcaaacgagtgaaggaaattgagaaatatggccaatgaagagttgaagagaggcctggcatggtggctcacacctataatcccagcactttcagaggcccaggcaggcagatcacttgaggtcaggagttcgacaccagcctggccaacaaggtgaaatggtgaaaccccggctttactaaaaatacaaaaattagctgggcatggtggcgggtgcctgtaatcccagctacttgggaggctgaggcaggagaatagcttgaacctgggagatggaggttgcagtgagctgagatcgcaccactgcactccagcctgggcgacagagcaagactctgtcaaaaaaaaaagagttgaagagaaaaagtctaggctaaattcaaagaaaaaaagtgagcccaaaaggaacttgcagagcaagggaaaagcagggatgtcaagggactagaacactccataaagtgaacagctgcaatgaaaataagggaagaaagtttagttcatctccgtttctttcctttcctttttactttcctttctcttcctttttggagttaatcaggaagtagtcccaaataccccagaaagttcatcttataagcccttggtcctcttgagatggtatcagatatattgctagacccttgaagaaaggaacaactccaggcaacttcttgagtccctgttattaattttatacatacacacacatatatgtatatacatgaaaacacacaaacacatgtgtgtgtatacagccatgcattccttaacaatggggatatattctgagaaatgtgtcattaagcaatttcatcattgtgcgaacataatagagtgtacttacctaaacctaaatggtatagcttactacatacctaggttgtattgatgtggcctattgctcctaggctcctgggctgcaaacctgtacagcatgtgactgtactgaacactgtaggcaatggtaacagtggtatttgtgtatctaaacatagaaaaggtacagtgaaaatacagtattataaccttatgggaccactgtcgtataatgtggtccatcattgaccaaaatgtcattgtgcagcaaatgattatctcatatatatatatatatgatatgatatatatgatatatatgtgtgtgtatatatgtatacatatatatgtgtacatatatgtatacatatatacacacacatatatatgtacacacatatatgtatatatatgtacacacatatatgtatatatatatgtacacacacacacatagagagagagagagaggagaggagaggaaggagggagggaaggagaaatatgattcagatagagacatctatcctccagagttcaggagtgtctcttcagactaggtagatgtagcttaaaaaaaacatatcctgaattctagagagatgcttaaatcactgcaattcctataacacttgccaaccaaaggtgctgttgatctgaaattgcttttttaaattaatgcagtgatttttctttaacatctagtgacagacactggggtcacatttgcagctggaccataattaggcttctgttcttcaggagacatttgttcaaagtcatttgggcaaccatattctgaaaacagcccagccagggtgatggatcactttgcaaagatcctcaatgagctattttcaagtgatgacaaagtgtgaagttaaccgctcatttgagaactttctttttcatccaaagtaaattcaaatatgattagaaatctgaccttttattactggaattctcttgactaaaagtaaaattgaattttaattcctaaatctccatgtgtatacagtactgtgggaacatcacagattttggctccatgccctaaagagaaattggctttcagattatttggattaaaaacaaagactttcttaagagatgtaaaattttcatgatgttttcttttttgctaaaactaaagaattattcttttacatttcagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacagtgagtatttccacataatacccttcagatgcagagcatagaatagaaaatctttaaaaagacacttctctttaaaattttaaagcatccatatatatttatgtatgttaaatgttataaaagataggaaatcaataccaaaacactttagatattaccgttaatttgtcttcttttattctttatagactgaattttggaagcagtatgttggtaagcaattcattttatcctctagctaatatatgaaacatatgagaattatgtgggttttttctctgcataaatagataatatattaaactttgtcaaaaggactcagaaagatcagtccaaccctctaacccatattgaatggtgatatactacagggttatgccagtgtgggaactatcgctggtaaataagtttaatcctccctagggcttcacaaagaacattgttccaccccaggagggtggaaggaagaaactgaaatgattgtgtcttagaacctaatgaaagtttgcattcctcagtaaaatcagagactgctgattgacttaaatgtttatagcttcaaagtcctcctcattatcatggcccacaagcccttccatgattgtccttccccaccctccccattacccttcttgcctcctctgctacttctctcctcgcacactgggctccagccaccctggccttcctgtcacttcttgcacactctaggaatgctcccactttggaggctttatctggctgtttctcttatttggctgttcccaacttcctgtgggctgactccctcacctccttcgggtctttgcccaaatgttaccatcttaatgaggcctaccttcaccatctattaatacttcaacctgccccagtagccttaccactctagacacctgtacagaactccactctactttttaacagagcttttcaccatctaatgtatcatataatttcttactcatactatttatcatttattttctcctactccactaaaatgcaagtttcatgttggcagggatattcaattgttttgtttattgatatattcctagcacctagaacagtatctggaaaagaggtactcagtaaatatttatcaaatgaattgaccaaaagaaggaaaactcaaaactttaatgacaactaactttaaagctacaataacttaaaattcagcagtaggattttgagggagggtaagtttcaaagattgacttacctaagactatctgcataaataaaaagaaattaatccagacaacaaattcaccaacttccatcaattggaaatccaattctattttctacagtttatgttctggagacactactggacactcttttactctcataactcataactcctccacttttgtttttaaatcatgagagaaaaagagttgactctgttatattgttttatctacctttccttgatcttagaaacgaatactaccataccagcttctactgaggtgccccctaaagttagtccaaataggtctttgcaatctccattcccgcagaatttagaactttgaatcacatgatttatttctaaaagtaaatccatgccgattttccccaccaaaaaattcctgactattaaactcctacaatcccttcattgctcactccccacccccaggatcatattttaaagttgggcccttgccttttgggtcacataggtacactgtttgctataccacaggtatagctatctggaaaacatggagggtattattctgttactactgcttcgtcaaccaaaaaataaaacaaaacaagaacaaaaaagaaacaaactccctgcctcttttcacttgcagtcaaggttcctaaccactacaaaattagcctatgtttcttcttgcacatagtagaaacccaagcttctcactgctgtgctattctgtaccatcaactcatcacataaagagcctggttgaagaatgattgtccaaccacattactagcatctgtcaagactttccagtttacaaaaggcctatcacatttaaccctcacaccatccttgtgaccaaagcattattaactccattttacaggagagtaaactgaagcttagggaagttaaaagaactgccaaaggtctcccagttggggagtcatgaagcccagaagagaagccaaattctctgctgctcaaccccttgctttcactattacacctcagggccttcaaatctaaatgcagttattcattaaacaggaacctggtagtcttaaacaggaatctctcacttggtaagatcttgtctcttgttgtatttgaccccaactgtctatggctttgcctgaacccaaagtacacacagcctagaaaccaaaggagaaccaaatgtgggataaaatgacactcattttaacgacatgtctcagcaaatgagttcctgtgtagctggctgaaagcccagaccctttcagtaaaacatcctgaataattcacatttgttggtctataatataaagggcaaatgtagctcatttttagaccagttctgaacatcaatagtaacaaaccagagataaccgattttgttttcatagaattggaacaaattagagtatctgtgcaaaagcatatcagatctaggagcagaggggacaaggtctaatttttaaataagcaaattttccagggagggactacttatgataaagggatattagtctcttagtcaacggaacctggatacacgcttctgacagagaagagggagaataggcaggaatctacacaccagatgtcaaggagatttgctttaaaatacgactgataattagaaatttctcagtttcccccttttccctcattctttgattcttattgttatctttatctcttactcctttgtttctcatatattgagtcttacagatcaagctcctatttttttcttcaggggtatttttctagttcaaagtgcctaccatctcccttctggttctattcatccttctctcccaaagctcctttagaagtgtggattaaggcagagcactaagaaaccagacttaaagattcccttctcattctgacttttctcctttcacctattccttcctcctgttttcttaccatcagtgtcttcaaaggctttcaagtacacggtaaatgcagaaacttcaagaaaggcagaatggaaacataaccaatgcatacataaataaagcacactgtagaatctttttaaattctgtatgatatatcgaatgctgtctctcacattacctagaccatttgaaaccgaatttgtaaaacatagactatctttaagtagtaacagatgcttctgacatgttttctattgtcttgaaccattactgcatatgatacatcaaagttaagtgacaatacaagaaagcagattcatttgctccctgcctaggccgtcagttcctaaagtggaaacgccatatattatctagctcagtttgctctacaagacctgcaatagagccttgtgtgacatagagataatatttgttgaagcaattaaatttgacttggaattaactctgccatcattctataaggaaggattgaaaatccttctcaccctgtgctgatatagtacctttctatacaaaaacgtccttctccctcttcccttggattgcataaactatgtacatgccttcctcagggcacttttctaggacagtgtcagcctaaggatctttgtttgggtggcttttagaaactcaggaagacaggagcatcatatgcctataggcagctggcttccaggtcagtagttttgctctgaccctaaaatcagactcccatcccaatgagtatctacaggggaggaccgggcattctaagcagtttacgtgccaattcaatttcttaacctatctcaaagatggagatcagtgtgagtccaatccatgtttaaatggcggcagttgcaaggatgacattaattcctatgaatgttggtgtccctttggatttgaaggaaagaactgtgaattaggtaagtaactattttttgaatactcatggttcaaagtttccctctgaaacaagttgaaactggaaaatgcaatattggtgtatcataatttttcttaaaaacatacctttgatgcttataaacatttcatttgtagtgatagttttcaggatatgagttcaagaagctacattaaaatcaataacaatatttggtaactaatattaagtaataatgatgttccactcacttattaatctttaatacaaccgtatgtggttagtactatcattatgcgcattctatgcagatgagaaaaccgcaactccaacggccaaaaattacagaggcataaatggtttagacaggacttaaacttcagtgtgaccaaaacccatgcttctaactactatattcaaaactcagagaaaactgaacccagaaaattgaaatcatgactaaattgctatcaacataggtagtgaaagtcaattaagtacagaactggagtatgactggccaattatcccatataatgggaattctccacatgtacaaaccacttcatatgctaaacttgttgacaacattcaaagctcatccctgaatttgactatattgattacatcaaaaatgttacatagcaaccttagaatccttgtgtaccttttcttctcaaagcctagattatttctttttccgacgtttcagtaattggagcagtaaaccccagtgtcccttacctacttgtttattacctccagatgcaatattactggtactgtgattgagaaacgcacacagtgctaatgaggaattcactttctactctgacactctggaagaatagagatgcaatcctaaggaagaatttaacaccacaggctacatgactaaggataaagagtagaaaattagcaggactctattaaggcattacagcaatccacctgacagatgaaaaaggcatgaaatgaaatgaaatgtagcagctacactcgtcctattgagaaaggaaaaaagtcacctgtaatgttgttcagaaatcctttcagtactaaaaaattcattgaccatcttcctttagtctcgaaaatttcttagaaggtaaaaaaaggaaaaggtgacagggcaaagacatttgaaaagaaagaaaagagtgaatgaacttgcacacctggcttggactcccattcccttaggtttccattgtgggggacaaactaatgcctgggttacctttcttgagagtgtgttaattgattcaatatctctgaagtgctactttcatctgaaaggttataatttgaaattcagatttacctggataaatttgatcttgctattatggaaacctctagaaatccttggagtagttactcattatcagcttaaataatatagccggtggagctgagggaatgagtaactcaattagtctcagttacaactgaagggcacattgttgtaaactataattgaaaacataaatatctttacctagtttaaaaataaagatgctttaaaaggaggaagggaatagccctgaggaatgtaaatataagcacaaaacttctacaacagagtttgctacgtgtgtggctgtgttccacccagcaaaaatgctaagtctacaactgacacaacttggatactctcatgttcccacattttggtttggtcaaggctgtgcagttgtactgcagccaccaccactcctggcctctacagtatattgatctgacccaccaatctgatcaaggtttagaaaaatattttcagcccagttagctcacaaacaaaatgagaattcccacaaattgctctttatctcagacaacagaggaaagctacagcaaaagcataaacaaattaccatttaagtttgttgcttcaaattaaagactaattgcaacagctactagatagcacagtttatggggcatctcggccccaagtcttttgtcttataaggtcttgaaaaaaagaaaggagattttcatcaataagagttttttgttatctttttcccttgttcatcaggcccttcactgcgagagagaggtgtaaacgttcagggcatgcattctagttaaagaatattaattggctattgggtccctttggttagaataaagacctctgtatgatgtccctagctgtacatcaaacccaaatatctctcagataaatgaaggtctgtaagaatttggtcattcctgtctcttctaaagagtaacagaggcattttcccgcagtaaagtagaatggaaagaaaacaaaaatcacaagcctataaacaccttcttcaattttcccagcatgtcacagacactactgtcttatttactacgtatttctgaggagtaaaaaaaggaaatatgttgagtttagctgaagcacagcatattttgtggtaaacttgttaaataaaacatcttttgtccaagctttggttgtcacacaagtggatatatcaggaaatataaaggcagaataaactaaagcagaacatactaacatttgtagtaggcatgaagggaattagaaagtgtttgtgttaacatggagggagggagaacagatgctttgagatgttcttcaacagatattctaggcactgagacccccttcgggaccagagagagcccatatccaccacagtacctgacacataaatgctcagtaattgataaatgagtcccattctaactgttccttagccctgctctatggaactctcccctggaattccttgtgccattattttatttctggaatcttcagccttttagctgagggcaaaagattgctgattaggaagcaatatttcccacctcctgcgcaaaacaagccaaagatcaacagcagcagcaacatactgagccctaaagggcaatgacaaatgtggagaatgatacagaggtctggttacttcttagccaatgacacagaatcacaattgagaaaacacagagtttattcattcccattgtgcatgccctggacaaaccaagctgcacctttcgtaacttatcacaatctcatattgacggaacactttctacaggtaatgtttgatttggctgaacactttagcattgcttcgtagcaacaaaatgatagctagtaacagaaaaagatccagggatattaccactgttagtgaggagaaaggccttttaattaattaattaattaattaataggaccaagtgccatctttttggatcatgcccttagtggattattggtagcaaaggttaaagctcaagctggttcctttgtccccctggcaacagttgatttgcctccctttatctcctgaagtatccgtaaggactaagagccaattattacatttggctatgctagcatatgtaaaatagagtttaaaagtttagattcatcactcaaaaattcatattctccaaaaccatacagtcactctgttagcctgtgttcccccagaaaaaaagtcacaagcttatttattaacatgtgcaatcccagggggcaagagaaaggaactgaagagtgaggcagaaaggaaaagaaagccaataagaggatgagttatcaaactactcgtttctaacagcaactgattgcttaacttcctgggactgtctccaataagtcaaattggcctcaggttagtccacctgagtgggaagaagcggtgaaagaatttgtctgtcagtatctgtctctcattggttagaagttcgacttatggggaattaactccctcacatttcctagttggatatgcttgggtacccagagggtcatatggcatccatgcctcagcatgaacagggaagcttcaaggcaaaagacacatagtgcagctatgagccaaggcaattcaaggatacacccataggaggctggttgacatccacccagagctaatcaccaccatgctggaaaaagacacaggtgaagctgagaagaatgaaggtggtgcataggaggtatctaatacagtcactcattttcaaactttccatgttatgattgcactgaccactgaggatttctattgaaagttttactgttgtcaaacacgtacacaaggggaaaggtgtcttacattgtttatgttcctgtgctgctctagaaacagaaataggctcaagagcagagcctgtttttcttaattcagcaggtctaagctaacaagtcctgaaacatggtacttcctgttattggtattgcataggagaaacaaagggaaagcacagtaattagaaaatacaaaacaagatggcaggaataagccaaaaatatcaggaaacacaattattgtgaattgggattaaactaatctattaataatgacaactttcagcttggagttaaaaatttaattgtatactgttaacgaaagtgatacctaaaataaaattacactgggaggccaaaatgaagggatgtgaaaagaactatcaggtaaaaactaacaaaaagaaactagcaaagcaatcttaatatcagacaaaatagaatccaagaggaaaatcatttcaaaagacaagagattttttttattaataaggggaattgcataggagagtaaagaaaatgtgggccactggaatgcttagcactaatgacatattggtctttggtcttcagttaccttacaggaccctatttcattctcttatgtttgatatgtaaccacctcagccagcttcaagttgctttttggccctaatggacttcctagcactataatttcttttttttaaatgttttattttaggtttaggggtacatgtgaaggtttgttacatagataaacatgtgtcacaggggtttgttgtacatattattacatgacgcagatattcagctcagtaccaaatagtgatcttttctgctcctctgcctcatcccaccctcctccctcaagtagactccagtatctgttgtttccttctttgtgtttataagttcttaacacttagctcccgcttacaagtgagaacctgcagtatttgatttttgttcctacgctagtttcctaaggatgatagcctccagctccattcatattcccacaaaagacataatctccttcttttctatggctgcataatattccatggtatatatgaaccacattttctttatccggtctgtcattgatgggcatttaggttgattccatgtctgctattctaacactgtaatttctaaagacttccagattctacttttataggtaacctgttaaacagtctagctctggaagccaagcaatttctagaataactaagcaatagaaattacacttcaatgcagaaaggcagtatctacatgagattatgaaattgcggttgctttttgtgttcactgaaaaaaataagtaaaactgtaactttcagaaaaaatgattgtacatatagaaaacccaaagcatctaaacaattaaaataaataagtatagaaagattactggatacagagtcaacatacaaatatcaattgtatgtctatataccagcaacgattcaaaaatgatttttataatagcattaaaaattagacgcttagtaataaatgtgagaaagatgtgcaagaactctacataaaaaattatgagacgttattgagaaaaattaaggaaaacctaaataaatgaatgaataggcaatgtttatcaattaaaggatacaatatagtaaatatatcaaatgtttactaatggattcaatgcaataccaaagtgcccagcaggctttttttggtggtgggaggtcgggcaggattcataagctaattataaaatgcatatggaaatgcaaagagccaaggatagccaagacagttttgaggaagaataaacttgtactacttacactaccagatgtcaagacttattatcgagttacatttattaagacagtgtggtactgacacaaggatagacaaatagatcagtgaaacacactagagtgctcagaagcacacctgtacatatataaaggcttgatttatgatagaggtgccagtgcagtagagaaggaaattattggtgttttcaataaaaagtgataggtcaattagatattcatatggcatgaagtatgaaacaataacaatttatattcataacttgcagaaagcaaaaatttcttaaaatacaaaaagtgatcaccataaaggaaaagattgataaactggactatattaaaactaaggactcctgttcagcaaaagacactacttcgactgaaaagacaagtcacagagtgagacaagatatctgcaatacagatacctaataactgaaccccatacagtgatggtgggaatttaagttcgtacaatcattttagaaaattgcttggcagtatctactagatctgaacatgtgatccagtaattacactcataattataagccagtaaaaaggcatgtttatgtcaccaaaagatatatacaagaatgttcattacactattatacataagagccaaaaactggaaacaaaccaaatatccattaacagtagaatgaataaataaaagctgtaatagtaatacagtggaatactacacagcaatgtaaatgaactactgctgtacaaaacaacatggtttaatctcacagacaaaatgttaaatgaaagacacagacgagtacatattgcgaacttctgtttataattcaagaactggcaagaactgtttactgtgttagaagtccaggtaatggtaacctataaaaaggaaaaagggtggaatgattgggagggggcatcttctggggtattgataatgtgctatgtattggtcagtttagtgtttaaacaggctcatttactttgtgaaaacttacactaaaattgtgtgtattttttgaatatatgttatacattaataaatagggtttttaaacctgtagttcataatttagtgaaagtagaatatccaaacatttagttttaaaccaatcaattatagtgctaccatcatttttatgcattattgagaagtttattttacctttctttccactcttatttcaaggctccaaaatttctctccccaacgtatattgggggcaacatgaatgcccccaatgtatatttgacccatacatgagtcagtagttccatgtactttttagaaatgcatgttaaatgatgctgttactgtctattttgcttcttttagatgtaacatgtaacattaagaatggcagatgcgagcagttttgtaaaaatagtgctgataacaaggtggtttgctcctgtactgagggatatcgacttgcagaaaaccagaagtcctgtgaaccagcaggtcataatctgaataagattttttaaagaaaatctgtatctgaaacttcagcattttaacaaacctacataattttaattcctacttgaatctgcttccttttgaaatcatagaaaatatcagtagcttgaattagaccaattaattttctagattgcatcatattttaaatataaactatgtaatcatctacaacctgaattctttctgtgtccaatttgtccaatttttttctctaacatttatatcacaaagcaattaatttgtgtgatttctgcatatgtatttgtaattcatcaagtcaaatcaatgtagtaatactatatcataaaatatacacaaataattgagtgataggcttctagtataaggacggtaagtttgaagcatgattctatctgggctggctagtttactctgagaaagttattttttattgttgggtcttaagctgagtttacacacttggtgtcagaatgattccggcaatgaactgttttatgttctgctaggctgatcagcacaatctatatggctgtgaacaaaacaatgtttcccagtcatgccaaccatgccaccattttaacagctgattagtgtattcagaacatctccactccatgttcgtatggctgttatctaaagatgaaagcagtagacacttttattttttgaaaaatttaggctctgcagggtcaattatatttgataaatgaggggcttttttgaagcaaactagatataatttcttttgcatttctaaagcctgatatcttattaattggtacattaaattgtgcaccatttctctgtaactgtttcagtacctgtctcagcactataccaggcagaagaaattaaagaaagaaccagtgccgagatcagcttggtcagggagaccctaatcctgcggcactagaggaattaaagacacacacacagaaatatagagtatggagtgggaaatcaggggtctcacagccttcagagctgagagccccgaacagagatttacccacatatttattgacagcaagccagtcataagatttactgaaagtattccttatgggaaataaagggatgagtctggctagttatctgcagcaggaacatgtccttaaggcacaaatcacttatgcaattgtctgtggtttaagaacacctttaagcagttttccgccctgggtgggccaggtgttccttgccctcattctggtaaacccacaaccttccagtgtggatatcaaggccatcacgagcatatcacagtgctgcagagattttgtttatggccagttttggggccagtttatggccagatttggaggcctgttcccaacaaaccagaagctaggaatatatatcctgcaaataaaatgaagaatctctaaggcttcagggcctgcccacttgttcttctgcctggttcttcacatacactgtctcaaagctagtctaccttgagaggagcatgaatatgtgtgtgggtgtgtgtctgtgtattttaaccttaaaaacctaacttccagtatagacagatggcatactagctaaacccttacaagttcttctatgctataaaagagaaacagaattgagaaccacctccaactattaagtgttatatttgaatatagccttagctttagcagaataagtaggccaaacttaaaataagcttttctgccttttcaatgataaaggtcccttttctgtagccattgttgattgtgtacacttatacataagtattttgaactaatttcctgttttctcaaccacttgctgtcttcatgatactttgtcgcagctggttgctatagaaatgtctgttacaaggaatgtggcttgaaggaaagtgataaatgaaaatgaaatgtgaagtgactttgtttgactacaaattcccattctggtagtccccagtgtatcaatacattatttttctttagaaaataaaccaacccaaggaaaaatggtgggcaggtcctggtgaatatggctgtgataattatattagcaatctctttggctaatatttgaagcccaaataattgaatcacaatgatctctccccagaaaatatataaaatgcaccttggaatctagaaggccttttagtctgcaaaagaaaccttcttaatcataagcagcagaagtcccatttaccaaattggaaagttaaagttacaaagcatcaatcataagacttccattcagggatggcaattgggagtaagactttttagtaaagaaactaaacacaaagtcattagactctgtaaaagtcttaccaaatttgattctggaacacctattctatttccgtaaagatgatgaattccggagccaaatgttcttttcatgaaggatttgaaaactgtccatgaaaataacgcaatcaaccttttagcttgagactctattcactgattagatttttttaaatactgatgggcctgcttctcagaagtgacaaggatgggcctcaatctcaatttttgtaatacatgttccatttgccaatgagaaatatcaggttactaatttttcttctatttttctagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggtactttatactgatggtgtgtcaaaactggagctcagctggcaagacacaggccaggtgggagactgaggctattttactagacagacctattgggatgtgagaagtatttaggcaagtttcagcactaaccaatgtgagaaggcctccagagatgagcagttggtgaaagagaggctcaaaaccagctaccatacaggtcaagaagaatttggcattaaggaaacagcatagcaggattccagacaggcaactggtcaacaacatgaaggtctggaagaaaggtcgcaggtactcaggttcagggcactacttcagcttcagcccttgcaaaaactggtgagagttggaaagtctttaggctaagaaaaattggattatttaaaagggggtaaagaaagggactcaaggaggaaggattaaggcaagaactaggttccaagaaacagggcatgagagagagtcttgatctaccactatagttctcgtggtagcatcagaatcacctgggaacgtagaaatgcaaattctcctgctctacactagacctaccaaatcagaatatctagggggtggggcccagcagtctgtgcgcaaacaagcactgcaggtgattttgatgcacattatagtttgaaaactaggccaggtgcagtggctcatgccaataatcccagcactttgggagactgagacgggaggattgcttaaacccaggagtttgagaccagcctgggcaacacggcgaaaccccacctctaattaaaaaaaatacaaaaattagctaggtgtgatggctcccacctgtgctcccagctattcaggaggctgaggtgggagaatcacctgagcctggaaagtcgaggctgcagtgaattgtgatcacaccactgcacttcagcctgagtgacagagtaagaccctatctcaaaaaacagaaaaagaaaaacactggcccaaaggaaatgaacttgttacagaagccggggttcaaaacaccaaataatgcacttgtacctagtccttcccgggtgctctgcagacatttctccaagcgtagtctgcaaacaacctacatatgtagaattacctatgcacatttttcatttaacaaccaagagctacatttgtagcaaaatctgggttgtaacttagcctacagctgaagcctaagagattccgtctgtgagaagaaataacccacctctttggcccccctccccaggcaggaagccaggatggtccttatataaagttgtgctgtccaataggtaaccactagccacatatggctatttaaatttaaattaactacaattaagagaaattaaaaattcaattcctcaattgcacctgccaaattttaagcacataacaaccacatgtggctagtaactactgtattggagagtgcaagcggagatagaacactctattactgcagaaatttctattggatagcacttataatagtttagtgtaacttaaaactccctagttgccacagtcatgatttagtagtaatttcatggatttctctactgaggttagaatctctgccattagagactgataaatttaaagtttgcaattatcaaactggtgacaatttaagccagaatcaggtaaatgtcctcagttttaacagcattggaattttctgggactagctgtgtatctatccaggattcttgagaatgcctgccatttttcaacataatggatgtaaggtattacacatatacctggggatggggtggtaggtataattgcacaagcattgtggagaatggtatcaaagagtggcagaacatcacaatcaaggttttccctttcttttacctttgctttttaaaaagacaatatttgctggacctgatcttataactcataaatgggacactgtatgttcctttttacctcctctgtttctacttaattgcaccctatgaggactgcttcccttacctaccataaccccttccttcactcatccatatctttactcttcttcacaactctgtaatattgaccttctttatgaacctttcctggaacaatccctcttaagtgcaagcactgttattatgccttcaatgtatttaatatccatgtatctattctctctaattttgtcattttgtgttctcatgtattttcattcattatgtgtccaacttccatggataacatggttacaacaaaagatcctactttatgacaattatcttccttgggtttgtgggacatagaacagtgctcagagtaggggatccaagaacccaggagaatatattagctaagaagataacttccgtttttaaaagtccaagattcaggagatcaaaaccatcctggctaacatagtgaaaccccgtctcttccaaaaatacaaaaaattagcccggcgtggtggcaggcgcctatagtcccagctacacgggaggctgaggcaggagaatggcgtgaaccggggaggcggagctggcagtgagccgagatcccgccactgcactccagcctgggcgacagagcgagactccgtctcaaaaaaaaaaaaaaaaaaaaagtccaagattaaaaaaaaaaaaaaaaaaggatgtctgctttgtgagtttagcattgtctccttgtcattccagaaatgaaatggcaaatacatttaaatcagaactaaaaaggggaacagggtataaaggctcaatttagtcacatcatttccgtttctcacccaccccctttaaaccagatgtttgccaatgcattaacaatgcagatgtttcctgaaagaaagtttagtaactcaagcagacaccttattttcttttcaagcagaaaagactatgagatggtggttgtggttgttccgggagggagaagatataaatgatacacattatttcaaatcatttcatgacctcactgcacacttatagttattgtacctgttgtctttttgctgtcaagcctagctaagatcatttggaatgttcaagatcactcatacatgcatgtgcacacatacacatgcacatatgttcactccctatttcatccacatgaactaagattactgatgtgtacagattcaaagcacttttattcttttccaaaggcaagaagctgagctactttccagaatagttgtgaaagaccctgtcatacttctgcattgtttcctccacaccacctccatccagttccttatgaatggttactggttttcaaaaatatgagataaattgagtgtataaaagtcatttttagacaaaatgaaacaggaaatgaaagaaaccagaatctctcctcatttgtggatgggccagctccaccatgtcatggttaatctgcagggaggaaatactagatttgattgcagatcagactgcagcaaacctgctgtgactaaggcatcaagagaaagcaagcaacagctggggcttcagtggtgaaaacattatatatctagctttgaaatatgaaatactgtttagcagtgtcacctagaaaagagtgtttcaaaatgctgatgcttcataagaacctttctcttcagagttgtttcttttatctttcaaattagccagggtgggaaataaagtgatcacttggtgaagaaatctcacaaagaagaacatagagagttcactttcatctggagtaatgaacagattgaacaaactagaaatggttagtctgttaaagaaaaggtgtaggtgagctgtttgcaagagccacaagggaaaggggaagacaacttctttgtggacttaagggtgaaagttgcaagcaggcaagacgattctgacctccattaagaaagccctttccaaccaacaaccactgggttggttacgcaggttgggcagcattgggagcaaatgttgattgaacaaatgtttgtcggaattgttgacttaaagagctgttctgtcactggggacagcagcggctagatagccccattcagggagagggcatttgttcacctggccagagatcagagcaggctaagggactgctgggatcctgtccagctttgagaccctacagagccatgttcacctagcacgtatcccgtctgcggtcacgctcatttcttaccttattccagggctttcacctcagcttgccaggctggagccaagggccaacgcagccgcgccttgttcgcgatggtagcttcccaggagccccctatggttccggaacggcgctgccggccccatcctgtttgctacctcctaaagccaaaggcactggcgggccgggccagcttctaaagtcgcgcaaggttagaaggttccggacaggaacggcgtgaggccaatggaaggaggtacttcagtttccctccagatgcccagcgatgggctcagagctccttgagaactcgggaaaggaagcagggtctctgaagaaatacttcaggagtagaaagaggaagctagagggttaaatgcactacacaggaacagaaatgagtttttcttagagttagtatatgtctagaggtgtagtaaactaaaacaagtcttgaattgcataccgccacgtagggaagaaatgaaaacctttgaatattagtgaaaaaagggaaactgcaacgcctgtattactagatagctttcatcaacagctcaaaaccgacagatttaaagaagcaacaccgcattttggctttctaaagctttaatttggtttggatcccatgcccatgaccctgccagctgacaattctaagcatgcgcaaactggccccaaaaattcctcccacatttccgaagaactatttggccctttatgtgaagtacctggtttttccattttctgttttaccataggcctcagttcggtgtgtggcgtatttattctacatttaacaatttgaagatcattctattagattaaaaaaaaagaatacaatggaagccaagtgattaagctttccttatgcttatattaagttgtagcatatgcatttaccgatagttaaccgtattaacctacagaaaatgtccagggaaatggtctatttcttattctatttttgacctaaagaaaatctttaaaatgtcttagcattttccccagtctccatccactttcctcagctttggcctgaagctatctttaaaggtaccctgtacagctcttgccctgtacagctagctacagagattcaatcctttctgttcgattaggacacatctcagtggcagataacatgcaaagttattatatgtatgaaccagaacttgtttttccttaggggccaggatgttacactaaggtcttaagactatagtaatatcttcacttgaaaaagccctctattattcctatctcagatgataaaaattcaattaagagaaataagaacgtgacatgtgtaatcgcacctggctctacaaagctagtctggacagacatttaaacaattatcctctaagattatttgatgaaatgcatttcaatgactagttaaccattaaaaaccaaagtgagcatcccatctgttcccagtcaaatgacctagagcaaaggactaggcaaaccacatctgtgggcatagcaagctgtacatcacaaacaaatgaatttgctttgtatatgagtgagagcaaacactctttattgtacaacttgggtgggtaagtagggagaataatggttttactgaaatcgcaggtaacggttacgttggagttaaaggttaggaagaaaaccaaagggtaagagctgttgttctgggctggcattgtcaatgaagagcataaattcagatgtgaatgtatattttgtagaagcatgtgtgttgttggtttttgtgtatgtgtgagtctgaaagagggaaaacaggctcccattagactatgactaacaaaaatgtttgacagattataactcagatgtcttactcagagcatatgccttcccattttccccattattccccaacatgatgtctttaagaacttgtccttgaccgagcagacatctcataccccaaatagctaatattttgatagctatgatcctgaacggccaaacattccaaaaccaagtagtttgtaatatctttaaatgcaaatatattttaggccttttccttggcaaggatgtttggtcaggggttggcaaaaataatgctcttcagacttaaaagaacacaaccatatttcttagccatccaccagaaagtagtagaagctccaggaagcaagtctttgtcaggagtcagactagctacatcataatctctctgcccaggggctgtggatgtcatccatcctggcctaactagcctactgagctgagagatgtccaatttccccccaatacactaaccagaggagaaggaccgtgatatcattgcatgtgaattcttaattccaattgcttaaacaaatatgttcagttgtaactatcaataccagtatataacagtgttggccaagttttattgatgctgacaatcaattggagttacagccagacacatggtcttatgaccggcgtacttacgcagggctttgcactgagacaggtcgtgcatctgaggtttactgctttgcatttttgttttgtaactgaagtctgatgagacagccagagcatgtgctacctagggacttgaatccctgcagccccatttcacttctcaccaccttccggggtggtttctcgacctcccactcccctaccacctggtgccttagccagccctggctctccctccaaacacctgcccaatgagcactgccaccccatggtgcccagacatgctctccctcctcatccctacctagctaccattgccactcccctcccccagcggggacatgggcataggagcagggagagttaaggttggtcaggtgcacgtgccctatgctatcttggaagggggcttggccatgtggcatctctggaccaagaatgcgccacagcacatttggagggtgaatggtgggggcacaccccttgtccacctctatttcaggcatggaacacatcctggcatgaaagttgcagtcccttgggaatcacctctccaccttgattgccacagtaggccagtgacaagggaagattgacacatcatcccctgctggggcccagtgtcctgtggctggcaggcaggggatcctaaggacatgtgggtgttaaattgtagggtgcacttcctgggcacctttgagggtctgcactgccccagcaaatatccccatgctagaaggagcaaaatattaaatggcaaattttaaaaatgtaacaagatgggttgcaaaagagactacagaggaaagcaaaagttttgtattttagtatcttccatggcacttttcttcctagcttttgaacaaggggccccacatttttatttctcactgagccccacaaagtatgtagccattcctgcccggagtgaggacttttaaaacataaagattatcaagtcttggaaattctgattcagtagatatataacaggtctcaaacttaattatgtaaagaatattctggagagcttccttttacccagtcccacccaccaaatattctgataaattaagcttcgattagcccccagatctgcattttataaggatccccagatgattctactgcaattggtccacagaccatgcctggaccgaatttgggtgcttaggagcacaaattctggagccgggcagacttgagtttgcttcctagctttaccaactgatctcaggggagttaatgtttacctctaaactttagctcatgcatctataaataaatatattaatatcatgtcataaggatattatgttgtattaaatgtctttaaaacaccacaatgattagcccaaagtaaacactcaataaatgttcaaaaatttaggaaaattgttaagactgggttgtatgcacactggtgtttattatattatgtagttttttctgtatttttacaacatttcagaattaaaagcaacagctagaaaaagagggaaatggccgggtgcagtggctcacgcctgtaatcccagcactttgggaggccaaggcgggcggatcacgaggttgagagatcgagaccatcctggccaacatggtgaaaccccatctctactaaaaatacaaaaattaactgggcatggtggcatgcgcctgtagtcccaggagaattgcttgaacctgggaggcggaggttgcagtgagccaagatctcaccactgctctccagcctggtgacagggcaagactccgtcaaaaaaaaaaaagagagggagagccagagtatgaaaaaggaagtcagagccctttaatgagtcagctttgtaggtctccaggtaggaggctagtgcttcagtgtctaggacatagtaggtgttcagtaaattaaattcaggacaaaaagaacatgccccaaggaccatctgatatccacttaaagtgatggactacctcgtttcccttgtttatgaatgggttcatgcctaagactgtgtgcactttaatacaagggcagtcgttcagaactagtcaggtcctgaaaaggatttaccaaatgttgagtgtgccctctagtgttcacacttcccagctttcttcctataaaggtggatcaaggcacttgcttacaactggaactgaaatcctccaagtcgatctagacattgagatggagaaaatattcattgtcgactgtaattatgcaacgaatatccagttgagataatggacttgcctcttatctaataatacccaggctcaatgcgtcactgctttgtccactttgcccaaaattcaagcacagctaagttgatattttaggacaaaggcagcttactatccagccagaggggagtagaatatggttaagagagagtggaaagaatgaatgagccctgctattcctcactgcctggatggctataagcacagcccttatggaggccttaggtcttgcttcataatattccagtttgaaaagggtttgaaaagacctcctagaaaaatcagtagtttttctcttttgagtaacatgtagcaaaaaaaatttcatcatgtaggtacagggaacaccctaataactattaatctcaaggagtcaagccagtgtgtttcctaatgtatctgctgtatccccatgaagcaaattttgccatcagagaaactgactcatggggaaaaaatccaaggacctcaaatcaccaaaagaagccattcctcagatttgcctaagcttaagcttccctgtctctcattgtgtgttgctttcaatgcagttacataaatggcttttttgtttatgcaccaaaaacactaattcatctgcaaagctcacatttccagaaacattccatttctgccagcacctagaagccaatattttgcctattcctgtaaccagcacacatatttatttttttctagatcaaatgtattatgcagtaagagtcttaattttgttttcacaggttgttttgaatggtaaagttgatgcattctgtggaggctctatcgttaatgaaaaatggattgtaactgctgcccactgtgttgaaactggtgttaaaattacagttgtcgcaggtaaatacacagaaagaataataatctgcagcaccactagctctttaatatgattggtacaccatattttactaaggtctaataaaattgttgttgaataaattgggctaaaggcagaagggtcataatttcagaacccacgtcgcaccgtcctccaagcatccatagttcttttgatatacccctattatcactcatttcagtgaggtacaattagttcttgatgtagccatttccataccagaaggccttcccaaaaatcagtgtcatgtcaccgatccttttatctctggtgcttggcacaacctgtagcaggtcctcagaaaacaaacatttgaattaatggccaaatgagtttgtgctcaaaaaaggggtgaggatacttgaaatttggaaaatctaggataattcatgactagtggattcattatcaccaatgaaaggcttataacagcatgagtgaacagaaccatctctatgatagtcctgaatggctttttggtctgaaaaatatgcattggctctcattacatttaaccaaaattatcacaatataagaatgagatctttaacattgccaattaggtcagtggtcccaagtagtcacttagaaaatctgtgtatgtgaaatactgtttgtgacttaaaatgaaatttatttttaataggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccgtagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 3902 - DNA, 31306 bp, human
tgcagcgcgtgaacatgatcatggcagaatcaccaggcctcatcaccatctgccttttaggatatctactcagtgctgaatgtacaggtttgtttccttttttaaaatacattgagtatgcttgccttttagatatagaaatatctgatgctgtcttcttcactaaattttgattacatgatttgacagcaatattgaagagtctaacagccagcacgcaggttggtaagtactggttctttgttagctaggttttcttcttcttcatttttaaaactaaatagatcgacaatgcttatgatgcatttatgtttaataaacactgttcagttcatgatttggtcatgtaattcctgttagaaaacattcatctccttggtttaaaaaaattaaaagtgggaaaacaaagaaatagcagaatatagtgaaaaaaaataaccacattatttttgtttggacttaccactttgaaatcaaaatgggaaacaaaagcacaaacaatggccttatttacacaaaaagtctgattttaagatatatgacatttcaaggtttcagaagtatgtaatgaggtgtgtctctaattttttaaattatatatcttcaatttaaagttttagttaaaacataaagattaacctttcattagcaagctgttagttatcaccaaagcttttcatggattaggaaaaaatcattttgtctctatgtcaaacatcttggagttgatatttggggaaacacaatactcagttgagttccctaggggagaaaagcaagcttaagaattgacataaagagtaggaagttagctaatgcaacatatatcactttgttttttcacaactacagtgactttatgtatttcccagaggaaggcatacagggaagaaattatcccatttggacaaacagcatgttctcacaggaagcatttatcacacttacttgtcaactttctagaatcaaatctagtagctgacagtaccaggatcaggggtgccaaccctaagcacccccagaaagctgactggccctgtggttcccactccagacatgatgtcagctgtgaaatcagactgaaatgctgaaataacgataaaaaaaaatacagaggttaaactagcaaagtgagtaaagtcaagggataaagaaaatttgttggaaaactcacaaagcaggacataaagcaaggccattagatatatctcattagtgtgacatctgggaggacaaagcatccaaaccctttcttctatataagtggtgagatgatgaaggttgtaagagggcttctgcccccttgaagacttcagatgctggggaaaggatagataagaataaggatgaaccaggcttttggagcctgggaaataatgactagcgataaacctgaagggaagttaagtatacgatccccagataatactaaggagaaaggcaatgtgattctgcagccattgtagccagagataataagcccttgaggaaggggccaggggaatttttctaaggatagacagtattaatgcagcactctcttctgctattaaactctcattggcttctaaaaggagtttcggtgagtgatttgctgagatgttgcattttcatggctgctgcctttaggtattattgcaacagtttggaattttgaaattaaaacagttctgtaaaaccagtttagttttgtaaagtgtatgcatcaaagatgtccttcattcagacattactgagttacaactatggtgccaggtactgtgtcagggtactaggggtatggggataaaccagactccctctttgatctaaagcagcatgaggccaggtgagaggtttcaatataatgtgataaaatgtgcactaggtactaagggatcatagagaaaggaacacattaaatggggaaacaattgatagagagagaatattttcatctgggtcttaaaagatgagtaggcgttctctctctttaaatgtctgatataagggcattttatgcaaagaggatcactcgtgcaaagactcagatttgcaagaacgtgaggtatttcaggagttttgtatggttccatatggactatgacaagtgagacaggtaaactaggcagagctggtcatcagataatgaagtcattaacctaaggagattggacaataaaatgcaatatggaggtatcgaagtataaacataaggagtaccactgatggctgatttaggatgcccagtctggcaacacgctaatgaaatgatagtgggggagggggccgtaccaagactaggagagagcagtcctgagactattgcaattatctgcgggagacataaaggctagaacctgaacagtagcagtacaaaaaaagaggggagttcaaatgatattaaggaagtagaagtggtatgacttaaccatctgggtatggaaggggaaatggctagagtcttggggactttgtgtttgatgtgattatggaccacagaataatgtctaagagaactggctctttagtctgactgccagagtctgaatcctgaatgttttagtatgttaccttgggcaaagcccttagcctctatgaatctatcttcctcattcataaaaataagatgacagtgcctatctcgtgggacttttgtgaggatgaagtgagataatggatgcaaagttactgagcacagtgtccaacacagcagaagcattacatatacattagctattactggctacattatgatatacagttagggagttggaaagataatctgaaattcaggagacgtatctgactataggtgagtatttggaactcattgttctgtaaacagtagttacagccacgtgtgtgggcatctggagagtgagcatggatattgtgatacctagtacagtgcctggcagtagtggttgtatgctcagtaaattttgttgacagggtcagggccggactagactgtggtaagcaaggcctgtagggcataaatatacttgtatgccccgagaagtgaggacctcttaaatattgtgccctacatgccttgtttggttcactcttgtcccagccctagcaagtatatataaggtgaaaaaggaaaaagctgaggctggagcctgggagaaccctggacatttaagggccatggagaggaacaggagttaatcaattcaagtgctggatggataacaggagttagagcaaagcggggaaccagaatagagtgattattataaaaagagtttcctaaaaagggagagatcaacaattagaaattatttagagcagccagtaaatacataaactcaaaattattctttaggtcattcctgattgtgacaatagtcatttcattatataaatgtgattaaggaaggaaaagagctacacagaagttattaaagagctaaagagaattgagaaatttaaaacagaagaaagtagggccaacatgaaaggagtagggagaaaaagagataaccagcatattgtctcactgatcctgccaacacctgtgagatagatattcttattatactactgttaaacctaatttacatttgacaaagttaaggttcagagcttgtgtgacttgtccaaggtcacaggtctagaggaggcagatacttgattcaaacctatttctgtctgatctgattctaaagtctgttttttcactcaaccacactgtacagtcagctctccttgtgagttccacagccacagattcaattaactgcagatcaaaaatattcaagaaaaaaatggatggttgcatctctactgaacatgtacagactcttttatctttcattattccctaaacaatacagcataacaactatttacatagcatttacattgtattagctattaagagaaacctagagatgatttaaagtacaaaggaggatgtgtttaggttatatgcaaatagtaagccatttttatatcggagacttgagcatccacagatcttgatatttgcagggggtcttgccaccaattttccatggatactgaggaacgactgtaaatggatgcaggcatggatgctatttaggagtgtccagggccaagtaaatgagttgctgagcagagaggtgggtggaggctgtgaggcatcaatatgtggtggcatccatctgcattttggtgatttttttccttcacagtcctcggctgtctgggaagagaaggatgaaggcagatggctgctccaatttaggggctaggattgcagggtgggcacagcattgcaaacgagtgaaggaaattgagaaatatggccaatgaagagttgaagagaggcctggcatggtggctcacacctataatcccagcactttcagaggcccaggcaggcagatcacttgaggtcaggagttcgacaccagcctggccaacaaggtgaaatggtgaaaccccggctttactaaaaatacaaaaattagctgggcatggtggcgggtgcctgtaatcccagctacttgggaggctgaggcaggagaatagcttgaacctgggagatggaggttgcagtgagctgagatcgcaccactgcactccagcctgggcgacagagcaagactctgtcaaaaaaaaaagagttgaagagaaaaagtctaggctaaattcaaagaaaaaaagtgagcccaaaaggaacttgcagagcaagggaaaagcagggatgtcaagggactagaacactccataaagtgaacagctgcaatgaaaataagggaagaaagtttagttcatctccgtttctttcctttcctttttactttcctttctcttcctttttggagttaatcaggaagtagtcccaaataccccagaaagttcatcttataagcccttggtcctcttgagatggtatcagatatattgctagacccttgaagaaaggaacaactccaggcaacttcttgagtccctgttattaattttatacatacacacacatatatgtatatacatgaaaacacacaaacacatgtgtgtgtatacagccatgcattccttaacaatggggatatattctgagaaatgtgtcattaagcaatttcatcattgtgcgaacataatagagtgtacttacctaaacctaaatggtatagcttactacatacctaggttgtattgatgtggcctattgctcctaggctcctgggctgcaaacctgtacagcatgtgactgtactgaacactgtaggcaatggtaacagtggtatttgtgtatctaaacatagaaaaggtacagtgaaaatacagtattataaccttatgggaccactgtcgtataatgtggtccatcattgaccaaaatgtcattgtgcagcaaatgattatctcatatatatatatatatgatatgatatatatgatatatatgtgtgtgtatatatgtatacatatatatgtgtacatatatgtatacatatatacacacacatatatatgtacacacatatatgtatatatatgtacacacatatatgtatatatatatgtacacacacacacatagagagagagagagaggagaggagaggaaggagggagggaaggagaaatatgattcagatagagacatctatcctccagagttcaggagtgtctcttcagactaggtagatgtagcttaaaaaaaacatatcctgaattctagagagatgcttaaatcactgcaattcctataacacttgccaaccaaaggtgctgttgatctgaaattgcttttttaaattaatgcagtgatttttctttaacatctagtgacagacactggggtcacatttgcagctggaccataattaggcttctgttcttcaggagacatttgttcaaagtcatttgggcaaccatattctgaaaacagcccagccagggtgatggatcactttgcaaagatcctcaatgagctattttcaagtgatgacaaagtgtgaagttaaccgctcatttgagaactttctttttcatccaaagtaaattcaaatatgattagaaatctgaccttttattactggaattctcttgactaaaagtaaaattgaattttaattcctaaatctccatgtgtatacagtactgtgggaacatcacagattttggctccatgccctaaagagaaattggctttcagattatttggattaaaaacaaagactttcttaagagatgtaaaattttcatgatgttttcttttttgctaaaactaaagaattattcttttacatttcagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacagtgagtatttccacataatacccttcagatgcagagcatagaatagaaaatctttaaaaagacacttctctttaaaattttaaagcatccatatatatttatgtatgttaaatgttataaaagataggaaatcaataccaaaacactttagatattaccgttaatttgtcttcttttattctttatagactgaattttggaagcagtatgttggtaagcaattcattttatcctctagctaatatatgaaacatatgagaattatgtgggttttttctctgcataaatagataatatattaaactttgtcaaaaggactcagaaagatcagtccaaccctctaacccatattgaatggtgatatactacagggttatgccagtgtgggaactatcgctggtaaataagtttaatcctccctagggcttcacaaagaacattgttccaccccaggagggtggaaggaagaaactgaaatgattgtgtcttagaacctaatgaaagtttgcattcctcagtaaaatcagagactgctgattgacttaaatgtttatagcttcaaagtcctcctcattatcatggcccacaagcccttccatgattgtccttccccaccctccccattacccttcttgcctcctctgctacttctctcctcgcacactgggctccagccaccctggccttcctgtcacttcttgcacactctaggaatgctcccactttggaggctttatctggctgtttctcttatttggctgttcccaacttcctgtgggctgactccctcacctccttcgggtctttgcccaaatgttaccatcttaatgaggcctaccttcaccatctattaatacttcaacctgccccagtagccttaccactctagacacctgtacagaactccactctactttttaacagagcttttcaccatctaatgtatcatataatttcttactcatactatttatcatttattttctcctactccactaaaatgcaagtttcatgttggcagggatattcaattgttttgtttattgatatattcctagcacctagaacagtatctggaaaagaggtactcagtaaatatttatcaaatgaattgaccaaaagaaggaaaactcaaaactttaatgacaactaactttaaagctacaataacttaaaattcagcagtaggattttgagggagggtaagtttcaaagattgacttacctaagactatctgcataaataaaaagaaattaatccagacaacaaattcaccaacttccatcaattggaaatccaattctattttctacagtttatgttctggagacactactggacactcttttactctcataactcataactcctccacttttgtttttaaatcatgagagaaaaagagttgactctgttatattgttttatctacctttccttgatcttagaaacgaatactaccataccagcttctactgaggtgccccctaaagttagtccaaataggtctttgcaatctccattcccgcagaatttagaactttgaatcacatgatttatttctaaaagtaaatccatgccgattttccccaccaaaaaattcctgactattaaactcctacaatcccttcattgctcactccccacccccaggatcatattttaaagttgggcccttgccttttgggtcacataggtacactgtttgctataccacaggtatagctatctggaaaacatggagggtattattctgttactactgcttcgtcaaccaaaaaataaaacaaaacaagaacaaaaaagaaacaaactccctgcctcttttcacttgcagtcaaggttcctaaccactacaaaattagcctatgtttcttcttgcacatagtagaaacccaagcttctcactgctgtgctattctgtaccatcaactcatcacataaagagcctggttgaagaatgattgtccaaccacattactagcatctgtcaagactttccagtttacaaaaggcctatcacatttaaccctcacaccatccttgtgaccaaagcattattaactccattttacaggagagtaaactgaagcttagggaagttaaaagaactgccaaaggtctcccagttggggagtcatgaagcccagaagagaagccaaattctctgctgctcaaccccttgctttcactattacacctcagggccttcaaatctaaatgcagttattcattaaacaggaacctggtagtcttaaacaggaatctctcacttggtaagatcttgtctcttgttgtatttgaccccaactgtctatggctttgcctgaacccaaagtacacacagcctagaaaccaaaggagaaccaaatgtgggataaaatgacactcattttaacgacatgtctcagcaaatgagttcctgtgtagctggctgaaagcccagaccctttcagtaaaacatcctgaataattcacatttgttggtctataatataaagggcaaatgtagctcatttttagaccagttctgaacatcaatagtaacaaaccagagataaccgattttgttttcatagaattggaacaaattagagtatctgtgcaaaagcatatcagatctaggagcagaggggacaaggtctaatttttaaataagcaaattttccagggagggactacttatgataaagggatattagtctcttagtcaacggaacctggatacacgcttctgacagagaagagggagaataggcaggaatctacacaccagatgtcaaggagatttgctttaaaatacgactgataattagaaatttctcagtttcccccttttccctcattctttgattcttattgttatctttatctcttactcctttgtttctcatatattgagtcttacagatcaagctcctatttttttcttcaggggtatttttctagttcaaagtgcctaccatctcccttctggttctattcatccttctctcccaaagctcctttagaagtgtggattaaggcagagcactaagaaaccagacttaaagattcccttctcattctgacttttctcctttcacctattccttcctcctgttttcttaccatcagtgtcttcaaaggctttcaagtacacggtaaatgcagaaacttcaagaaaggcagaatggaaacataaccaatgcatacataaataaagcacactgtagaatctttttaaattctgtatgatatatcgaatgctgtctctcacattacctagaccatttgaaaccgaatttgtaaaacatagactatctttaagtagtaacagatgcttctgacatgttttctattgtcttgaaccattactgcatatgatacatcaaagttaagtgacaatacaagaaagcagattcatttgctccctgcctaggccgtcagttcctaaagtggaaacgccatatattatctagctcagtttgctctacaagacctgcaatagagccttgtgtgacatagagataatatttgttgaagcaattaaatttgacttggaattaactctgccatcattctataaggaaggattgaaaatccttctcaccctgtgctgatatagtacctttctatacaaaaacgtccttctccctcttcccttggattgcataaactatgtacatgccttcctcagggcacttttctaggacagtgtcagcctaaggatctttgtttgggtggcttttagaaactcaggaagacaggagcatcatatgcctataggcagctggcttccaggtcagtagttttgctctgaccctaaaatcagactcccatcccaatgagtatctacaggggaggaccgggcattctaagcagtttacgtgccaattcaatttcttaacctatctcaaagatggagatcagtgtgagtccaatccatgtttaaatggcggcagttgcaaggatgacattaattcctatgaatgttggtgtccctttggatttgaaggaaagaactgtgaattaggtaagtaactattttttgaatactcatggttcaaagtttccctctgaaacaagttgaaactggaaaatgcaatattggtgtatcataatttttcttaaaaacatacctttgatgcttataaacatttcatttgtagtgatagttttcaggatatgagttcaagaagctacattaaaatcaataacaatatttggtaactaatattaagtaataatgatgttccactcacttattaatctttaatacaaccgtatgtggttagtactatcattatgcgcattctatgcagatgagaaaaccgcaactccaacggccaaaaattacagaggcataaatggtttagacaggacttaaacttcagtgtgaccaaaacccatgcttctaactactatattcaaaactcagagaaaactgaacccagaaaattgaaatcatgactaaattgctatcaacataggtagtgaaagtcaattaagtacagaactggagtatgactggccaattatcccatataatgggaattctccacatgtacaaaccacttcatatgctaaacttgttgacaacattcaaagctcatccctgaatttgactatattgattacatcaaaaatgttacatagcaaccttagaatccttgtgtaccttttcttctcaaagcctagattatttctttttccgacgtttcagtaattggagcagtaaaccccagtgtcccttacctacttgtttattacctccagatgcaatattactggtactgtgattgagaaacgcacacagtgctaatgaggaattcactttctactctgacactctggaagaatagagatgcaatcctaaggaagaatttaacaccacaggctacatgactaaggataaagagtagaaaattagcaggactctattaaggcattacagcaatccacctgacagatgaaaaaggcatgaaatgaaatgaaatgtagcagctacactcgtcctattgagaaaggaaaaaagtcacctgtaatgttgttcagaaatcctttcagtactaaaaaattcattgaccatcttcctttagtctcgaaaatttcttagaaggtaaaaaaaggaaaaggtgacagggcaaagacatttgaaaagaaagaaaagagtgaatgaacttgcacacctggcttggactcccattcccttaggtttccattgtgggggacaaactaatgcctgggttacctttcttgagagtgtgttaattgattcaatatctctgaagtgctactttcatctgaaaggttataatttgaaattcagatttacctggataaatttgatcttgctattatggaaacctctagaaatccttggagtagttactcattatcagcttaaataatatagccggtggagctgagggaatgagtaactcaattagtctcagttacaactgaagggcacattgttgtaaactataattgaaaacataaatatctttacctagtttaaaaataaagatgctttaaaaggaggaagggaatagccctgaggaatgtaaatataagcacaaaacttctacaacagagtttgctacgtgtgtggctgtgttccacccagcaaaaatgctaagtctacaactgacacaacttggatactctcatgttcccacattttggtttggtcaaggctgtgcagttgtactgcagccaccaccactcctggcctctacagtatattgatctgacccaccaatctgatcaaggtttagaaaaatattttcagcccagttagctcacaaacaaaatgagaattcccacaaattgctctttatctcagacaacagaggaaagctacagcaaaagcataaacaaattaccatttaagtttgttgcttcaaattaaagactaattgcaacagctactagatagcacagtttatggggcatctcggccccaagtcttttgtcttataaggtcttgaaaaaaagaaaggagattttcatcaataagagttttttgttatctttttcccttgttcatcaggcccttcactgcgagagagaggtgtaaacgttcagggcatgcattctagttaaagaatattaattggctattgggtccctttggttagaataaagacctctgtatgatgtccctagctgtacatcaaacccaaatatctctcagataaatgaaggtctgtaagaatttggtcattcctgtctcttctaaagagtaacagaggcattttcccgcagtaaagtagaatggaaagaaaacaaaaatcacaagcctataaacaccttcttcaattttcccagcatgtcacagacactactgtcttatttactacgtatttctgaggagtaaaaaaaggaaatatgttgagtttagctgaagcacagcatattttgtggtaaacttgttaaataaaacatcttttgtccaagctttggttgtcacacaagtggatatatcaggaaatataaaggcagaataaactaaagcagaacatactaacatttgtagtaggcatgaagggaattagaaagtgtttgtgttaacatggagggagggagaacagatgctttgagatgttcttcaacagatattctaggcactgagacccccttcgggaccagagagagcccatatccaccacagtacctgacacataaatgctcagtaattgataaatgagtcccattctaactgttccttagccctgctctatggaactctcccctggaattccttgtgccattattttatttctggaatcttcagccttttagctgagggcaaaagattgctgattaggaagcaatatttcccacctcctgcgcaaaacaagccaaagatcaacagcagcagcaacatactgagccctaaagggcaatgacaaatgtggagaatgatacagaggtctggttacttcttagccaatgacacagaatcacaattgagaaaacacagagtttattcattcccattgtgcatgccctggacaaaccaagctgcacctttcgtaacttatcacaatctcatattgacggaacactttctacaggtaatgtttgatttggctgaacactttagcattgcttcgtagcaacaaaatgatagctagtaacagaaaaagatccagggatattaccactgttagtgaggagaaaggccttttaattaattaattaattaattaataggaccaagtgccatctttttggatcatgcccttagtggattattggtagcaaaggttaaagctcaagctggttcctttgtccccctggcaacagttgatttgcctccctttatctcctgaagtatccgtaaggactaagagccaattattacatttggctatgctagcatatgtaaaatagagtttaaaagtttagattcatcactcaaaaattcatattctccaaaaccatacagtcactctgttagcctgtgttcccccagaaaaaaagtcacaagcttatttattaacatgtgcaatcccagggggcaagagaaaggaactgaagagtgaggcagaaaggaaaagaaagccaataagaggatgagttatcaaactactcgtttctaacagcaactgattgcttaacttcctgggactgtctccaataagtcaaattggcctcaggttagtccacctgagtgggaagaagcggtgaaagaatttgtctgtcagtatctgtctctcattggttagaagttcgacttatggggaattaactccctcacatttcctagttggatatgcttgggtacccagagggtcatatggcatccatgcctcagcatgaacagggaagcttcaaggcaaaagacacatagtgcagctatgagccaaggcaattcaaggatacacccataggaggctggttgacatccacccagagctaatcaccaccatgctggaaaaagacacaggtgaagctgagaagaatgaaggtggtgcataggaggtatctaatacagtcactcattttcaaactttccatgttatgattgcactgaccactgaggatttctattgaaagttttactgttgtcaaacacgtacacaaggggaaaggtgtcttacattgtttatgttcctgtgctgctctagaaacagaaataggctcaagagcagagcctgtttttcttaattcagcaggtctaagctaacaagtcctgaaacatggtacttcctgttattggtattgcataggagaaacaaagggaaagcacagtaattagaaaatacaaaacaagatggcaggaataagccaaaaatatcaggaaacacaattattgtgaattgggattaaactaatctattaataatgacaactttcagcttggagttaaaaatttaattgtatactgttaacgaaagtgatacctaaaataaaattacactgggaggccaaaatgaagggatgtgaaaagaactatcaggtaaaaactaacaaaaagaaactagcaaagcaatcttaatatcagacaaaatagaatccaagaggaaaatcatttcaaaagacaagagattttttttattaataaggggaattgcataggagagtaaagaaaatgtgggccactggaatgcttagcactaatgacatattggtctttggtcttcagttaccttacaggaccctatttcattctcttatgtttgatatgtaaccacctcagccagcttcaagttgctttttggccctaatggacttcctagcactataatttcttttttttaaatgttttattttaggtttaggggtacatgtgaaggtttgttacatagataaacatgtgtcacaggggtttgttgtacatattattacatgacgcagatattcagctcagtaccaaatagtgatcttttctgctcctctgcctcatcccaccctcctccctcaagtagactccagtatctgttgtttccttctttgtgtttataagttcttaacacttagctcccgcttacaagtgagaacctgcagtatttgatttttgttcctacgctagtttcctaaggatgatagcctccagctccattcatattcccacaaaagacataatctccttcttttctatggctgcataatattccatggtatatatgaaccacattttctttatccggtctgtcattgatgggcatttaggttgattccatgtctgctattctaacactgtaatttctaaagacttccagattctacttttataggtaacctgttaaacagtctagctctggaagccaagcaatttctagaataactaagcaatagaaattacacttcaatgcagaaaggcagtatctacatgagattatgaaattgcggttgctttttgtgttcactgaaaaaaataagtaaaactgtaactttcagaaaaaatgattgtacatatagaaaacccaaagcatctaaacaattaaaataaataagtatagaaagattactggatacagagtcaacatacaaatatcaattgtatgtctatataccagcaacgattcaaaaatgatttttataatagcattaaaaattagacgcttagtaataaatgtgagaaagatgtgcaagaactctacataaaaaattatgagacgttattgagaaaaattaaggaaaacctaaataaatgaatgaataggcaatgtttatcaattaaaggatacaatatagtaaatatatcaaatgtttactaatggattcaatgcaataccaaagtgcccagcaggctttttttggtggtgggaggtcgggcaggattcataagctaattataaaatgcatatggaaatgcaaagagccaaggatagccaagacagttttgaggaagaataaacttgtactacttacactaccagatgtcaagacttattatcgagttacatttattaagacagtgtggtactgacacaaggatagacaaatagatcagtgaaacacactagagtgctcagaagcacacctgtacatatataaaggcttgatttatgatagaggtgccagtgcagtagagaaggaaattattggtgttttcaataaaaagtgataggtcaattagatattcatatggcatgaagtatgaaacaataacaatttatattcataacttgcagaaagcaaaaatttcttaaaatacaaaaagtgatcaccataaaggaaaagattgataaactggactatattaaaactaaggactcctgttcagcaaaagacactacttcgactgaaaagacaagtcacagagtgagacaagatatctgcaatacagatacctaataactgaaccccatacagtgatggtgggaatttaagttcgtacaatcattttagaaaattgcttggcagtatctactagatctgaacatgtgatccagtaattacactcataattataagccagtaaaaaggcatgtttatgtcaccaaaagatatatacaagaatgttcattacactattatacataagagccaaaaactggaaacaaaccaaatatccattaacagtagaatgaataaataaaagctgtaatagtaatacagtggaatactacacagcaatgtaaatgaactactgctgtacaaaacaacatggtttaatctcacagacaaaatgttaaatgaaagacacagacgagtacatattgcgaacttctgtttataattcaagaactggcaagaactgtttactgtgttagaagtccaggtaatggtaacctataaaaaggaaaaagggtggaatgattgggagggggcatcttctggggtattgataatgtgctatgtattggtcagtttagtgtttaaacaggctcatttactttgtgaaaacttacactaaaattgtgtgtattttttgaatatatgttatacattaataaatagggtttttaaacctgtagttcataatttagtgaaagtagaatatccaaacatttagttttaaaccaatcaattatagtgctaccatcatttttatgcattattgagaagtttattttacctttctttccactcttatttcaaggctccaaaatttctctccccaacgtatattgggggcaacatgaatgcccccaatgtatatttgacccatacatgagtcagtagttccatgtactttttagaaatgcatgttaaatgatgctgttactgtctattttgcttcttttagatgtaacatgtaacattaagaatggcagatgcgagcagttttgtaaaaatagtgctgataacaaggtggtttgctcctgtactgagggatatcgacttgcagaaaaccagaagtcctgtgaaccagcaggtcataatctgaataagattttttaaagaaaatctgtatctgaaacttcagcattttaacaaacctacataattttaattcctacttgaatctgcttccttttgaaatcatagaaaatatcagtagcttgaattagaccaattaattttctagattgcatcatattttaaatataaactatgtaatcatctacaacctgaattctttctgtgtccaatttgtccaatttttttctctaacatttatatcacaaagcaattaatttgtgtgatttctgcatatgtatttgtaattcatcaagtcaaatcaatgtagtaatactatatcataaaatatacacaaataattgagtgataggcttctagtataaggacggtaagtttgaagcatgattctatctgggctggctagtttactctgagaaagttattttttattgttgggtcttaagctgagtttacacacttggtgtcagaatgattccggcaatgaactgttttatgttctgctaggctgatcagcacaatctatatggctgtgaacaaaacaatgtttcccagtcatgccaaccatgccaccattttaacagctgattagtgtattcagaacatctccactccatgttcgtatggctgttatctaaagatgaaagcagtagacacttttattttttgaaaaatttaggctctgcagggtcaattatatttgataaatgaggggcttttttgaagcaaactagatataatttcttttgcatttctaaagcctgatatcttattaattggtacattaaattgtgcaccatttctctgtaactgtttcagtacctgtctcagcactataccaggcagaagaaattaaagaaagaaccagtgccgagatcagcttggtcagggagaccctaatcctgcggcactagaggaattaaagacacacacacagaaatatagagtatggagtgggaaatcaggggtctcacagccttcagagctgagagccccgaacagagatttacccacatatttattgacagcaagccagtcataagatttactgaaagtattccttatgggaaataaagggatgagtctggctagttatctgcagcaggaacatgtccttaaggcacaaatcacttatgcaattgtctgtggtttaagaacacctttaagcagttttccgccctgggtgggccaggtgttccttgccctcattctggtaaacccacaaccttccagtgtggatatcaaggccatcacgagcatatcacagtgctgcagagattttgtttatggccagttttggggccagtttatggccagatttggaggcctgttcccaacaaaccagaagctaggaatatatatcctgcaaataaaatgaagaatctctaaggcttcagggcctgcccacttgttcttctgcctggttcttcacatacactgtctcaaagctagtctaccttgagaggagcatgaatatgtgtgtgggtgtgtgtctgtgtattttaaccttaaaaacctaacttccagtatagacagatggcatactagctaaacccttacaagttcttctatgctataaaagagaaacagaattgagaaccacctccaactattaagtgttatatttgaatatagccttagctttagcagaataagtaggccaaacttaaaataagcttttctgccttttcaatgataaaggtcccttttctgtagccattgttgattgtgtacacttatacataagtattttgaactaatttcctgttttctcaaccacttgctgtcttcatgatactttgtcgcagctggttgctatagaaatgtctgttacaaggaatgtggcttgaaggaaagtgataaatgaaaatgaaatgtgaagtgactttgtttgactacaaattcccattctggtagtccccagtgtatcaatacattatttttctttagaaaataaaccaacccaaggaaaaatggtgggcaggtcctggtgaatatggctgtgataattatattagcaatctctttggctaatatttgaagcccaaataattgaatcacaatgatctctccccagaaaatatataaaatgcaccttggaatctagaaggccttttagtctgcaaaagaaaccttcttaatcataagcagcagaagtcccatttaccaaattggaaagttaaagttacaaagcatcaatcataagacttccattcagggatggcaattgggagtaagactttttagtaaagaaactaaacacaaagtcattagactctgtaaaagtcttaccaaatttgattctggaacacctattctatttccgtaaagatgatgaattccggagccaaatgttcttttcatgaaggatttgaaaactgtccatgaaaataacgcaatcaaccttttagcttgagactctattcactgattagatttttttaaatactgatgggcctgcttctcagaagtgacaaggatgggcctcaatctcaatttttgtaatacatgttccatttgccaatgagaaatatcaggttactaatttttcttctatttttctagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggtactttatactgatggtgtgtcaaaactggagctcagctggcaagacacaggccaggtgggagactgaggctattttactagacagacctattgggatgtgagaagtatttaggcaagtttcagcactaaccaatgtgagaaggcctccagagatgagcagttggtgaaagagaggctcaaaaccagctaccatacaggtcaagaagaatttggcattaaggaaacagcatagcaggattccagacaggcaactggtcaacaacatgaaggtctggaagaaaggtcgcaggtactcaggttcagggcactacttcagcttcagcccttgcaaaaactggtgagagttggaaagtctttaggctaagaaaaattggattatttaaaagggggtaaagaaagggactcaaggaggaaggattaaggcaagaactaggttccaagaaacagggcatgagagagagtcttgatctaccactatagttctcgtggtagcatcagaatcacctgggaacgtagaaatgcaaattctcctgctctacactagacctaccaaatcagaatatctagggggtggggcccagcagtctgtgcgcaaacaagcactgcaggtgattttgatgcacattatagtttgaaaactaggccaggtgcagtggctcatgccaataatcccagcactttgggagactgagacgggaggattgcttaaacccaggagtttgagaccagcctgggcaacacggcgaaaccccacctctaattaaaaaaaatacaaaaattagctaggtgtgatggctcccacctgtgctcccagctattcaggaggctgaggtgggagaatcacctgagcctggaaagtcgaggctgcagtgaattgtgatcacaccactgcacttcagcctgagtgacagagtaagaccctatctcaaaaaacagaaaaagaaaaacactggcccaaaggaaatgaacttgttacagaagccggggttcaaaacaccaaataatgcacttgtacctagtccttcccgggtgctctgcagacatttctccaagcgtagtctgcaaacaacctacatatgtagaattacctatgcacatttttcatttaacaaccaagagctacatttgtagcaaaatctgggttgtaacttagcctacagctgaagcctaagagattccgtctgtgagaagaaataacccacctctttggcccccctccccaggcaggaagccaggatggtccttatataaagttgtgctgtccaataggtaaccactagccacatatggctatttaaatttaaattaactacaattaagagaaattaaaaattcaattcctcaattgcacctgccaaattttaagcacataacaaccacatgtggctagtaactactgtattggagagtgcaagcggagatagaacactctattactgcagaaatttctattggatagcacttataatagtttagtgtaacttaaaactccctagttgccacagtcatgatttagtagtaatttcatggatttctctactgaggttagaatctctgccattagagactgataaatttaaagtttgcaattatcaaactggtgacaatttaagccagaatcaggtaaatgtcctcagttttaacagcattggaattttctgggactagctgtgtatctatccaggattcttgagaatgcctgccatttttcaacataatggatgtaaggtattacacatatacctggggatggggtggtaggtataattgcacaagcattgtggagaatggtatcaaagagtggcagaacatcacaatcaaggttttccctttcttttacctttgctttttaaaaagacaatatttgctggacctgatcttataactcataaatgggacactgtatgttcctttttacctcctctgtttctacttaattgcaccctatgaggactgcttcccttacctaccataaccccttccttcactcatccatatctttactcttcttcacaactctgtaatattgaccttctttatgaacctttcctggaacaatccctcttaagtgcaagcactgttattatgccttcaatgtatttaatatccatgtatctattctctctaattttgtcattttgtgttctcatgtattttcattcattatgtgtccaacttccatggataacatggttacaacaaaagatcctactttatgacaattatcttccttgggtttgtgggacatagaacagtgctcagagtaggggatccaagaacccaggagaatatattagctaagaagataacttccgtttttaaaagtccaagattcaggagatcaaaaccatcctggctaacatagtgaaaccccgtctcttccaaaaatacaaaaaattagcccggcgtggtggcaggcgcctatagtcccagctacacgggaggctgaggcaggagaatggcgtgaaccggggaggcggagctggcagtgagccgagatcccgccactgcactccagcctgggcgacagagcgagactccgtctcaaaaaaaaaaaaaaaaaaaaagtccaagattaaaaaaaaaaaaaaaaaaggatgtctgctttgtgagtttagcattgtctccttgtcattccagaaatgaaatggcaaatacatttaaatcagaactaaaaaggggaacagggtataaaggctcaatttagtcacatcatttccgtttctcacccaccccctttaaaccagatgtttgccaatgcattaacaatgcagatgtttcctgaaagaaagtttagtaactcaagcagacaccttattttcttttcaagcagaaaagactatgagatggtggttgtggttgttccgggagggagaagatataaatgatacacattatttcaaatcatttcatgacctcactgcacacttatagttattgtacctgttgtctttttgctgtcaagcctagctaagatcatttggaatgttcaagatcactcatacatgcatgtgcacacatacacatgcacatatgttcactccctatttcatccacatgaactaagattactgatgtgtacagattcaaagcacttttattcttttccaaaggcaagaagctgagctactttccagaatagttgtgaaagaccctgtcatacttctgcattgtttcctccacaccacctccatccagttccttatgaatggttactggttttcaaaaatatgagataaattgagtgtataaaagtcatttttagacaaaatgaaacaggaaatgaaagaaaccagaatctctcctcatttgtggatgggccagctccaccatgtcatggttaatctgcagggaggaaatactagatttgattgcagatcagactgcagcaaacctgctgtgactaaggcatcaagagaaagcaagcaacagctggggcttcagtggtgaaaacattatatatctagctttgaaatatgaaatactgtttagcagtgtcacctagaaaagagtgtttcaaaatgctgatgcttcataagaacctttctcttcagagttgtttcttttatctttcaaattagccagggtgggaaataaagtgatcacttggtgaagaaatctcacaaagaagaacatagagagttcactttcatctggagtaatgaacagattgaacaaactagaaatggttagtctgttaaagaaaaggtgtaggtgagctgtttgcaagagccacaagggaaaggggaagacaacttctttgtggacttaagggtgaaagttgcaagcaggcaagacgattctgacctccattaagaaagccctttccaaccaacaaccactgggttggttacgcaggttgggcagcattgggagcaaatgttgattgaacaaatgtttgtcggaattgttgacttaaagagctgttctgtcactggggacagcagcggctagatagccccattcagggagagggcatttgttcacctggccagagatcagagcaggctaagggactgctgggatcctgtccagctttgagaccctacagagccatgttcacctagcacgtatcccgtctgcggtcacgctcatttcttaccttattccagggctttcacctcagcttgccaggctggagccaagggccaacgcagccgcgccttgttcgcgatggtagcttcccaggagccccctatggttccggaacggcgctgccggccccatcctgtttgctacctcctaaagccaaaggcactggcgggccgggccagcttctaaagtcgcgcaaggttagaaggttccggacaggaacggcgtgaggccaatggaaggaggtacttcagtttccctccagatgcccagcgatgggctcagagctccttgagaactcgggaaaggaagcagggtctctgaagaaatacttcaggagtagaaagaggaagctagagggttaaatgcactacacaggaacagaaatgagtttttcttagagttagtatatgtctagaggtgtagtaaactaaaacaagtcttgaattgcataccgccacgtagggaagaaatgaaaacctttgaatattagtgaaaaaagggaaactgcaacgcctgtattactagatagctttcatcaacagctcaaaaccgacagatttaaagaagcaacaccgcattttggctttctaaagctttaatttggtttggatcccatgcccatgaccctgccagctgacaattctaagcatgcgcaaactggccccaaaaattcctcccacatttccgaagaactatttggccctttatgtgaagtacctggtttttccattttctgttttaccataggcctcagttcggtgtgtggcgtatttattctacatttaacaatttgaagatcattctattagattaaaaaaaaagaatacaatggaagccaagtgattaagctttccttatgcttatattaagttgtagcatatgcatttaccgatagttaaccgtattaacctacagaaaatgtccagggaaatggtctatttcttattctatttttgacctaaagaaaatctttaaaatgtcttagcattttccccagtctccatccactttcctcagctttggcctgaagctatctttaaaggtaccctgtacagctcttgccctgtacagctagctacagagattcaatcctttctgttcgattaggacacatctcagtggcagataacatgcaaagttattatatgtatgaaccagaacttgtttttccttaggggccaggatgttacactaaggtcttaagactatagtaatatcttcacttgaaaaagccctctattattcctatctcagatgataaaaattcaattaagagaaataagaacgtgacatgtgtaatcgcacctggctctacaaagctagtctggacagacatttaaacaattatcctctaagattatttgatgaaatgcatttcaatgactagttaaccattaaaaaccaaagtgagcatcccatctgttcccagtcaaatgacctagagcaaaggactaggcaaaccacatctgtgggcatagcaagctgtacatcacaaacaaatgaatttgctttgtatatgagtgagagcaaacactctttattgtacaacttgggtgggtaagtagggagaataatggttttactgaaatcgcaggtaacggttacgttggagttaaaggttaggaagaaaaccaaagggtaagagctgttgttctgggctggcattgtcaatgaagagcataaattcagatgtgaatgtatattttgtagaagcatgtgtgttgttggtttttgtgtatgtgtgagtctgaaagagggaaaacaggctcccattagactatgactaacaaaaatgtttgacagattataactcagatgtcttactcagagcatatgccttcccattttccccattattccccaacatgatgtctttaagaacttgtccttgaccgagcagacatctcataccccaaatagctaatattttgatagctatgatcctgaacggccaaacattccaaaaccaagtagtttgtaatatctttaaatgcaaatatattttaggccttttccttggcaaggatgtttggtcaggggttggcaaaaataatgctcttcagacttaaaagaacacaaccatatttcttagccatccaccagaaagtagtagaagctccaggaagcaagtctttgtcaggagtcagactagctacatcataatctctctgcccaggggctgtggatgtcatccatcctggcctaactagcctactgagctgagagatgtccaatttccccccaatacactaaccagaggagaaggaccgtgatatcattgcatgtgaattcttaattccaattgcttaaacaaatatgttcagttgtaactatcaataccagtatataacagtgttggccaagttttattgatgctgacaatcaattggagttacagccagacacatggtcttatgaccggcgtacttacgcagggctttgcactgagacaggtcgtgcatctgaggtttactgctttgcatttttgttttgtaactgaagtctgatgagacagccagagcatgtgctacctagggacttgaatccctgcagccccatttcacttctcaccaccttccggggtggtttctcgacctcccactcccctaccacctggtgccttagccagccctggctctccctccaaacacctgcccaatgagcactgccaccccatggtgcccagacatgctctccctcctcatccctacctagctaccattgccactcccctcccccagcggggacatgggcataggagcagggagagttaaggttggtcaggtgcacgtgccctatgctatcttggaagggggcttggccatgtggcatctctggaccaagaatgcgccacagcacatttggagggtgaatggtgggggcacaccccttgtccacctctatttcaggcatggaacacatcctggcatgaaagttgcagtcccttgggaatcacctctccaccttgattgccacagtaggccagtgacaagggaagattgacacatcatcccctgctggggcccagtgtcctgtggctggcaggcaggggatcctaaggacatgtgggtgttaaattgtagggtgcacttcctgggcacctttgagggtctgcactgccccagcaaatatccccatgctagaaggagcaaaatattaaatggcaaattttaaaaatgtaacaagatgggttgcaaaagagactacagaggaaagcaaaagttttgtattttagtatcttccatggcacttttcttcctagcttttgaacaaggggccccacatttttatttctcactgagccccacaaagtatgtagccattcctgcccggagtgaggacttttaaaacataaagattatcaagtcttggaaattctgattcagtagatatataacaggtctcaaacttaattatgtaaagaatattctggagagcttccttttacccagtcccacccaccaaatattctgataaattaagcttcgattagcccccagatctgcattttataaggatccccagatgattctactgcaattggtccacagaccatgcctggaccgaatttgggtgcttaggagcacaaattctggagccgggcagacttgagtttgcttcctagctttaccaactgatctcaggggagttaatgtttacctctaaactttagctcatgcatctataaataaatatattaatatcatgtcataaggatattatgttgtattaaatgtctttaaaacaccacaatgattagcccaaagtaaacactcaataaatgttcaaaaatttaggaaaattgttaagactgggttgtatgcacactggtgtttattatattatgtagttttttctgtatttttacaacatttcagaattaaaagcaacagctagaaaaagagggaaatggccgggtgcagtggctcacgcctgtaatcccagcactttgggaggccaaggcgggcggatcacgaggttgagagatcgagaccatcctggccaacatggtgaaaccccatctctactaaaaatacaaaaattaactgggcatggtggcatgcgcctgtagtcccaggagaattgcttgaacctgggaggcggaggttgcagtgagccaagatctcaccactgctctccagcctggtgacagggcaagactccgtcaaaaaaaaaaaagagagggagagccagagtatgaaaaaggaagtcagagccctttaatgagtcagctttgtaggtctccaggtaggaggctagtgcttcagtgtctaggacatagtaggtgttcagtaaattaaattcaggacaaaaagaacatgccccaaggaccatctgatatccacttaaagtgatggactacctcgtttcccttgtttatgaatgggttcatgcctaagactgtgtgcactttaatacaagggcagtcgttcagaactagtcaggtcctgaaaaggatttaccaaatgttgagtgtgccctctagtgttcacacttcccagctttcttcctataaaggtggatcaaggcacttgcttacaactggaactgaaatcctccaagtcgatctagacattgagatggagaaaatattcattgtcgactgtaattatgcaacgaatatccagttgagataatggacttgcctcttatctaataatacccaggctcaatgcgtcactgctttgtccactttgcccaaaattcaagcacagctaagttgatattttaggacaaaggcagcttactatccagccagaggggagtagaatatggttaagagagagtggaaagaatgaatgagccctgctattcctcactgcctggatggctataagcacagcccttatggaggccttaggtcttgcttcataatattccagtttgaaaagggtttgaaaagacctcctagaaaaatcagtagtttttctcttttgagtaacatgtagcaaaaaaaatttcatcatgtaggtacagggaacaccctaataactattaatctcaaggagtcaagccagtgtgtttcctaatgtatctgctgtatccccatgaagcaaattttgccatcagagaaactgactcatggggaaaaaatccaaggacctcaaatcaccaaaagaagccattcctcagatttgcctaagcttaagcttccctgtctctcattgtgtgttgctttcaatgcagttacataaatggcttttttgtttatgcaccaaaaacactaattcatctgcaaagctcacatttccagaaacattccatttctgccagcacctagaagccaatattttgcctattcctgtaaccagcacacatatttatttttttctagatcaaatgtattatgcagtaagagtcttaattttgttttcacaggttgttttgaatggtaaagttgatgcattctgtggaggctctatcgttaatgaaaaatggattgtaactgctgcccactgtgttgaaactggtgttaaaattacagttgtcgcaggtaaatacacagaaagaataataatctgcagcaccactagctctttaatatgattggtacaccatattttactaaggtctaataaaattgttgttgaataaattgggctaaaggcagaagggtcataatttcagaacccacgtcgcaccgtcctccaagcatccatagttcttttgatatacccctattatcactcatttcagtgaggtacaattagttcttgatgtagccatttccataccagaaggccttcccaaaaatcagtgtcatgtcaccgatccttttatctctggtgcttggcacaacctgtagcaggtcctcagaaaacaaacatttgaattaatggccaaatgagtttgtgctcaaaaaaggggtgaggatacttgaaatttggaaaatctaggataattcatgactagtggattcattatcaccaatgaaaggcttataacagcatgagtgaacagaaccatctctatgatagtcctgaatggctttttggtctgaaaaatatgcattggctctcattacatttaaccaaaattatcacaatataagaatgagatctttaacattgccaattaggtcagtggtcccaagtagtcacttagaaaatctgtgtatgtgaaatactgtttgtgacttaaaatgaaatttatttttaataggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaa

SEQ ID NO: 3903 - DNA, 125930 bp, human
aaactttttttcatgttaagagcaagaaggcttttgttcttggagcaggcagagagtattgtacattcttttggccgaggaaacagaatgagctgcgacagtcttaaggacaaacatttgtggtaagtatttctttaccttagagtaatataagaaatggattggggcaatgagtgggtcagtcttggaatatttttatagatagcatcccccatagccagtcattttcattcttgtagtagtttccccttttccccagaatcccccatttctaggaccaatgatttgcaggacacagtgcagttcttgtaaaggtgtatctgtccatacagaccgcaatagcctgctttgggtttctctgacagttctttgtctactgttcagttttttctaaaataattaggattcccaagtaaaggcaggtgggaatttctcaactctggattagaacttcaccactgtaaacctggaactattagtataacaaatctggtgtgcacctgggcttcatgggatggctgtaccttggtgtggttcctatgcaatgtatgggcctcagtctctgagccgtctagggattaggacttgagaaattgccttgtgaacttgcatatggttggcttataaatttggacagcagattatttattttcagtgggtaaaagaccattccattatttgtgtccagttctttttaagcacgcaaattttccagaccaagaagaactaccttggtccccagaaggtagccggggggatgtagacttggagagcaaagaaaaatgggaggtcttgagggcaatcttccaaaagaatatggtgatgtttctcacattttttaaagcagggtctctagtgaggcaaaaccacattttattcttgcctctatagtatttatttgtggaggtagaaagtttctggggaaggagtgggactgtttatatgaagaacctagaggtcttctcagaatgaaaggattggaaactccaaccctttttttctctgatatgcaaggttcttgaaagttgcttgaggggcccaaaaagatcctaaggaaaactcaccaaacttggtgagaaagaggtagaaagggatgggagcagctccctcccagagccctccatccttcttttttcatctgagctggttactctgccggctagctgcacatctctttctgaaattccctttgtctgtgctcctgtatcggatcattatttcctagattcattgtcttgctcttcattgatgtacttcatcatttttttggggaatacattctctactaacttctttatatgggttataaacttttattaataataataataataataattatgtctgaaaatatcttagacaacctttatttttgtttgagagtctgacgcagtataaagttccaagctgaaaaaccttttcccccctgattttgtgtttatttttccattagtttgtagaatccagtgttgctattgagaagttcaatgtcattttgtttcattttttttcaactttaattttagataagggggtacatgtgcagatttgtcatatgggaatattacatgatgctgaggcttaaggtacagatcctgtcatcctggtagtgagcatagtacccaatagttgtttttttttttatcctccccacctccctgcaccctctagtagtccacaatatctgttgttcccatattaatgtccatgtgtgctcaatgcttagctcccttcataaatgagaacatgtggtatttggttttctgttcctgcactaacttgcttagaattatggcctccagctccgtgcatgttgctgcaaagaatgatttctttcttttttatggctgcctagtattccataatgtatatgtagcacattttctttatcccatttaccactgatgggaacctgggttgactccatgtctttgctattgtgaacagtgcagtgatgaacatacaagtgcatgtgtctttttggtagaataatttcttttgggtacatacccagtaatgggattgctgtgtccagtggtagaattgttttaagttctttcagaaatctccagactgctttccacagcggctggactaatttacatttccaccaacagtgtataagtgtttgcttttctctgctgccttgccagccagcatctgttgttttttgactttttagtaatagccattctgactggtgtgagatggtatctcattgtggttttgatttgcatttctctgatgatagtgatgctgagtattgtttcatatatttgttggccatttgtatgtcttctttcgaaaagtgcctgttcatgtcatttgcccactttttaatggtgttatttggtttttacttgttaattttttcaagttccctatagattctgagtattagacctttgtcagatacatagtttgcaaatatcttctcccattctgtaggttgtctgtttgctctgctgatagtttcttttgctgtacagaagctctttagtttaatgaggtcccactggtctatttctggttttattgcaattgcttttagggacttagccaaaaattctttaccaaggccaatgtcgaaaagagtatttcctaggttttcttccaggatttctatagtttgagatcttacattaaaatctttaatccatttttagttaatttttgcatatggagaaaggtatgggcccagcttcaatcttctgcatatggctagccagttatctcagcaccatttactgaatatggaattgttttcccactgcttgttttggttggccttgtcaaagatcagatggttgtagctgtgcagctttatttctgagttctctattctgttccattggtctatgtgtctgtttttgtaccactaccaagctgtctttatttgtttgtttgtttgtttttgagactgagtctcactctgtcgcctaggctggagtgcaatggtgtgatctcagctcactgcaacctatgcccctggattcaagcaattctcctgcctcagcctccccagtagctggaattacaggtgcccgccaccacgcctggctgatttgtgtatgttttagtagagatggggtttcaccatgttggccaggctggtttcaaactcctgacctcaagtgatctggccacctcagcctcccaaagtgctgggattacagatgtgagccactgtgcccagccacccaagttgttttgtttactgtggctttatagtgtagtttgaagttgggtagtgtgatgcctccgtctttgttctttttgctttggattgctttggttatttgggctcttttttggtttcatgtgaattttagaatagttttttttttttctaattgtgtgaagaatgccattagcagtttgataggaatagcactgaatctgtagattgctttgggcagtatggccatttttatgatattgattcttccaatccatgaacatggaatgtttttccatttatttgtgtcattcctgatttctttcatcagtgttttgtagttctctttgtggagacttttcacctccttggttaggtgtatttctaggtatttcattttctttgtggctgttgtgagtgagactgtgttctttatttttgtttaatttttcatttccacaggttattggggaactggtggtgttttgttacatgagtaagttctttagtggtgatttttgagattttggggactgtgttcttgatttcactctcagcctggatgttgttgatgcatagaaatggtactgatttttgtacattaattttgtatcctgcaactttacttaagctgtccaaatttataagccaatcatatgcaagttcacaaggcaatttctaggagccttttggcagcatctttaaaattttctaagtatagattcatatcatcaaggaaaagagattgtgtgacttcttttcatacgtggatgctttttatttctttctcttgcctgactgctctggctaggacttccagtactatgttgaataggagtggagagagggcatccttatcttgttctggttctcaaggtgaatggttccaaattttgcccattcgatatgatgtttactgtgggtttgtcataaatggctgttattattttgacgtatgtttttttttgatacctagtctgttgaggggttttatcatgaagggatgttggaagttattgaaagctttctctgtgcctattgatcctctgtaacagatttgcttctttccagctataaatatttaagttctctttcatgtctgtggtgtacttcaaaattcataaggatgtataccagtgtggttatttttgaataatctcattttgcatttgataggcccttttaatacaaatattcttgttcttcagttccagaaattttttttctatttcttctattatttctttgaaatatccttccccattttcccttgtgtgtgttttttgttttttgttggtttgtttgtttgtttgttttgacagagtctcgctctgtcactcaggctggagtgcaatggcacaatcttggctcactgcaacctccacctcctaggtttaagcaattctcctgcctcagcctcccaggtagctggtattacaggcacccgccatcatgcccagctaatttttgtatttttgtagagatggggtttcaccatgttggctaggctggtcttgaactcctgacctcaggtgacacccctcctcggcctgccaaattgctgggattacaggcatgagccaccgtgcccagcctatcctttcctattttctctgttctttttttctcctggattcctgtgtgatattggacctcctgaatttattcttcatgtctcttatctttttttctcactcaacactgagacaattccactatactttgctagaaactcaatttctcactctaaaataacaatttcacccttcccttgtatcctcaaatttcctacactcactcctctctcttctcctgatcactatcatctaatgacttcaattcatgacttagaagagaaaatagatacagaaggtgtattagggcacattactgggattaacacatgcagaagagcagggaagagaaggaagaaggcttcgtgacagaagcctcatgcaaccttacaagaagttctgaagattggataatttgccgcagtggtccccatttgggaccagggaactggcccctgataccccaagttgttcagtcatttaatgtgggatgcctttggaaggggctatgaccttggctaggtagctcttttcagctgaggcaatccctgaataaggctgacagccaaagacttatctggcagccttctcaacagatggggtaataagtccttcattcctgagggaggatccgaagggcacattacagtgtctaccacatcagctacctgcacctatcagtgttgtcctgatattggctcgaaccagctagtgagggccagctctgcacttcccttcccaattttgtattcagtgacattgtgttggtaacttaggacttttctgtggaagttttaaagtttcaccaatctttttcaggtctgaaagctctctttctttttctccaattgttctttgttcacagtattccgttattgtttatggattataataatgatttgaatctttcagtgtgtaaccaattagcattgtttttaaagttcactgttccctgaactacgtctgtttctttcagagattttttttccatttatcattccttccatatatcatctcttcaactcttaaaggaccaggcactgtgttaggtgatggggacacaatagtgaacaagacacgaatagatccttctttagttcataagcatgatgattgggttttcatgtacatgtgtgagatgtgcctccctcaaaacttgttacaacattggcacattacctgtctgacatgaagggaaaaaaagacgtaaagggttcctgttgtagacatttttttcttgtcacagaaaaaactagtaaatatacaaataaataatattatttaaggaagttgtcattgctatgaacgaacaaaattcagtggatggagcatatgggagtagggggatgtctgttttaaagaataggctgggaccatgtctctgctgtgatagtacttgaacagagacctgaatacaatctggatagcaggccaggtaaaccattgcagtgggaggcagccccaggggtgatagactctgagaaaagaacaagcactctgtgttccaggaacaccaagaaggccagcgcggttggagcaaagtgtacaaggttaagtttgacaaagcaggcagggcccagatcattttcactgtttgtcttggtcttcttttgcatttggtgacttctgtctgttggggttctacccgagaaacaagaactagtaaaatttgtacatgtatatgtagaatcttatgtgtgtgctttacatttgtgtatttgtgtatttttaaattgtgtattatatacattatatacatgcctgtataatctattgacagagtgagacacacagaggcagagaaagatagagacagagaaagggtgtttttgtagtaggtaggtggttatttcaagaaattgattttcaggatcatggggtgctggctaggcaagtttgaaatatataaagcaggccagcaggctggaaattctcaggcaggagttggcacttcagacttgaggcagaatttcttctccttcagggaaattttagttttgctgttaagaccttccaactgactgggtgagctatggttttcatggataatctcctttgtttaaagtcaactgactgtagaagttaatcatatctacaaaaaccttacagcgacacccagattagtgtttgattgattaattatagcctagccaagttgacacgtaaaagtaaccatcacagtgacttacctcaaacatttggtgatcttagcctgcctgttcatatttaagggtgagatctagaaaaactggtgggggtatttataggagaagattgccaactggaaatcattgctttagggtgaccaagaggaggtatagaatcttataatgggaaacccctaaataccagattgggaagtttttccctccagagggccttcaatttcccctgaaaagtctctactcccttgggaggaggggatgtgctatgtgtgggtgctgtccttcgataatgagtggatctggggaggcaggagggacttttcccacattagagtcttttaatgaatgtcactgtttttaggcatgagcctcactcctacccttcacagcacctggtgtctccaaatcgcaaggcttccctttggtccatattcctttctgtgagcctatctcccacctcatcctaagctggggttccctgaacatttactcatgactttatctacttttgaccttccaaaaatagtggaaatagtgtgtttcatctgccatttcaaactacacagactaattattgcatgaaacagcctttaaacattgaagggaagggaaggaaggaagtgtctttctttgtatcctgaagaaccacagtggcctgggagaggtctgaaatagcaacagccacagagccagtgactgagatgtagcccaaatgctatagacctctgggtttcagtggacccccaaggtccctggatccatggcttggtctgaatatgggcagtggcggtgaaactctcctccaactacaagggtatttccagtcatgccaaaatatcaatattctattaaaatggagatatcgttatcttcttcttcccaatattataacgtgctgttcctcctgggggaggctcagatgaggctgttctgtccttctgggttgagtgcctccagacaggatgattgagaatgaagattctgggtcgaacaaattatcacaggaggggtaggctcctaagaaaagaaatctggcttggatggaaaaggaggaaggaagcagaaggaacctaaaccagagaaaaggaagtggtcaggttaaagggaaaacgttggaaattgggcctaagaatctcccagcacctattctctcctctcatcatcctccatcacaacttcgttctcatgcccccattttaatgcccacaccctagtctaaatttattccatcagggtcctctgaaagaagaccaaggacacaaacagactctgaaagaacacataaatgactaggaaacagaaaaagatgctcgaccacacaagtaacccagaactagctatttcaacaacaataagaggccttggaaagtttgtcctgagaatactttcaaaatgagtgtatctctagcttgaaattttaatacaggatattctctgtgcacatccaaagattagatttcagatgaaaatgacaacgttctcaggagaaaaaatatcgtgttagttttaaaatatcagggtttcaatatttctatatttaaaaaacatggtatctatcaactgatgaatgaataaacaaaatatggtctagccatacaatgaagtattattcagccttaaaaaggaatgaaatactaatacatgctacagcatggtttaacctggagaacatgctaagtgaaagaatccaaatataaaagttacatattacaggattccatctacatgaaatgtccagaataggtagatccattgagacagaaaatagattagtggtttcctagggctggtggtgatgtggggccttaagaagtgacagctaaagggtacaggtttcttttggggacgatgagatgttctaaaattagattgtgatggttgtacatctctgtgaatatattaaaaccattgaattgtacactttaaatgggagaattgtatggcatgtgcattctatctcaataatgctgttacaataaaaactatgatactctggaatactggaatccttaaaattgatacagtaattgctaagaggtgaatctcttcattgattgggagactagactttataagctttaaaagcactaagattcccttaagacagaggaagactgagaattacagaattttgttctggcgtaatgttaacaagctgcagatctgcaaaattataattcattgatacggttattttcatttcagaaatgctaggattagagtcagccaacttacagtctagatctagttatgctttggacaaatggcacaaacttgggcaactcagctcctcaaaacctcagtctcctcacctggaatgtggcaataaataaactgggccttccttgtacatgttttgggaggatcaaatgagatgacagaagaaaaagtgcttacaaacattatgcaaatgaagatggtatacttattattaattttgtaattattagtagtaacagcaactgtatatcaaattaagatggtaaactgctcatcatgtaaagacttgattctttaaatttgtccttatatgaactaaacaacatgtcttacatactaagtcctctttgtacatttcttattggtcatcgttgcctaagaatatatatttttgagaaataaccaggtcatatgtacaattatggaccttagcgtgagtctattacctatacttttatcttcatgtgacctatataaccagtctggtaaaactagttttgttaggtcaagctgtttaacttggtcatctagctgtttaacttggtcatcttttcagatggcagtcttcagtcccaattcatgtcagtaaatatttgattgggtggcacagaaattcagaaagaaacaagctattcccatttcactgagcctaaactcatcatgcctaatgtggaaagaggcagttctagctaaaaattaaagaaagagttgggaagttatgattccaaactcctattcctgactctaattttgccccaagcagttaacatttacatttccaatatatcatcatcgtttgagcaagtactcaaagcatttcatttacagaagtagttgtttgctctattacaagtataattgcattggaaatattcttaaactttttacacagcctttggccatcagaacagagcaaggatttttatttttatttttattttgagacagggtctcactttgtcaccaaggctagagtgcagtggcacaatcgtggctcactgcagcctcaatccctgacctccaaccaggctcaggtgagcctcccacttcagaccccagagtagctgggactacagggatgcaccactacacccggctaatttttgtattttttatagagacagggtctccctttgttgctcaggctggtcttgaacttctgggctcaagtaatcctcctaccttgaccttccaaagtactgggattacaggcgtgagccaccgcgtctgacccaaagcaagttttaaaggggctacttcttttaaagcacaacagaaatcatatttacctctgaaacaatattttcttctgaaaggaaagttttggcctttaaaatggcaacaaattgaagatctataaatggcaacatataagaataaaatttctgaggaatttcctgagaaggggtaaacatcaagtcaatgtcagggcctggattcaggtcaattcattgaccaatctctttgggcttacttagctgagggtgtcaaagtgactcccttgcatttaacatacttttcaggatttttacatacatctaagaagcctccatgatgccaatctggagttagattataatgtattcatcataacgtattagtttggatttttttggttgcaaatgatagaaccccaactgtaagctagtttaagcacaaaagaaaatttattgatctatgtaactgaaaaatctagtgggtggatatttcttcagtcatggctggatccagatgttcaaataatatcattaggaatctgtctctttacatgtatcagccctgttttcatgatattggtttcattttcaggcagcctgtctttgcggccttaggtttacctcatctttgtaactaacaattcagtgaagataatctctacctttcattggttccagaaattactgggattgtgtatcattgcttcaaacttatcacagtggccatggggacagaatacactcatttatttggcctggactaccctcctgccctgaagcaggggtttgctggaagtctcatctgtgtcacatggatttagaatggaatagggagactctccatgggaatgttgaagtacatagatgccaactaggcaggcaaaaactaccaatgtcccctgcatacatggcaaagaacctaatgtttgaaacttgatatagtcctttatataatcttaagtaatttatataaattgtgaggttgctattatccttattctataaatgaggagttttcatttggtaaccccctcacatgtcaatagacttcctgaattctgtagaacctctcaaaatcaaaggtagtaaggatatttttacttttattgcctatctccattttcagcatttcagaggttctggtttctcaaaacctatgcctaatttactataatgaaataatattccaggccacggtgggcagatcacttgaggacaggagttggggactagcctggccaacatggcgaaaccccgtctctactaaaaaaaaaatagaaaaattagccaggcatggtggcatgcaactgtaatctcacctacttgggaggctgaggcatgagaatcgcttgagcccgggtggtggaggttgcagtgagctgagattgcgccactgcgctccagcctgggtgacagagcaagactctgtctcaaacaaaaacaaaagactctgtctcaaacaaaaagaaaagaagaggagacgagatgagaagagaggagaggagaggagaggagaggagaggagaggagagaagagaaagaaggaaggaaggaaagaaagaaaagaaagaaaaagaaaggaaggaaggaagggagggagggagggaagggagggagggtattccctcttactcaaattccctgtgtcctactcaggagtggtaagatttaggcagatggtgtaacaccttaccacatcacattagagagaggaatttggtataaggctggtttatccttagacttcatccaagggcattaatgaaataataccaaagggccttatttccaaaagagttagttacattgtaaggccccaaaaactgtattatagagtagtgtagatgaatctgaatgtgctatgcaaattagagactgagttacagctatgcatctttttcttcagacctgaaaaaccctgaggttagtgttctttccaataagggttggcagtaaaattaagactgatgttcactcattgttactttattcacccattcaggtaacccacattttgagggcccactatatgccaagccctggaagacagtgcttaataagacatttcttctggcatcaagggcctcagaatatttctgagtgatagacctgcaaacaattgcaacacatgataagaatcagcttgagaaaggtaggatgaacgggcatgaaagaaggtgtttggttcagggagtctagcaaaacttcagagaagaggtaattattttcaatgactgcataattaatgattttatggatgacacagaaggagctcatgtgagcttaggctttctctccctctctcatatttggctgtcatctatccatccactccatgttttttccagcattctttcaatgcttatagatggcatgtagttgaaattatactacatattcatcttgcatgcagataagtcaatcaacataaggtcatgatcattttctcatgttcttaaaaatccttcaataatttcattttaaaaattagacttttaaagataattctagattcataagcagctgtaagaaataatacacagaggctgggcgcgatggctcacgcctgtaatctcaacactttgggaggccgaggcgggcagatcaccttaggtcaggagtttgagaccagcttggccaacatggcaaaaccccatctctactaaaaatacaaaaattagccagtgtggtggcacgtgcctgtaatcccagctactcaggaggctgaggcagcagaattgcttgaacccaggaggcagaggttgcagtgagctgaaatcgtgccactgcactccagcctgggtgaagagcagactccaactcaataaaaaaaaaaaaaaagaaagaatacagagagatcctgtataccctttaccaagtttcccccaatggtaacatcttgcaaaactacagtacaatatcacaagcagaatattggcattgatagaattaaatacagaacagttccatcactacaaggaatggcatttttgataactgatatgcttaacaatccattttatgcatttatggataaaaaatccataaaatccattatggataatggatttatggatatccatttatggatgtatcataatttattatctgctattgtttgtcatgtgggttgcttccaatttggggctataattaataatgctttgcatacaaacttttgtcaaaaacctctgattatttctgtaggagagatcctcaagttaaagggtatgtatattttaaggttcacaatttgttgaaaagactattctttctccattgaattgtcttggcaccatggtcaaaaataatttaccttagatgcaagggttttctctggattcacagttctattctattgatctataagtctatccttatattagtatcacactgatttgattattgcagctttgtagtaaggtttgaaatcaggaagtgtgagtcctctttgttttttttttttttcaagattgttttggctattctcgatcccttgaaggatattatttttttggttaccttatttctttgtaaataacctcccatttgtgatttgacttttgtttatgtttttaattatacagaagtttaaattttttcttctttgatttttgtatttttcacatacgtagaaaacattcttttatattgttaagtttctaatagctttctaaacctaaagttatttttccatttatttccttcttttttaaaaaatggaattacaaaaataacagttgctcactgtaaaaagtttaacataattacttattgggcaaaaaacatgagatttctcctataaccaagtgctttccaatttcactttacagagatcaacactggtagcagtttgtatccttcccaatcattttctatccccatacacatgtatagtgtttaaaataagggatcaaacaataaatattgttttgcatcttacttttttacacttgacaacatagcagggcatctgtccatatgcagatcaatctcatttttaaattatgctatggaaactctttcccattgttagattttaaaaatgtcttcctaggttgttatttagtacttttatagactacccctcatttgtgtcttatttatttttaacttattttacaacaactgccacattggtagaattcttaatgtcatactacccacagtagtgcggaaattttaactatttgctcctctaccctgtgcacatattcaagagagaggctggcaaacattctgcctggttgacttaacacattcaaatagcttacacattcagataaaaatatgtaaatcaactccgagaagttgaaaaagcaaggctaggggaagaggtgtgtgcttgtaggggggacatgtgtgtgtgtgtgtgtgtgtgtgtgtgtgttcctcccctactcactctgccttttgcacttgcctatccccactttcctcaggtataaattggcgattcctcataagagatctacttggaatgattggcctgtataatattaatccactctcctgccagaaaattttgaaaaggataagtattaaagaaaaaagtgggatgtggcatttgcaattcacatcaggacttctaagcattagagcaaaattggggcgaatccctatggcattagctcagcttcagacacacattttttttaaatgctaacacccctggcctctcctcagccagctactgcttcacaagcagggctccctcaggtcctgcatacccttttccttccaggcactgcggagctccatcttccctcggcccagtccctgagtgctttgggttcagggcaaggaaggagctctagctcctttcattttccatttggcttcttaaacgggttgcctcctcttgcctttccgttttctcgtgtcctctctaaagcgtgtcaagtctcccatgcccatggcagatggcagctcaagtgtctatacaggaggcttggcgtttgggacctgaagggcgtgggacttggcatatccaaagactgagatcagagtatgtctgtgtgtttgtttgcatcctcggaggacatatttcggcttcagcacaggacctctcagactattcagggctagtattctcttcgggcaaagacagcagccctgacagggccacctgcatgtgctcacacagtgtaactcccttgcgccgagtctttgcccaggtggatactggccagaatgctaagaaaccgccaagacttgcatgagttgccatgagagtgcgaggctgggctgtctcctcccaccacaagtgctagcctaggttggcctttcgtccctcgaaaatgggaatctctgcagaaattctctcttttagctccttgcgtccctcctccacagcccccgcctcctttcatccaccggtggctaagcgggggcgtgggtgtgcgcacccagggagagttgccctcgcagcggcgggggccagagcgctccgccagagccccaaactcttaacaagttcctggactccgcgcgcgcggagctctcgggcctctgcgcctctgtccctactaggggggctccggaggactggcggccgcggcgcagctgggctgagcggggccaggggctgtacccctccggcagtgcctgagtgcccagcggcggcgcgcgggtcagagctgggcagctgctggctggagtagcggccctgcccggctctccagcgtgaggatggcagcggcaggggcccggccctacctgggttcgccaaggcgggcggccaggcacatgccccaagctgccgcttcggcgccgtggacctcagtgtcctgcggcaggatcccaggcctgccccagaacccagatggctgcactttcatgccgatagcccaggcgatccctctgcaggtggacatggccatggccctgcagcgcgtgaggattgccgagaagtacgggaagaactacctctgcctcctgcaagcagtcttcgtggcaggtaagtcccctcctctcatctcctccccggcggcctcgggctggcttgcccttcttctcagccgctgcctccccagcccggccggcttttctttattttccagtccacacccctccccgcgcgcactttattttccagtctatacaacccccccacctcgcccgcccgcccgcccgccgcgcacacacacactttcctgctgcagtggcgctcccagccacgaactcgctgggtcatccgttctccgttcctctggccagctgccgcgctgcaggcgtgcagctctggtctcagctcgcaggaggtgagatcaggagctctggtcccgcaggaggaccgtgggaaagtgcaggaagcagtatgaaactgtctctgccattgctggttcaggtctcctatccccttctcacccactttggtgcgtccccggagaagtgggaatagagtgtatcttcccacactgcatctcacacaccagaacccagcctctttgaggagtgcacttcccttgtaatattccctgaagttgaaaaagcaatttttttttgtttttgtttttcccataacgcatgtggaggaaaccaagtcaaaaaggcactcaggttcggaaaccagcagcagggccgtggcagggcaggtgggggaggagttgtagggaaacagctgctgccactgacttgggctttgcacccagaaaagcgcatcttttcatcttggtccatgagcttgttgcttccctacaaaggcaaaagctcttgtttgtctggaaggacaaacaaaagcaaagacaagtaactcacaaagtctttacggccgctgccatggtttgattaaggggagtaagtggggtaacatggacttggtcacttgccagtcgtgatacactcacatttagcaagctgaagttgcccagctttggggttgatgtagcagggaggatgctgcaggctgtggggctgcgttcctatggggccattctgactggggcaccggggctgcctcagaacagagtgcaactctgagacctgaagttcagccagagcttttcagagaagtctgcaaggtgctgcaattgatgtgcgcgccttcctgtgcacccaaggtagttttgacttagtaggttctaagccttgcagtggaagttttggtattcaaaaaatagacttggtggcaatttcccacaaatcagatagccacaacacatgttccaaatatacctccctattcagtgctatccacaaatctaaaggaggccatgcaaacatcttcagttagaccagaggaattaattcaaggctgtggtctgtgcatcttcatcacacagaactctttggtcttgcttgttttgttttgagctggtctatattattttctagatgtaataaatcattaagggcaatgtggtgatggggcacaaactagttccggtcttaagagcaatttaaatagtttttggagactacaaaaaaaaatcttgctgaaacattccgtgcagtacagtggaaagtactttgcgttttgttctcatttaccttctgcatcatcttgggagctaaaaaaaaaaaaaaaaaaaaaactcctttggaggaatgcatgcttaatcacaaaggttaaattagttatgctatgaaatgtaagttgatatttttgctgctagtgatttctcttatttctagagttgtgtgatgtgtcatctgttcacacttttgaaggctcctacatgttgacaggcccccattcctgtggcattacaatgtgtcataacacctaaatgacaccagttgctgtgctgtgtttttacctgggcttgcaatacttttgtaccttttcagcatttgccctggaagggatttgtagccatgtgattagagtacacactatagtacaacaattttaaatgtaaaatggatttccatatacttcgaagctatttatatattaaaatatgtttacaaagtttttcattgtggtaaataactttctgaacaatcacgtcaaaaatgaccatttgtggattgctcaggcccagaaattatactacagagtaataagctaatgacatatgtgtgtgcagaatcttccctggggcaaccagaagagaaaatgattggcttcacttagggagttaggggaagacttgatggagagagtgatgcatgagttgaatcttgagagatgcacacaaatgtccagctggacagcgggtggggattgaacgtggtagggataggtgggtgaatggtattccaggcaaggaaataagatatgcaaagacaagcagagagaggagagcagagtaggtttggggaattgtaaattccttttaaatgactggagtgtaaaatatggggggtaaaggagagagagagatttggagaggtaggaggggcctcgtaaggcatgttgagtggttttactttatttccagagcaatcggaagccactggagtgttgtaagcagggcaatagagaaagctgctgcatatgattgaacaggttgtgcactgcaaaacccctggggcctccactgacacagaccacaccaggaatgatgcccttactatggctgtacagtgcacagtatacacagtggtcaacagcagctatgagtgatggaactttttgctttcacaaagatcatccaagttgtgtggaggattcagtgtgtggcttatgccgtggagaggaagaagactggagataaaatgactagttagaacacagttgaagtaagctggctctcagtggatagaggcatggactgtcacttctggggatgaggagaaggggagaggtctgagcggaattaagagggtaaattgatttgacttggtgactagtcgtggtgttcgagggacagggaggagactaggttaatttcaggtttctggttagggtgactgaatggaaagagatgccattaacacagggaatggaagaggaagaggtagtttgattttcaattctgggtatgtggtttctgtggaatattcaggtagagctgacgaatgggtctgcagctgggaagaagtaaatgttatttcttattctcatcatctatagggttcattaaacatctcctggcactgaagttctttccttaaatctacttctccatgggctatattgataactcagcaagtctagtacagaagtaggcacacattataaaattacctttcagacttgttctttatattttccctcacacatttctttacctgatgatgaaaaaaaatgaaaaaaagaaacgtcttgtattcatcacaggaggaaagaatgtaagctattctgatctaatgtaacctcagataacttacataattagttgtgaaaacctgttcactgcaaattttactcatcagagtatagctcagggagatatgtaaatcacaacaaaatttattcagtgtgcattccagtatggtatgaagatttatttcaatgatgatgggtcatctattaggccacacgatactgtgagtgttccacgtaactgatttttctgggtaactgaggttcaacacttttagtgcctgactttttccccttaaaatatgtatccattttggatgagaagcttttcaaaaatactatttaccttcctgacccctgaacctggaaataattgcatccttttttgatgggttaagattgtccttataatagcattagttctttcaatgtgctgtattcagtgctgcctctgggctcctaaactgtggagggctgtttgtccctatactaaatggggacagattgttctgctttttaattttcaatgcctgacttttaccctctaacttttccgtagatttcctctctgttagctgatattttttgctgctgttaatttaactgtttctactggccagttgttattgcctaatcctccatgccccctcctccattgccttctctgagtgttacgaactagggaacaagataatcaagcttgttcgaactgtgtgaaaagtataatagaccatgagtaggcctgtggggaatctacctcaactaatgtatatgagctttagtacatggactctgtgatatctattccaattgcaaaacatctttttcttttctttctttctagttcctttgtgtgttttggagggttgatgcagttaaataagttatcagtaaaaatctatgttctcctgctaatcgaggcataataacatgtgaaattgtaatattttacttccttgtaaaacaaacaagtgtgttcagaatctatcagcaattccacgtgcattttatccactgcatttctcagacatgcctgtgcttggcaccagaaggcacttcattcttaaaatttgcccccaggtttgaaagcaattgtccctgtctctgctcagcatcttcttaagcaagcatcctctgaaggctcaataaacaacttgcaccttacctactctagggcaggagcagaggccaatcccatgaggagagatgccttctatctgatggctgacaaggccagtgcctctttctgttgcttcgacgtcttgttccagagacagttagctcctggccagaggccagtgtcacagaagttacatttattttttcacccaaacttcccctcattgtatgtttatggcagatgtaagaatctgagtgacttcttgttacttccagcactgggaagatgccattgagcaaaatcctgaaggaggtaggaagtgaactaccagaggtgactgggggagagtgtttcaggaagagggggcagtcagtggaaaggccttgagacaagagcatgctgacaagttcaaggaacaagaaagagacgggtatggctgaagcagagtgagtgtttgcatatgtgtgtgtgtgtgtatgtgtgtgtgtgttgtgtgtgtgcatgcgtgcctgcatgagatgaagccatagatgtaataaagtctggatcacatagggcttggtaagaatttaggcttttaacctgagtcagatgatgagccattggaaggttttgagcaaaggagtcacttctgtgttaacagaatccctctggatgctgtgtagagaataggattaaggtcagacaaagatggaagcagtgaaaccagttaagaggctattagcattaatgatggcaacttgaaccagagaggtaatttgtggaggtggtaagagtgatcaaatagattctggatatattttgaggatagagtcagaaggatttgctaatggtttggatatggagtatgagagaaagaggagttaaggataatgctaacatttttggctttagcaagtggatggcagaaattttcatcagtggagatggagatgcctgcaggaggcgtaggtttacggggaaaaattatgaatatcagaagtttggctgtttgaacctgttaactttttttttttccgagatagagtctcactctatcacccaagctggcatgcagtggcacaatctcagctcactgcaacctccgcctcccacgctcaaatgattctctcacctcagcctcccaagtagctgggattacaggtgtgcaccaccacacccagctaatttttgtatttttaatatagaatcatgtcgtctgcaaacagggataatttgacttcctctcttcctattgggatgtcctttattttttttctcttgcctgattgctctggccaggacttccaatactatcttgaataagagtggtgaaaggacatcttttcttgtgccagttttcaaagggagtacttccagcttttgtccattcagtgtgatgtcggctgtgggtttgtcatagatggctcttattattttgaggtacgttccatcaatacctagcttatcgagagtttttttttttttttaacgtgaaggggtgttgaattttgtcaaaagccttttctgcatctattgagataatcatgtggtttttgtttttagttcccatttatgtggtgaatcgcatttattgatttgcatgtcttgaaccaaacttgcgtcccagggataaagcctacttcatcatggtggattagctttttcatatactgctggattctatttgctagcattttgttgagtatttttgcatctctgtttatcaataatattgccctgaagttttagaattgtgtctctgtcaggttttggtttaaggatgatgctagcctcataaaatgaattagggaggagtccattttggaggagtatttagggttttctaggtgtatgattgtagcaggacaagccacagacaaaacccctcagacaccgagttaaagaaggaagcagtttattcggctgggagcatgggcaagactcctgtctcaagagccgagctccccgagtgagcaattcctgtcccttttaagggctgacaactctaagggggtccacttgagagggtcgtgatcgattgagcaagcagggggtacatgactgggggctgcatgcactggtaattagaacggaacagaataggacagggattttcacagtgcttttctatacaatgtctgtaatgtatagataacataaccggttagatcaggggtctatctttaactaccaggcccagggtgtggcgccgggctgtctgcttgtggatttcttttccgccttttagtttttacttcttctttctttggaggcagaaattgggcataagacaatatgaggggtggtctcctcccttatgatcatgtcatcagcaaacagagataatttgacttcctcttttccaatttggatatcttctatttctttgtcttgttttattgttttggctaggatttctagtactatgttgaataggagtgataagagtggacatccttgtcttattctagttcttaagggtaatgttgtcaacttttccccattcagtatgaccttggctatctgtttgtcatatatgagagcctatttttaaaaatagcttttgtagagctataattcacatacaattaacctacttaaagtatgcaattcaatggtttttagtataatcacagagttgtgcaacctttaccacaatctaggtttaaaatattcccatcaccccaaaaagaaaccccatactcgttagcagtcactctccattttctcccaaccacctttttcctcagcccctggcagtcactagtctactttctatttctatagatgtgcctattctggacatttcatatacatagaatcatacaatatgtgatctcttgtgactggcttctttcactgagcgtaatgttttcaatgtccattcatgttgtcgttgtgtcattcttaaaatggctgcatcttattgcagtgcatagatgtgccacattttaattatccaataaaaatgataggcatttgtgtggtttccaccttttggttattatgaataatgttgttatgaacattcttatacaagtttttatgtggacatatgttttcatttccctgtggtatgtatctaggtgtggaaattgctaggtcctagagtaactgtatgtttcatccttgaggaaatcccagaccgtttttcaaagcagctgcacccttttacattcccaccatcaacatatgagggttataatttctctacattcttcctagtacatgttaatctctctttatttcccagccatcctagtgggtgtgaaatagttttttattgtagttttgatttacatttcctgaatgactagtgatgttgagcaccttttcaggtgcttattggccatttatatatcttctttggataaatgtctacatggattatttgcctgatttaagattgggcttttcctcttttactgttgagttttaagagttctctatatactctggaatggagatctttatcagacatttaatgtgcaaatattttctcccactctgtgggttgtctttttacgtacttcatggtttccttgaatcgcaaatatttttaactttgagaaggtcgaatgtatctatttttttcttttattgcttgtactttggatgtcaaatataagaaaacattgcctaatccaaggtcataataaattacaactatgtgtttgtctaagagttttatagttttacttcttatacttagatctttgatccattttgagttgatttttgtgtatagtgtgcggcaaagattcagcttcattcttttccatgtgcacctccaggtttcccaacatcatttattaaaaagaatatcctttccccgttgaaatgtcttggtgccctggatgaaaataaattaaccttcggtacaaagatctatttctggactttcaattatttcccactgatgtatctataagtctatcataatacctatctttattactgtagctttgtactaattttgaaatcagaaaatataaactttccaaatttgtttttctttttcaagattgctttggttattccaggtcccttgcgtatccatatgaattttaagactagcttgaaaatttctgtgcaaaaagccatctgggatgttgctagggatggcattgaatctgtagatgaatttaggaagtaccttaacctcatttttatagtggcacaaattgaggtttcccaaactatggaccattcacatttaacatatttggaattatttactataatggatattggcattctgcccttcagtgctcacattggatagttattcatctttagtttgtcatgaatttacaaagtttatggctgggcgcggtggctctcgcctgtaattccagcacttttggaggcctaggtgggaggattgcttgagcccaagattttgagaccagcctgggcaacatagtgagacctcatatctacaaaatatattttaaaaaattagctgagcatggtggcacactcctgtagtcccagctactcaggaagctgaggtgggaggatcacttaagcccaggatgtcaagactgcagtgagctgtgatctcgccactgcactccagcgtgggtgacagagtgagaccctaactcaaaaaaaaaggagaaagtttgcaacatattcattcctagtatgagaattattctagacactgtgctgaagtcttaaaaggcaagaaggtatcaacctgatctctcccaagggaaaacaataatacaaatgaaaacaacaacatcatcactaactcagtcgcctttgtgtttgtgattcagcatttggcaggcacgtctgtgtaggactggggtgggataacagaagaaatgagaggcatatgtttggataccacactgccacgaatcggcaaaggctttttcatgctggacaagacaatttgtcaatcaagtgtgtagttatcctccctgtggcaggagatattttttaggaaaatagactgcagtggctcgataaatggacttggaccagatctacagtggatttgctgatgctttaagcaggaaaaatatttacttatttctatttttacatattgtaaatcaccacgtatgtagttcttctttacagactgattcagttcctctcaaaatttacctacatgttttggatttctgaataataaattcattcagctgtgattattagggaggttcccaagacaatgtcagctcctgctgctgtacagggaaaacctgccatctctactgaatggtttttaatctgaaggaaggctgaaggaaaaggtttccacagacatgctcttaattaaacacctacaagagatatagtcaaggagcagcaacctgggacactaagcctgtggggggaggtcttctcactgtcacttcccaccagctgtttctcattttttctcatgcatttttcctgccctctctctttcatccttctcttttctcggttcttccccttatttctcccttcttactcctgtcatttcctagtgcctttgagtcttctttttcctgtttttgttttctgtttttggtagggaagtatcttttatttcctcttcttctattcttataattaaattatgtatatgtgatctttgtaaaatatctaaacaaaacaaatgcccataaactaataaatgaaagtcatccatgtgcctagcccagtcctgctccttggtggtaaacactgctaatagtttgtgtgtgaggacataggaggttttctatgaatatagatatatcaattcaattcaaacatttattgatcacctccagtgtgctagacactattgagatattatggtgaacaagtaaataaatctctgccttcagggaacttatttctaatggtgagagcaacaataaaaaatccacatatatctagatattttaccaaactgggatcatacaccatatgttgatctaagacttgtattggaatgtgtgtatttaaaaattacttcattacgaaaattttgatacacataaaataatgcaagaggaaaagtaaagtatataatataaaatcatgatgctaagatattttaaaatttccctttcatagagcacaaagaggctactgtatcttttcagcataaagcatttgcccagttttgtcttaatgggcttatagtagaccctgtagatgctactggaatatgaattttgcataactttgtggctggagggtgtggtagaggttgagctgccctttcataaatgccttgactaggtcagcatcagccgctgctatcagccaagagtattctttacattcaaggatactgagagttctctggtcatcacgtcttcatttgtactcttgtaccattgttaagtggaagcaatagctgttgcatatacactgtgatgagaagaataacctttgagagttattttaaataacattttctctattttaactgaaattgtgtgattaggtatatgtattctgagactctttgatggcaattagaaggaatatgcatatttgggggcatctttgagtttgcaattgcaggctagatcatgggattagccatagagcaaaaagcagtggccctgtttttatttgtaattttgcacttgtcagtttacaaaagagggtcaggtttactttcttcattaacatattcaaaggaccatgaacagatattgtgtgttcttctgcatgcattacaaactaaaataagtcattttaattggatttaccattgcagatgttgtacatttcaaaatgattttatgaacccaagaagaggtgaatagctacagagtaggagatctggcatttagtcacgtctacatggatattgtgagttctgatatcagtgggtcatcttgtctctttttatagcttgtgctttaaatagctgctctcaaaaggtctgatgccataataaaaaattaaataggggttaatgtaaatatttacctattgctaaggtagtatgtttggaaatatttagtggtggctgtggctgtagtggtcagggactagtgtttctttaagctcatgttcaaacatgcccctactcgtttacactgcaagaactgaatggtgattatttgggtgaataaagtaatgccctttcagtgccttttccccacatttctgttgttgaggaatactctggcatattcaaaatgtcggatgaagagatttctttttaactgtgctttgcaaattatccaaggaatctaattctcaaaggcagttatattcatgactacaaaaaattttttaaaaacccacacaattagccggatgtggtggcacttgcctgtagtcctagctactcagaaggcttaggcgggaggatcgcttgagcctaggagtttgaggctgcatgaagctatgattgcaccactgcactccagcttgggtgacagagtgagaccctgtctctaaaaataaataaataaaataataaaaaataagtaaagatggagattaaagttttaaaaccctccattttaaacacttaatattttcatgtctgcacactatatgaatgcacatatacgtgtaaatattgatgtttacaaaaattacagaaatgaatggcttccctttatttgcagcacatacaaacatgtctggcctatgaaaaggcatgtttgaaaagatgagggagctcactatcatattgctctcatccttggaaacaggtcttaattattaatatacttaaggttatattgtaaccttaatataatattgagtcaggacctgaagaggtggaaggtctttcaggtcctgactcaatattatgtgctgaaagcgtcccaggaggtacttggcgtaggttaagtataaaacctttttattttttcatttttttaatacatgatctattttatcagtttagtgctggatgtcctttcactgtgtgctcttggcatcctgggctcaatactactgtaacacttatcactctgggctttcactgcttcctgcctctagatgtagagtcccaggagatccagaccagtgtctaactggtttctgtatctatccccagtgctgcacagggcctgatataagataggagcctaacaaaggtttgttgaaagaacaaattcatgaatgattagagtggctgaaaaacacatggaaaaaaaagttaaagttgtgtggaattgtagattcctgttttgtattcctattctttccttccatcctctcattccttccttacatttcacatcttccttagaattccactttgtgctactgagggtaaaataatcctgtggttccttcctttaaaacacacttaaaagtctgagcatctgagaacagtcagatctgtgcatgtttttttccagatgtggacactattcattattatgtgctctgtaagcacgtggtaaaatgacattgaatgcatagtaggtgctcaggcaaacactaaaagtttgggttgacattgtacatgtctttaatgtgatctcagagttcatttgatctttgttgccacatctaactgattttgtttctccattttagattgtttgtgtcaagtcattcgtatttacccttcagctctagaggggtaaaattctacttgggatgttttctttcagttatgactaaaataattttaaggtggtccttcaaaatggatgttttgtgaaaaatgaaaagtaaacctgtgataagagcaaaatccaaaaccaaaacacatctgtaatgatgttgttgcacatataagtgcttgctattgttagattttttaaaaaatgttgcttaagtggtgagtataaaaggttatcctgctctccttgaaatttacatttcacacactacaaatgcagtggagcatcttttcaagtgttcattggccattcttatttcctcttctgtaaaatgcctgcttgtgttttatttttcatgtatttatgggttgtctttttcttattattgacttataatcttttatatatccttgatattaattactaattctttgtcgttacatgtgttgaaattatcttcagtcaggttttggactgtctcatcactttctttatcatgtattttgaggaaagaaatgaaaaattttaatgtagcataattaatcagtttttttattttatgctttctgcttcttccatcttgctttaaaaagtctatcctacccataggttacacagatatcatactatattttctctgatctgattcccaacagtgtaagatttgaatcctcaccaatgcatgaccattagcgtgaaggtggaaattgttagatatcccaggggtaactgctattatttgttggcttctcccacaagatattcgcctaagtaatgattttggcctctgaggatttgcttgtctttccagccagctcagcgatgcattaaaaaagatttttttttgagacagggtcttggtctgtcacccaagctgtagtgcagtggtggaatcacagctcactgcagcctcgacctcctgggctcaagcgatccttccacctcagcctacccagtagctgggactacaggcgcctgccaccacacttggctgatttttgtatttttagtagagacggagtttcactgtgtcggcccagctgcccttgaactcctgacctcaagtgatctgcacgccttggcctcccaaagtgctgggattacaggtgtgagccatcgtgcctggctgaaaaggatttaatttgatttttcccaccatgtttttgtattttgtactagaaggtttttcaggatttttagttacccatatgaccaagaaggggagctcctccatgtttttcaaacttagacgttcaatgtttagattcaaatatgatatctaatgtaggagtttttcttgtacacaagacgtgagatatggatcgggaaacataacccattaccccatccacagatggcttaaagggggaaaagatgggagtggtgttctggctctggggtcctttgtgattgtttggagaaggtgatgcagaattaaaatctttgcagaactatagtggtaataaactcagcatgttacctgtggcgtattcgtatggtctgcagcaacctcaattcttgcctcctcagaagaaagaattcaactgaaggtcataaggcagaagaagagaccgaggcaagttttagagcaggagtgaaagtttattagaaagctttagagcaggaatgaaaggaagtaaagtacacttggaagagggtcgggtgggcgacttgagagatcaagtgtatggtttgacctttggtcttggggttttatatgttgggatgcttctgggatcttgtgtttcttctcccctgattcttcccttgaggtgggctgttcacacatgcagtggcctgctagcacttgggaggggagcatgcacagtgtgtttactgaaattgtatgcatccttacttgaggcattcttcccttaccagtcaaatgtcctagaaggtcataataccagttaaactccaccacttttcctcttagtgtgcatgcatgagcccacttacccaactcctgagatcttatcaggagctgctgatcaccagtttcagatgtttctgtttattgggagatggcctttccttggcactggctgtgaccaattattatcttagagagacagtttcataactgcctgatcatcacctgttggttgcctgacattcctggtgggaaggtgtccctctcctgccctgctcatgtctgactagctaccctctgtaacaagcattgtctgtgactgcatgaatgctaacttttacatgaaacctttgaaattgtaatgtcattttttctttataacaatggccgacatttatcgagcacttactatacactaaggtaagtgctttgcatgtatgaaaaacttattcattacaataaccctgtgaaataggtgctgccattttttccactttaccaataaaagaaacagacacagattttaagtagcttgcccaaggtcacataactaccaagtggtacagctggaatttgaatccagtcaatctgtttctggagtgagaactcataaggagtatgctatatgacctctataggaaatgcttatttgttcagaaaaataagaatttttttccattccaagatggccaaataggaacggctccagtctgcagctcccagtgtgatcaacacaaaatatgggtgatttctgcatttccaactgaggtacctggttcatctcactgggacttgttggacagtgggtgcagcgcatggagggtgaactgaagcagggtggggcatcacctcacccgggaagcacaaggggtcaggggatttccctttcctagccaagggaagccgtgatagacggcacctggaaaaatgggacactcccgcccaaatactgtgcttttccaatggtcttagcaaatggcgcaccaggagattatatctcacacctggctcagcagatcccaagcccacagagccttgcctactgctaacacagcagtgtcagatcaacctgtgaagcagcagcctagcagggggagggggtccgccattgctgaggcttgagtaggtaaacaaagcagccaggaaagctcaaactgggcagagcccactgcactcagcaaggcctgctgcctctgtagtctccacctctgggggcagggcatagctgaataaaaggcagcagaaactgctgcagacttaaacgtccctgtctgacagctctgaagagagcagtggttctcccagcatggtgtttgagctcggagaacagacggactgcctcctcaagtgggtccctgacctccgtgtagcctaactgggagacacctcccagtaagggcctactgatacctcatacaggcaggtgcccctctgggacaaagcttccggaggaaggatcaggcatcaatatttgctgttctgcaatatatgctgttctgcagcctccgctggtgatacccaggcaaacagagtctggagtggacctccagcaaactccaacagacctgcagctgagggacctgagtcttagaaggaaaactaacaaacagaaaggaatagcgtcaacatcaacaaaaaggacatccacagcaaaacgccatctgtaggtcaccaacattaaagactaaaggtagataaaaccacaaagatggggagaaaccagagcagaaatgctgaaaattctaaaaaccagagagccttttctcctccaaaggattgcatctcctcgccagcaatggaacaaagctggacagagaatgactttgatgagctgacagaagtaggcttcagaaggtcggtaataacaaacttctccaagctaaaggaggatgtttgaacccatagcaaggaagctaaaaccttgaaaaaagattagacgaatggcgaactagaataaacagtgacctgacgagctgaaaaccatggcataagaactacgtgacacatgcacaagctttaatagctgattcgatcatgtggaagaaagggtattaatgattgaagatgaagttaatgaaaccaagcgagaagagaagtttagagaaaaaagagtgaaaacaaacaaagcctccaagaaatatgggactatgtgaaaagaccaaatctacgtttgactggtgtacctgaaagtgacagggagaaagaaccaagttggaaaacactcttcgggatattatccaggagaacttccccaacctagcaaggcaggccaacattcaaattcaggaaatacagagaacaccacaaagataatcctcaagaagagcaaccccaagacacatagttgtcagattcaccaaggttgacatgaaggaaaaaatgttaagagcagccagagagaaaggttgggttacccacaaagggaagcccatcagagtaatagcagatctctcggcagaaactctaccagccagaggagactgggggccaatattcaacatacttaaagaaaataattttcaagccagaatttcatatccagccaaactaagcttcataagtgaaggagaaataaaatcctttacagataagcaaatgctgagagattttgtcaccaccaggcctgccttacaagagctcttgaaggaagcactaaacatggaaaggaacaaccagtatcaaccactgcaaaaaacatgccaaattgtaaagaccatcgatgctaggaagaaactgcatcaattaatgggcaaagtaaccagctaacatcataatgacaggatcaaattcacacataactatattaatcttaaatgtaaatgggctaaatgctccaattaaaagacacagacaggcaaattggataaagagtcaagacccattggtgtgctgtattcaggagacccatctcatgtgcagagacacacataggctcaaaataaagggatggaggaatatttaccaagcaaatagaaagcaaaagaaaaaaaagcaggggttgcaatcctagtctctgataaaacagactttaaaccaacaaagatcaaaagagacaaagaaggccattacataatggtaaagggatcaattcaacaagaagagctaactatcctaaagatatatgcacccgatacaggaacacccagattcataaagcaagtccttagagacctacaaagacacttagattcccacacaataataatgggagactttaacaccccactgtcaatattagacagatcaacgagacagaaggttaacaaggatatccaggacttgaacttagctctacagcaagcagacctaatagacatctacagaactctccaccccaaatcaacagaatatacattcttcacagcaccacatcacatttattccaaaattgaccacatagttggaagtaaagcactcctcagcaaacgtaaaagaacagaaatcacaacaaactgtctctcagaccacagtgcaatcaaattagaactcaggattaagaaactcactcaaaaccgcacaactacatggaaactgaacaacttgctcctggatgaccactgggtaaataatgaaatgaaggcagaaataaagatgttctttgaaaccaatgagaacaaagacacaatgtaccagaatctctgggacacattcaaagcagtgtgtagagggaaatttatagcactaaatgcccacaagagaaagcaggaaagatctaaaatcgacagcctaacatcacaattaaaagaactagagaagcaagagcaaacacattcaaaagctagcagaagacaataaataactaagatcagagcagaactgaaggagatagagatgcaaaaaacccttcaaaaaaatcaatgaatccaggagttggttttttgaaagattgacaaaattgatagactgctagcaagactaataaagaagaaaagagagaagaatcaaatagacgcaataaaaaatgataagggggatatcaccaccgatcccacagaaatacaaactaccattagagaatactacaagcacctctacgcaaataaactagaaaatctagaagaaatggataaattcctcgacacatacaccctcccaagactaaaccaggaagaacttgaatctctgaatagaccaataacaggctctgaaattgaggcaataattagtagcctacgaacaaaaaagagtccaggaccagatggattcacagccgaattctaccagagatacaaggaggagctggtactattccttctgaaactattccaatcaatagaaaaagagggaatcctccctaactcattttatgaggccagcatcatcctgataccaaagcctggcagagacacaacaaaaaaagagaattttaggctaatatccctgatgaatatcgatgtgaaaatcctcaataaaatactggcaaaccgaatccagcagcacatcaaaaagcttgtccaccatgatcaagttggcttcatccctgggatgccagactggttcaacatatgcaaatcaataaacataatccatcacataaacaggaccaacggcaaaaaccatatgattatctcaatagatgcagaaaaggcctttgagaaaattcaacagtgcttcatgctaaaaactctcaataaactaggtattgatggaatgtatctcaaaataataagagctatttttgataaacccacagccaatgtcatactgaatgggcaaaaactggaagcatttcctttgaaaactggcacaacacaggggtgccccctctcaccactcctattcaagatagtgttggaagttctggccagggcaatcaggcaagagaaagaaataaagcgtattcagttaggaaaagaagaagccaaattgtccctgtttgcagatgacatgattgtatatttagaaaacccaattgtctcagcccaaaatctccttcagctgagaagcaacttcagcaaagtcttaggatacaaaatcaatatgcaaaaatcacaagcattcctatacactaagaacaaacaaacagagagccaaatcatgagtgaactcccattcacaattgctacaaagagaataaaatacctaggaatccaacttacaagggatgtgaagtccctcttcaaggagaactacaaaccactgctcagcaaaataaaagaggacacaaacaaatggaagaacattccaagctcatggataggaagaatcagtatcgcgaaaatggccatactgcccaaggtaatttatacattcaatgccatccccatcaagctaccaatgactttcttcacagaattggaaaaaactactttaaagttcatatggaaccaaaaaagagcctccattgcctagacaatcctaagccaaaagaacaaagctggaggcgtcatgctacctgtcttcaaactatattacaaggctacagtaaccaaaacagcatagtactggtaccaaaacagatatatagaccaatggaacagaacagaggcctcagaaataacaccagacatctacaaccatctgatctttgacaaacctgacaaaaacaagaaatggggaaaggattccctatttaataaatggtgctgggaaaactagctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagggcttcatgactaaaacaccaaaagcaatggcaacaaaagccaaacttgacaaatgagatctaattaaactaaagagcttctgcacagcagaagaaactaccatcagagtgaacaggcagcctacagaatgggagaaaatttttgcaatctacctaactgacaaagggctaatatccagaatctacaaataacttaaacaaatttacaaggaaaaaacaaagaaccccattaaaaagtgggcaaaggatatgaacaggcacttctcaaaagaagacatttatgcagccaacagacacatgaaaaaatgctcatcatccctggccatcagagaaatgcaaatcaaaaccacaatgagataccatctcacacccattagaatggcgatcattaaaaagtcaggaaacaacagatgctggagaggatgtggagcaataggaacacttttacactgttggtgggagtgtaaactacttcaaccattgtggaagacagtgtcacaattcctcaagcatctagaactagaaataccatttgacccagcaatcccattattgggtatatacccaaaggattataaatcatgctactataaagacacatgcacacgtatgtttattgcagcactattcacaatagcaataacttgaaactaagccaaatgtccatcaatggtagactggattaagaaaatttggcacatgtacaccatggaatactatgcagccataaaaagggatgagttcatgtcctgtgcagggacatggatgaagctggaaatcatcattctgagtaaactatcacaaggacagaaaaccaaacaccgcctgttctgacccataggtgggaattgaacaatgagaacacttggacacagggcagggaacatcacaccccggggcctgtggtggggtgggtggaggggggagggatagcattaggagaaatacctaatgtaaatgacgagttaatgggtgcagcaaaccaacatggcacatgtatacctatgtaacaaacctgcagattgtgcacatgtgccctagaacttaaagtataataaaaaaagaattaaatgtgtttaagataataatccccaaatataacatattggtgctgtgatgtcattgcagtcttttttccctagcatacatttccaaaagtgtagcctacttcttatgtttttggtatttttttctttcatatctcttttttaaataattaaatccttttgaaaagataagtggaaaaaagtacattcatcgttcaaatgaacttttttcttataaataccaaatttttccttgagctttttggtaatggcttagttgggatataatacacgtataatacaatttacccatttaaattaaatgtttttagcatattcgcagaggtgtacataaccatcactgcaatcaattttagaacattttgttactccctaaagaaaccctgtatattttagctatcatttccgaagctccctgattcccctagccctaggcaatctctaatctattttctatctttctctctatgcttattctagacatttcatagaaatgaaataacacaatatttggtcttttgtgtctggcttctttcacttagcgtgtttttttcaggattcatccatgttgtaggatgtattagtccttcgtttctttttattgccaaataattttccactgtatggatatgctgcttttgtttacccattctacagttaatggatatttgagttatttccacctttggggttttatgaataatgtggctattaacatttgtgtataagtttttgtgtagtaatatgttttcatttctctttgctgtatatctagaggtagaattgctgggacatgtggtaaatctatgtgtaaccttctgaggaattgcaaaactctattccgtaggggatgaaccattttacattttataataacattttacatttacatgtatgagggttccaatttgtccacgtactaatcaacacttgttcttgtccatcttttttgttacagacatcctcttgggtgtgatgtggtatcattgtggtttccatatacattttcctaatgactaaatgatgttgagcatccttgcatgtgctcatggaccacttgtatatcttctttggagatatgtctattcaaatattttgcccattttaactcaattctttgtctttttgttattgatttataagtgttctttatattctagatacatgtcccttatcagatatacgatttgcaaatatatcctcttattctgtacgtcatcttttcactttcttagtatcttttgaagcacaaagttttaattttgatgaagcccaatttatataattttaaacatttgtacttttgatgtaatgtataaataagaaggttttgccaaatgcaaggtcacaaagatttacttctataatttaatattttgattgttttagctgctacattttggtgtttgatccacttttagttaatttttatatatatacatatatatatgacatatgtagatatcctgttatttcatcactgtttcttgagaatacttttgttttccccagtgaatttatttgttcttgtcaaaagtcatttgagagacgtatcatgatggctgaatagaaacgtttcatacttgccccctccacttagaaaaaccaaaatagcgtatagacaatcacacattttggatacattatccaagaaagaacactgaacttcaacagaagagtgacaggaaacaccaaaatcaaggaaagagaaggaagagaggcagcctgcttggccgggattggcaggcagctgggagtgacttcccaacacagggaaaggttaagtgagagacttttagtgactcacatccccacactggaagcatgcaatcctggccatggaagaggccctctatcttctcaaagcctgaaacaaacataaggagttaccaggagaccgtgagatggaactgctccagggaaggaactagcactaggacccacacctgttctgagtcttgagtggctacatcaagacactatttgcagtcttagcctttaacagactgcacagtatcctggaacccagcggtgttgggactgaggtgttattgctgctggaaactggggaatcagcctgctgataactgccaacattgctgtcagtgtacactaccctggggcacaaagataggcatgctcagagactgggagtgagctgggaatgaacttacgcagctggagctgagaagcaagtgcatgggttgcagctgccggtgctagaaagggaggaccactgggactaagctgggacatgagtgaagcatgagttgtggctgcaactgagtcatggggctcctacagctggggctgaggcacaagctaaaaatgggctaccactatgttgctcaggttagtcccagtcatcagggttcaagtgatcctcctgccttggcctcccaaagcactagcattacaggcatgagccagcatgcccaagcagtatgctaccactgctagagctggggagtgtgccccactgggatcggagtgtgagagttacatgtgctcaccacccaccagcttggactgtggccaccaacagccccaccctctccagtgacagggccttagcatggctgctaccaccctttccccaaacactgcccaaaacctgaagatcacccagatcctacctaccacaagcagtgcctgctctcaccattggagacctgagcatgagcctgcccacaccccctgagacagagcacatagcctggaatcatgagggatgaacaacccaattcaccactttgggcacctgaacattcctcctaggggctggatgtacgacctaaactcctggctactaccacctcagctgacacctacctgcaaatgctacctgcaggcctggagactggcttggccagcacattgcagccaccacctacatcagtgcataccgcttgggcatgctggctcatgcctgtaatgctagtgctttgggaggccaaggcaggaggatcacttgaaccctgatgactgggactaacctgagcaacatagtgagaccctatctcttaaaaaataaaataaaataagccaagcatggtggcacatgcctgtagttctatctgggtaacagagcaagaacctgtcaaaaaaaaaaaaaaaagaattcaaaatattgattttaaagaagctcagtgagatacaggagaattctgaaaaataatacaaagaagtcagaaaaacaatcagggtatgaatgagaagtttaccaaagagatggatattttaaaagagaaccgaatagaaattctagaactcaagaattacttgaaagaaatacaaaatacgtttgaaagcatcaataatacactagatcaggcagaagaaagaatcatggaacatgaagacaggtcttttgaaataacccagatagagaaaataaagagattaggataaaaaaagagcaagcaattttttgggacatttgggacaaaataaagctactgaacatatgaattatcagtatccctgagggcaaagagaaaatgaagagattagaaaatctatttaaagaaataatagatgaaaactttccaaccctagcaagagattttaggtgttcagatgcaggagtctcaatgatccccaggaagatataatgcaaaaggtcttcttaagggcacattatattctgactttcttaagtcaaagataaggagtgaattctaaccacagcaaaagaaaagtgtctagtcacctgtaaaagaaactgcatcagactaacagcagatttctcagcagaaacttcagaggccaatagagaatgggatgatacatgtaaagtgctgaaagaaaaaaaataccagccaagaatactatatccaataaactatcctttataaatgaaggagaaataaagtattttttaaacaagcaaatgctgaggaaattcactttagggccaccagactggccctaaaagaaatgctcaagggagtcctaaacctggacacacatttactggacatacatttactaccataattgaactcataagcatagagagtagaaggatggttaccagaggctgggaagggcatggggtgttgggggagaggtggggatggttaatgtgtacaaaaaaaaaaaagaatgaatgaataagacctactatttgatagcacaatagagtgactatagtcaataataacttaattgtatatttttaaataacttaaagaatgtaattggattatttgtaataataaggataaatgcttgaggggatacatactcctttctccataatgtgcttatttcacattgtatgcctgtatcaaaatatctcatgtgccttgtgtgtgtgtgtatgtgtgtgtgtatatatatgtatatatataatatacatatatatatggtttgtgtgtgtgtgtatatatatatatatatatatatatatatacacacacacctaccatgtacccataaaaatcaaaaggaaaggattataatatccttataaaaaacacatgaaaacacataactcactgataaagcaaacacacaaaggagaaagggacacagatactaatctgaggagcagagcaggatggcagaatagaaggccccaccaatcataccccctgcaggaacaccaaattcaacaactatctacataataaaagcacctcataagaaccaaaaatcaggtgagcattcataataccaggttgaaacttcatatcactgaaagaggcactgaagagggtaggaaagacagtttgaattgccaatgccatccctcccccactaccctgcagtagccacatctctgcagcatggagaaatctgtacacttgggagagggagatcacagaaactgtgggactttgcattgaactcagtgctgccctagtcacagtggaaagcaaaactgggctgaactcagctgatgcccactcacaaagtgagcattcaggccagcttcagccagaggggaataacccatatcagcagtaggaacttgagttccagcaagctcgctgccatggggtgaagtgctctgggaccctcaataaccttgaaaggcagtctaggccacaaggactgcaaatcctagtgtggagttgggttcagagccagtggacttggggaacatgtgactttactgagacaccagccagggaagctaagggagtgcttgtgccacctctctcacaacccaggcaacacagcttgcagctccaaaagagacctcttccttccacttgaggaaaggagagggaagagtaaagatgacttttgtcttatatcttgggtaacaactcagccacagaaggataaaccaccaagcagagtcatgaggcccccattccaggctctagctcccatacggcatttctagacacaccttggaccacaagggaacctactgccttgaaggggaaaagcctatccaggtaggatccatcacttgctgactaaagagaccttgggccctgaataaccagctgtgatacccaggtagtatgccatgggccttgggtgaaactctgagatgtgatggcttcaagtgagacccaacacatttttcagctgtgatggctatggggagagactactgcttgagaaaagcagagggaaaagtaaaggggactttactgtcttccactttaggtactagctcagccacagtgggatagagcaccaagagggctcatgcggtccctgattccaggccttgcctctgggagggcatttctggacatgccctgggccagagggaaacctgttgccctggagggtgattcccaggcatggcaacattcaccacaagctgattaaagatcccttgggccttaagtgaatggaaggacagaagcctgtatggcttcaccttaccagtaaagaaacacatagactcaatgtaaaggaatggacaaaatatattccatgtaaatggaaaccaaaggtgaccaggaatagctgtacatatatcagataaagcagattttacatcaaaaatggttttttttttttgttttttgttttaaaaaggctgggcgcggtggctcaatgcctgtaatcctagcaccttgggaggccgaggcaggcagattacttgaggtcaggagttcgagaccaccctggccaatatggcaaaaccctgtctactaaaaatgcaaaaattagctgagcatgggggcttgtgcctgtagtcccagctacttgggaggctaaggccggagaattgcttgaacctgggaggcagaggttgcagtgagccgaaatcgcaccactgcactccagcctgggtgacagagagagactctgcctcaaaaaacaaaaacaaaaaacaaaacacaaacaaaaaaaagccaccccaaaaaacaaacagtaaaaaaacaaaacaaaacaaaaactggagaaagagaaaggaggtcattatatataattaattggtcaatccagcaagtggatataacaattctaaatatatatttacccaacactaaagcacccaggaccataaagccaatattactagatctaaagagagatatagactgcaatacaataatagtggggcattcaacaccccactctcagcattagacagatcacctagccagaaaatcaacaaagaaacattcgatttaaactgtaaattagtgggagctaaatgataagaacttatgaacgcaaagaaggaaacaacagacattggggtcagcttgagtgggaggatgggaagaggaagaggagccaaaaaaaaaaaaaaaacaaagcaaactattggctattgggcttaaaacctgggtgattaaataatatgtacaacaaacccctgcaacacgtgtttatctatgtaacaaaccttcacatgtacctccaaacctagaataaaagttaaaaaataatgaaaaagtctgtacattagactgaatggacctaacagacacttacagaagattctattccttaactgcaggatatatattcttttcatctacacatggaacattcttcaggatagaccacattttatgccacaaaacaagtatttaacaagtatttaaagggaattcttatatactgcgggtagaaatgtaaactagtacagtcactgtggaaaataccatggagatttctcaaaaaattaaaaatacaattaccatttcatccagcaatcctgctactgggtatctacccaaatgaaaagaaatcagtatatgaataagggatacttgcactcacatgtttattgcagcattattcacgatagaaaaatatggaatcaacctaagtgtccatcaacggatgaatggataaagaaaatgtggcatatatacacaatggaataatatttggtcataaaaaatgaaatcatgtcatttgcagcaacatggatgaaactgtaggtcattattttaagtgaaataaaccaggtttaaaggtaaatattgcatgttgttacttaaatgtgagagctaaaaaattcatcacatggcagtagaccatgaaaagacagataacagagactgaaagggtgaatttggagaagggggagggtgaagagaagtgggtaaaagggtacatacaattagaaggaataaattcagtgtttcatagtagagtagggtgactatagttaacagaaatgtattgtacctgggtacccaagcacttgggtacttgggacaccttaaataccattttgatccctacacattatatacatgtaacaaaattttacatgtaccccattaatttgtacaaaaaaatcaactgaccctcaatatatgggctacttttttggactctccattccattccattgatctttatgtctatccttatgtcagtaccacactgtcttttttattgtagctttgtactaagctttgaaatcgggaactgtgagttctctaactttgtccttttgtttcgagactgttttggttaatttggctcccttgtatttccatatgagttttaggttccacctgttaatttctgtaagaaaaaagcgagctaaaatctttataggggttcttttcaatctgtatatcaatttagggagtattgctacttcaatagtattatattccaagatatgaacatggattggctttcaatttctcagatatttaatttctttcaataatattttatagttttaagagtatgttttccatttatgctttgtacaatagaaataaaattgattcttctatcttgaccttgtatcctgcacccttgctgaatttgttagttgtaacagcttttgtgtgtctgtctgtctgtctgtgtgtaaattccttagtgttttttatgtacaagatcacatcatttataaatagagatagttttactttttcctttggggaagtgactatgagcagtgggttccccaagactatcccaggtaagatggtttatgaggtggactcacatgactcgaacatagttgaactcatggctaatattattacaacaaatatatttatatacatatgtgtcatatatatgtcggttataaaaagactggaatttattttttgaattttctttttctttttttatagttgtatgtgcttggctctaaggtacttaatatagggttttggacagaaaaatgaaaaacaatcaaatgtgatgatggcattcagatctaagatacctccagatttcagaaatgttaacatttgaatagaatagtacttagcatcttagaatagtattcaggacaagttttgtttggagttttataactgataagagagagccttcctcctacttttcctttctccttctccttcccacacattttgttgtatacgtgcttgtacaaaacctgagtcatagggaatcttcagtgaattgcctgaggttatatcaaaagttggtagctaattcactgtagaagccaccagttcttatatccctgccattctgttgtaggcgttgactgcctggacaacatctttgtgttaagtcagtgatgctgaatcagaggctttcaagaagcctgttttcctcctctgtcagcatgcaagatcctacactttctgcttctggtcttgctttctagctttaactagatcatcctatctctatactcaaaccatatcagtccctataaagtccctgattctttcacctactcctatattgatgccttgtttctttcacttgggatgacattctctgttcccctgtccatgtatttgaatcctaatcaattttgaaggctcagcttacatgtctcattatctattaaaccttcccttttctctcatcctcaatttagatgtaatcatttctcctctctccatgctttatattgcatatttctattctagcatgtactataccctgccttatattatggccagtagtttgtatatatttccatcttctcttaatttttatgctttgtgaggtgaggaactctgtttatattcccatgggccacagcacctagcagagaggagcaaatgagaatccagtggatatttgctgaattgaattacacaatggattggaaggcggctccagtaggtgttagcaggaaaaggatttaatatgaatcttggttttattctgttagcacagaattatgaatgccttttatattgtacctttactgcagaacaaagcactgcatagattgttttactgtagtccaatgggaattcattttgtgatggtttcagaattacccttttatttgtttcaccttttaaagcataacatttgtcaagacaacatttcagtttattgcatgtgctaagtcattactatttacagatggtatagagtatcgatgttcagattgaaaggaaaaaaatacacacatagaatcccatctgccttgcacaggatttaggactcaaacaaaacctaattttatctgtcctgcacatcagaagtagggaactttcaaagaaatcattgctaaaagtaagcatcattgttgagaatttcaggctgtaaaaataatggagtttctttcaaaagattgtttataaacattcttgatatagtttgggatgaaacccatcctggaagaaaatgggaggttatggagtcatatctagttagtaatttgcattagagctatttgggtataaccttctgagtacagattttagatgacctatctgaaggttagggaactagatagatgacatggtaaaagctttgctgaatctcctactagattctactttgcatctgaacagtgcctggcacctggcatttgttcagtatgagtctttcaaatgaataagagaagtttgaatgaatggtatgtatgaatggtatgaatgaatgaagtatgaaaggtagcctccctgaggctgttaacttatctgcaagataagtgttttaatatcaaccctggaggattgttgttaggaccagagaaactgcatataaagtgccttgtgtagtgcctggttgatactagttgctcagcaaatggtagcgattgttcatttactacactttctcagtctgttttcatattggtggtggcaatgagtttattgccatggaagagactatctttctggctgacatttccctttctatttttatttgtttgtgctctgtttttacctcttatttatttttaggaaaccatgtgagagtagaggcatttcctcttttaagtagtttatttgctatggctccgtagtgcttggatgacatggcacgtgtgtgcagcctggttcagaactcatatttttctattgtatatgaatagaaaccccagagaggttggataaatggacatgagagagcgtcgctgtgaaataaagttcaagtgttggaattattgctgttacactctgggatctgaagtaaaaaaatgttttctataaaatgggaaagcttatagataccaatttacttaatttttaagctatcattagccccatagaataactaataaacttagtatagtttaaattcctggaatggtgatatgtactcaaatcatgaaggcaaagactctcagagaaatagttttttttttaatttttaaattttttatttttttttttagacgaagtcttgctctgtcaccaggctggagtgcagtggcacgatctcacctcactgcaacctccgcctcccaggtttaagcaattctcctgccgggcctcccgagtagctgggactacaggcacgtgccaccacgcccagctaatttttgtatttttagcagcgacagggtttcaccatgttggccaggatagtctccatctcttgacctcgtgatccgcctgcctcggcctcccaaagtgctgggattacaggcgtgagccaccgcacccagccagaagtagttcttaaaagatcatttgaccgggcctggtggttcacatctgtaatcccaacactttgggaggtcaaggtgggaggatcacttgatcccagagttcgagaccagcctggacaacacagggagacacccccaccccgtctctacaaaaaatagaaaaattagctgggcatagtggtgtgcgcctgtagtcccagttacttgggaggctgaggttggagcatgggttgagcccaggagatgggaggttgcaatgagccaagattacaccactgcactccagcctgggcaacagagtgagaccttgtctcaaaaaaaaaaaaaaaaaaaaaaaaacacatctttttttagcagaggcttcactctgacagggtaggcttaaagaattttgaccctctatttgtaactactcataatgtatcttaaatttcaagtttcttgaactgttaccaaagaaagtttccttgttaataactgcttgtcaggaaatttttattttatatttgtgaacttaatttctgtgttgtcacataatgagacaataggatgttacatagattttctataatctttctggagcatttaacaacgtatctccatacactgatttccatgctgaaaataatttcacaaggaaatcattcattatggggaaaaaaaaaacccacattgcttaatccaatttaatttactgaaggaacaatattcacttaagtccccaatctcttccttcttatagaggactcttggacattgaagatgaacttttacatattcttaaggtaaaaaatataaacaaatcccaaaacaaatgaatatgactcagaattctattaatttcaaatttggaacataaaaactaagttcctcctgcctcccttactgacccctcccaaattcatgagtatatagattttttttgctttcttttcctagaatcacttactgttgctgagaatataccattaaatcttattctaaaagataatctattccagtcaactatatgcttgattttcctctcttttctttaccacagagcagcttggcctttgtttgaatgctattaatgataggaaagggattgtctatcttccatgaaagtcatttcatctacagacagttctgactttagaacaaagtgcttcttcatatggagtctttctagctctctctcttgctttctgtttgtcttctgtctctctctgagggtaaaaaccaaccaatgaacaaccaaccgaccaataaactgactgagcaaacctgatcaataggtttgagaaatactgcatacatagcccatacccaaggagtcacaatgtgtacatgtgtatttactaggaaatattgcagtgtgtttaacccctaatatttcacaaacttacttgattgtgaacttttactttttttcagaacatctgtccaaacacagcttagagcagaatctggcatatagtagacactcaataaatatttgtttaaaaagtgaatgaatgcaaaataaatctttaaaaactttaaagcacatgctgtattgagatgatccatgttctgcatttttacaagtgacacagccagactagagctactgattggatgcgtataccttccttctctatgtgagcctttctaaatcaattatttatttccacacattttagaactttaaaaattcatatttggatttctaagtttgtatcctcattggcacaactaccttttaaataataaaataaatattagtgatgtgtttgcttgactcttttgctttttgatcatatgtaggaatgaattaattggaaatgcttattttgacttttgatttcaatttgtatctgattgtgtttgattgtacaagcacatggattttcagcagaagtcttaaaatgaagatttgctccagtagggtgtttttaagggtgtttatcagattacctgttgagttacagccctttatttggcttctaagtcagctcctttttgggcttagcaacgagtccaatgtaaggagaatgaatcctttttatctgtgagtagttgagttttctacatgagacagcttgacaaccttcctatcaaacgtaaatctagtcaacaaggaacatgctgtaatgtggacttgatccaggtttggtgatctaggctttttatttctcatgctctaagtgaatgcatttaaaaggtcagcaataggaacagtataaattatttgttctcacttttatatttcaggaaaaaatccgtgtggaaattcgagagggtcagctacaaagctgggtgtaactcagtgtcacaactttatctaaagtcagtattttctgtttctctttgttctcagcaacaatcttacctcgtcccttgcagctgctcaattgataactgtgtgtcttctgttgtctttcctgtgttatcttcttccccttcagtctgtttccaacccagaacttgatcatttattaaagtagtaatattttctcttgtaaccgtgatttcatcctttctctttagtgtggaaatgttattttattggcacagttgtgggctacattttatgatagaaaacatcagtctgtttttacatctatggattttacatgttgttggatctcatagaatgtagggtaccttaaaaagcatttactggccgggtgcggtggctcacgcctgtaatcccagcactttgggaggccgaggcgggcggatcacgaggtcaggagatcgagaccatcctggctaacacggtgaaaccccgtctctactaaaaaacacaaaaaattagccaggtatggtggcaggcacctgtagtcccagctactcgggaggctgaggcaggagaatggtgtcaacccgggaggcagagcttgcagtgagccgagatcgcgccactgcacttcagcctgggtgacagagcgagactccgtctcaaaacaaaaacaaaaacaaaacaaacaaacaaaaaaaaacagcatttactgtattgccctcatttctaaagtgggagtaatgaccacagctaatattgtactgaatgtggaaaaattgaaggccttttgtccaagaactggagcaagacaaggatgcccacttttgccacttttattcagcacaacactggaagtcctggccagagaaactaggcaagagaaagaaataaggggcatccatactggaaagaaagaagccttattagttttgtttgtagatgacatgatcttgtacccggaaaaacctaaagactccatcaaaaaactgttagaactctatgagaacacttggacacaggaaggggaacatcacacacaggggtctgctgtgcggtggagggaagggggagtggggagggataacattaggagaaatacctaatgtaaataacgagttaatgggtgcagcacaccaacatggcacatgtatacatatgtaacaaacctgcacgttgtgcgcttgtaccctagaacttaaagtataataataataataaaaaactcttagaactgataaacaaattcagtaaaggtgcagaatacgaaatcaacgtacaaaagtcagtagcatttatatacaccaacagcaaacaatctgtaaaagaaatcaagaaagcaatctgatcacatttacaatagctacaaaaatataaaatacctaggaatcaatctaaccaaaaagtgaaagactataaaatttgatgaaagaaatagaagaggacacacaaaattggaaagatatttcatgatcatggattggaagaattaatattgttaaaatgacaattctacccacagaaatttacagattcgatgcaatctctatcaaattccagggcatgcttcagataaatagtaaaaaattctaataacgtatacagaaccacaaaagacctgaaatggccaaagcagtcctaaccaaaaagaacaaagctgcaggcattgtactaggtaacttcaaaacttgctacaaagctgtattgaccataacagcatgatactggcataaaacagacacatagaccaatggaacagaatagagaacccagatgtaaatccatacatttacagccaagtcatattcgacaaaagtgataagaatctacaatggggaaaggaaatattttcaataaatgatgctggaaaaactggataactgtatgtggaagaatgaaactagatccctatctctcaccatacacaaaaatcaaatcaaaatggattaaagaacttaaattgaagacctgaaactatgaaactactagatgaaaatgttggggaaactttccagaacattggtctgggcagagttttttgtgcaaaacctcaaaagcataggcaaccacagcaaaaatagacaaatgggatcacatcaagctaaaaagcttctgcatagcaaaggaaacaatcaacaaagtgaggagacaattcacagaatgaaagaaaatattcgcaaactatccatttgacaagggattagtaaccagaaaatataaggagctcaaacaactcaatagcaaaggacccaaataattcaatttataaaatgggcaaaagatctgaatagacatttctcaaaagaagacataacaatgaccaacaggtatatgaaaaaatgttcaacatcactaatcatcagaaaaatggaaatcaaaactacaatgacatatctcaccccagttaaaatggcttgtatcaaaaagacaggcaataacagatgctggtgagggtgtggggaaaggggaattcttgcacactgttggtgggaaagtaaactagtacagccactatgaagaacagtatggaggttttgcaaaaaacgaaaaatagaactaccatagaatccaacaattccactctgggtacatattcaaaagaaagaaagtcaatatattgaagagatatttacactcccatgtttattgcagcactatttacaatagccaaaatatggactcaatctaagtgccattcaacagatgaatggataaagaaaatatggtatatatacaccatggaatgttattcatacataaaacagaatgaaatcctcttatttgcagccaaatgaatggaaatggtggcaattatgttaaatgaagtaagccaaacacagaaacacaaatactgcttgttctcactaatatgtgagagctaaaaaaatggatctcatgaagatagagagtagattggtggttaccagaggctgggaagggtagaggggaggggatgaaggggaaaaaagaatgtaaatatatttattaccactgaactgtacacttaaaatggtaaattttgtatgcatattttaccttgataagaaatataaaataaaatggaggtaatgaggtgaggagtggggagtgacttgttgaaaattacagagcagctaagtggtcaagcccacactaggccctggtgctcccactcccagcccacagacttttattttgggtcctgaggcctctctcattacatgagtgcttaaattgtagagtaagtggacatagtttccatagctatgcaagagtctgagtggtatcagagaatcaagttgttcatattaatacttccagatctgccacctgacataaaatgcatcaattcgtctttgtacttgttcctactgatcaaagcaagggagaaatttgggtctcctattatgtaggaatatttttatgtctgatgctttctcatttaaaaagtagaacacattttaactattgccacttttgcaggctcctcaggggagaaagtgttcttgtatcttttgcattaccctcattctcacccttcttccatggctccatgcctgaaaatgtcaatatgtgacacatgtttgtagctgttataaacacattcttttatctgattaaacatctagcatggaaagaataactgcgagtgtaaatgtgcatgccttgatctgaaatatatcgagtctaaatatataaaattacaagacatttttaagaaatgactttatgtattgacaaattagatatttgtaatggcatgtatcttatgaaaataaacatcaattaaaattgctttatgtttctaatcatgtgtcgggggggtgtctataacagataacctattccactgtctattgtggaaccattgagaacttttttttttaattcccttgaggattgtcctttataaaccacatccatgtggtgtgatttgaggagcactgagaagggtaatgcatcatcagcctgacaccaccagagaccaggactttgaaggcactttgtgtcagagagcaggtgaaaaacatggcttcagtaagagatgtgaaaccacaggcattaaaaccgacaagccaaaatagcctagtttgatgacccgttttcttttaaaaagttttccttgttcatggaccagaggcaggtagtgtactttgatttttggcccctatagagttcactagaattgaacattgtaagttaacacttaagatctgggacaatcaaagcacattgaacaatgcatggacattgttccatctgtaatgataaaaaatgagttaatatgctactttttattgaacacttaccattatgccaggtatttcacatttagtttgcatggtaccttgtgaggtagatatcattatgcccagtttatagctgaggaaactaaggtttagagaggctaactaacttgcccgcgtttgcatggccagtaaatgcaacaagctggatttgaatccacgtctatctagactaagaagcctatatggttaaccacttgtaaaatgggataacagtacctaccttagagattttttaaggattcaataagattaaaaaatccaaaaagcactttgtaattgctaataaagctttgtagagtgaaaggcattatcagaagtagaagacaatctgctacagtgtctccccatgaccatctacccttcaaataaatccgaatgtcctggagtttgtgcctttgtccttggctttctggtgagtgagagtagtttatgttttgggcatagattctgagaagtaggtcactggttctacttattcagtgatattttcgagtgtgatttctttgccatgtagttgagaggaggaaagagatcgacagtgtctgtggacacagacctgtggggctcccagaataattttagacacagtgagaaatcatgtgtctaaaatcatgtaaggctgtaccttaacatgtatgtcatttcttctattttcgtttgtcatagaaaccgatctgctcctccgtataaaggacatcagtcatttcttaatgcaagacatcgccttcttgtctggtaagcaaactttcttatatatagtccagatagatatatgacttgattagcagttagtttggtacctattatataaatagctcgctctctatatatagagctattatatatattcatttgagaagcactatttcaataaacatttgtacattgtgcacctagttgctaaacaaatggacatttagagaataattggaggttttaagcattttagatatatgagtaaaaccgaccttaccactcttatacatttgactttcagacgagtcttcagaaatctatgatagttgaaagtagaatatgtctcctaggtggttgcaggctgggtgggaggggagcagctgaggtagcttctttgattactcaaatgtgtattacaaatggtggcaagttgcactaaataatcagcatgcactaagtatttttttttaggatttcatttacacattataaagaaagttgatttttctcaaagatgtatatacacttgtatataatttttagtaattatggtaaaataaatttaacatacaacttatcattttaaccattttgaagagtacagttcagcggcattaagtacgtttacatttttgtgccaccattgccaccaccatctccggagtttcaggtcttgcaaaattgaaactctatatccattaaacaattactccccgtttcattccttcctctctctagcccctgtcaaccgcaattttactttctttctctatgaatttgactatcttaggtacctgatgtaaatgaatcataaggtatgtgtctttttgtgactggcttatttcacttagcataaggtcttcaagtttcatcgatgttgtagcatgtgtcagaacttcctttttaaggctgaataataatccattttatgtatattccacactttgtttatctgttcatccattgatagatactttggttgcttctaccgtttggctattgtgaataatgccgctaaatagcattacccatttttagagacgtaactatggtaaaccatcctgcccctttagcttctggtcagactttggggaaagttttgcttaaaaacaagcaaattactttcaggtattagagtaatttgaattatatcattaaatattacatttagcatattaaacagataaagaaaacttactggtatatattaatacattgtttttataaagacgaatgcttcttaggagtacaagaaactatcttattccttctaaatagtttaattaattctctgaaaaatggcactcacatgctcagtttactaaacaagcttttactttataagtgatcctaattagacacttcaatctggcctctgcttttattatcattattattatttttaaagacaacttcttgctcttttgtccaggctccagtacagtggtacgatcatagctcaatgtaaccttaaactccttggttcaagtgatccttccacctcagcctcctgagtcactggaactataggagtgtgccaccacgcctagctaatttttatatttttgtagcaaaagggttttgctatgttgcctaggctggtcttgaactcctggcctcaagcgatcctcctatcctggcttctcaaagtgctgtgattacaggcatgagccgtcgcacccagcctggcctctgcttttaaatgattataattatacctatgataaagcttaattaaaaatgattctaattagtggtaactgtgaattaatgatgacttaattaatatggctttatgttttattttataagtggcagaaatgtgtgagtgtcagtaaatttagcagtatgttacgttcacttttaagttttggagattttacttaagattatctgtgttttccaaaccgtgttctaaatagaaccatcctcagggcttgctgcacccatccagacccctctctacacctttccttccttaactgctttttgtatttgttttaaaaatgcttctacctatagcttcctttgaagaaagggttcccaatggtaaaaaataattaaaacttcctgatttggaatgtaaatatctcttttgatctcttctcataaagtttactcgtaggacagtacttgtaggtgttcagtggtaataatcatttatagattagtcaatgataatttactcttataggagccttgccacctttcctttgataagtgtagtttgcctaagtgctagatggttctgtccttaactagagtgctcaccagcttgcttggcaagtatgtagttatatttaagatatttattacattatatattacatatcatttatattactagttctataccatactgtatctatagaggccctttgcttaaagattcactaaatctcttggttcagaattgtacagtttctcctttgagttttttaaaaactcttcagtggatgccattattctcagtgattattttcactctactctaattctggaatatcatacagtgaagattaataaccctttgatttaatactttggactagtttgattaaaaaataatttgggaatgaatactgtctctcaagtttcccttggtaaatattgaggcaaataattaatttgatctttttccatgtgcactagagaagaaagtgtattctgcttttgttggatggagtgttctagaaatgtcaattaggtcatgttggttgagactgttgttcaggtatacaatatccttgcaaattctttgtctacttgttctatcaattattgagagatgggtggtgaaatatctgactaaaattgtgaatttgtctatttcctcttgccactctatcagtttttgctttgtgtattttgaagctctgttattaggtgcataagcatttaagattatgtcccattgatgaatcgaccactttatcatgatcaaatgatcattttaatatctggtaatattttcgactctgaaatctactttgtcaaatattagacagctttgttttgattagcactgtcatggtatatctttttctatcctttgcttttaataatttgtacttttatatttaaaatgtgtgtttcttgtgggcagcatataattcagtctttctttttatccagtttgatgatctttgacttttaattgcagtgcctagatcattgacattttatgtgattattcatatggatggatttaaatctaccatcttactatcatataataagcaaaatacaaatagtgagatggtagcttttcccatttgtcccatgtgttctttgttttcctccatttctgtcttcttttgcgttgagtattgttgtgattccattttatatccttttctttttctttctttttggggggggcgtggagagacggggtcttgctctgttgtccaggctggagtgtagtggcatgatcttggctcaccgcaacctttgcctcccaggttcaagcgattctcctgcctcaacctccggagtagctgggattacaggcgtgcaccaccacacccggctaatttttgtatttttggtagagacagggtttcaacatgttggccaggctggtcttgtactcctgacctcaagtgatcctctggcttcggcctcccaaagtgctggggttacaggcatgaaccactgtgcccggcctgtatccttttctattgtcatatttttattgcagattgaattaaaaatatttttacatctttattcacttaaattcagccaaataaaaattacaactgaactaaaaaaatttctattgctgagctaatttcaaaggccaccttgcaactttcctcctaaaataattcttcagattctatttggcacttagtatttattgagcattcgctctctgtgtaggtgctaggctggctgcagatgtgaaccttaaacacatgtaaggctcatctctgcacttaagtggctttcgttttcaatatttctcatccttcaggctgcatagagggctattgggctgggtggagaaacgggtagaaaccaaaatgaaagcccagagctggtgcaatcattccctcaccaagaacccctatgacagttaccattattcctggttcctatggaaatgggcttagggcagcctcacctatgagcactgggatccatgctttccaggagtcaaggtcacccacttggtcaagatactgctggatgcaactgctccaggttaatggctgcatgggtctgcggggagcttccacaaccctacacctctgcctggacccctacccaggctgaacattgaattttgacccacagataatttgtgatctttctttgcattaataaaattcctatgtcattcctgccatcattccttttgttgtttcttccataaacacattagaccatcacctatttcctatagggtgctctgtatcttttcctgctcaccatgacactaagagatcgattatatcaaattttccacttgctgtcaagccatcattcactcattttaaatttaggctcattggtatagaaacagttatttcccaaccccttggttgtccagattggggaatcagctattttccactgtatttattatatgcatttcatgacattttcttctgactatattcattcattttactctctttctttttctttttttattgagaaactactctgccaccttttaaacttaaagtgtcaggaacttggagccattttggttttatgtggagatcatcatctttgcaaaaaagttgtgttgctgcaaaacagtattcaaatctaaaatcctcttcttgcttcgttgttatatacatttttaattcagttgattatttttctattgttgtaggtggccggggaaaggacaatgcttggatcattacgtttccagaaaactgtaattttagatgtataccagaggaagtaatagcaaaagtacttacttacctgacatctattgcaaggtatagtatttcattacatttttttcaattcgctttatatcagatatccatctgaatgtcataacatgaaaatggcttaatatagctattattatcatggtgaataaccaactgacttaacttcagagtagataagaagtacaacttagaaggagaagctggcagctacctaaattgttacaaaaattatcctgagaatctatgaaaataaaattggggatctaggagtatttgttcccatcaaaaagaacataggttgagaacgatggtcatacatatatgctttaatttgcttaaaaggaaatattaccagccaagagtgagtacagccatttttcatttcttctgaatataacacaagaagactgaatcttaagtagattcaatagtggtactgggagatactaggaggaatgtcttgaaattaaaaattatttggaactagaatgctttaaaatggaaagtttaaaaaggtttcttagagattttatgtgtgttaaagacaaaattttcaaaggaagaattttctagttactaaccctgaagaacaagaggacacaaatctaggatgataaaattcaaagtctcatgaacaaaaatcaaatctcagaaaatgaaacttacaatgtacctattgaagcttgaaagtgatatttttagggcaaatagaagttatattttccattaaactgcatttcctcaggagcagactagagttagaaaaatagatttagcagtgtgattttgaatgagtgaatggatcattgactcatgatggattgcatggaaagttaaatctgatatcatgaaggacacttatcttttgagttttcccacacccaagattacagtattctaaatcaattttagtgacctatcttcattacactatcactttcctatttaaaagattgacattaatgctgcaaaagaaattttaaatagtgagtaagggaatatgtattcagattagttttctaagataggactttgtgatagctttccaattccaaatctgtcttcagtcaagacatcaaatgtagatgaaataatcagaaatagaatgaaggcatatataacaaatttgcattattattaagaaaaagttcttatttcttcttatcgttcaggcaaaatggatcagactcccggtttaccattattctggatcgaagattggatacatggtcttctctcaaaatctctctccaaaaaatctcggtaagtatctatgcattatacagtaactttttatttttgttttatattatactttctgttttgggaggtatagattactttggtactgacggagacaataaaaattgatggaatgtgaggagggaaagtagaaggagaggttgtagcagagactgagataaataactctacccaaaataaaacctagtaagaatgagtgagtagtttgtggctccagttatgagtgagaagagattcatggttctatgtgcctttcaggacaaggcaagtttttatggaagctttttaaaattatttatttatttatttattttggtggaaatagctgtgttgcatactcgtatgtgaaaaagtataaagaagaaagtttaaaacaatagtaatccaaccaccccaaaataagcagtttttaacatttcagtgtacaactttctagatttgttttaccctaggatagggtagggagatgagtcacatataaaatgatatataacttccctactggtatctagtccccaggttcccaagacccagagagagaaacattttctctaattaaaataacgagaggtacaattctgcccatgaccaagataatcttttacacttttaggctcacaagggtatcacaaaattgtttgacacttcactttcatagacgaggagggagatgagggacccccagactccttctgagctggcaagatatgggctctctgtggaagtgccatgtggccaacttcctctatcagactagaatagctgggaatcaatatattttttttctttgagattccaacattgccagccatctgaaattcttactttgtctcctgactgattgaggaggtcacgcccaccacaagaacttgatttagttgcaaaggcaaaacaaaaatctaggttgttggacttccaagccaatgttctagcacttgcaaggtaaaatgggtaagatcattattcttttaatactcagaatgaattattcctcactttggacaaataagcaaaaagtggtttcctgtttatttaacagaggtgtttaatcattagcagtggagagaagagttaacattagatatactcaaattactaaaataaaatagaagaaaatttgactttctatagcatattagtgctttttcaaaagcattcacatttattaagtattgttgattctcttcatttcctgattaagtactgcaagtaggtatcactataattgtcttatagatgatgaaatcacattgatatttatactttggaatggctatgtgatgaatccaagctcaaatagccaagtaaccaaaaaagccagagcaagaattgaaatgtcaagaattccagttggtgatggtttctatcattttccaattggcttacaaatagacaaatacattcaatgttatttagataaaggtaaaatttcttttgagagattagatctgtcctccatatacaattgagccttatcagtggggctaaataaagtaaaagctatttcccttgctccggtcttttaggattggtccttgggcttgctgagtagaccttggtttatgctaataattgcttctcttatactaaataaagcacttgttacattagaacattttttatcacccaggtttttttcttttggccaacactgcacccgcctgattaaattaattttcattttgtgactggtttggcacctgacgttagtttttttggtagagttttatttttattattcaaaataggtggcttgtaacagaggttctatttttcataaaagagaaatataagattaggtcatgatcctgtcattttgaagtcaacagagggtaattacttgtctaccggggagtgatactcctctttctgtattcccagggctgctttctcagtggagaattttgacctatgctcagtaaagaacttggatcccagggtccctttattttcataactgccaaattgatcgtgctgggcaagggaggggtacagattctgaccacatgtaactggctataggttgttttaggtgtttcttttttaacatgttaaatgtttttgcttgtggtatagtttctatactcatactcaagagcacattaattacatctcaaccattagtaactgttggttactgtttgaaataaaggtaaatattgaatgcaagctaatttcaagtgcaaaagttggcattcagaaaggatttctagtgaaatctaccattgtgtagctaggtataattgcctgtggtgtattatttcaaacaagtgtctgtgaaataatcatacaattcaatttgaatacctttatttgtagatttcaaaacaaataaaagcatttaggttgtatttcataattaatgagaggagactttattttagttatacattttggggaaaggttaatttgggagagaattgtatccgtcttagaaagtttgcatgttctattctttctagattattaccaggacaaaattttgcaaactatagcctttcacaaggcttaaacccagaatacaataacagagaaaacaaaacagaattgaaatttaagtcacataccagggtaggacgagagtaaaaagcatgagttaatactaccttcacaaagattcttagcattccaccttaaaaatcaaactgcgcagaggagaaagccagtcccatcaagcctgctcctaggaagagagctggtttttttttcctcctccttccactcttaggacatgcctgatcttcttgagcagtccagcacaagctaatccacaaggttcaatcaggctaagtaattggaggaatgtgttaactctgaattacaaggagcagaagggaaggatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggtaagggctctgtctgcactcctggaaagcctgttcccaagttcaagtgctgggatgctgcagcatggtgctatagcacaaactgctgagtagggtttttaaggacagatggagagaatggagacttatatttgcatggattgcattgatgtgattactgtgatattgacatagggtaattttcaggcaattgagggggtagaatataatttcaaaatctaaatgtcatcaggtttatgaatgagcaccttagtcatgttattcgtttaagactgtatgaacaattttgaatcattggacagcatagctttaaataatgacttaaaacaatatctaacaaaaggattcatcctttctttcaccatgatcaagtagagtatattgccatggataggtctggaggggattccatcatcacttaaaaatgcagcctttcctgggtgttaccgtataagtgaataaatttaaaatctgtaatgatttgaaatccttatggtttcaattcttctccaaactgaaacttcgtaggtacaaaattgtcacctgctgacaacttttttcttttagggaaaaagacagtaactcacttttcaatatagactagaatttggaagtctctcctctcaggtacatttcatgcagtcttttgcctaaattttcccttcattcatttattcatatagtaaattcccagcaaatttctaatgtgatctttagatgtattttggagaaatgttgaaataacactagctaatttaataaaaaactaatcatcaaaaaggctttaaatgccactctttttctttcaaagattaatataatgttattgatgttatggtttaaaatataaacttgctcactaaaaatatcgagataacacacacacacagataagaaggtaaaaattgaccataggaaaaaaatgacagtttgaattaaaattatgataaggaaagtaagacttttattattgttgaatgacagtgaacatcaataggtgtgtaaatgatttattttctaataaagctcttagcacagactgctattttaaaaactatagttggctttattttgacaaaattatatctttggctctatacatgtttttatattatgagaatatagattcagacttttaacagacgatttatggtgcacaagaaatgtttgtgtatgtactttgcagtattgtaggcaactgatattagcacttttgttatcaaaggttaacttaagctttcagaaagttcctaattatatatatacatatatttatatatatatttatatatatatatattctcagtgctgaacttagttttatgtctatacacatgcattaatatacacacaataaatacagcacaggggtactcactgaatagacatatctagcactgtgatatatacaacataagttacaaaggtaaatatggaatggctactgggctgaaggaactctcaatctaatagaaagggtaagacatgttcgtaaatgactattttgaaaagaaattctggctggtggagaaggccttatacaggagatggcatatgtttgggtgttaagtaagagtatatgttgctgttacctttccttgattctttcctgtgtttttttttctcataaatgaattaagtgatatgtaggaacagatatgagtgggattaattggattaattctgaagcctagaactatagtagaagacacatatgctttccttatatggataggacttgaccagagtaaagaatttgaaccttagctagtaaaaaaatggtttcaccttgaagggtctctggaattgggctgattctggaggctgtggacaggtaacatctaaaaggatggtccaatgccacttgaagtccaaaaaaatgtttgaactagttacttggtagaaatttcaatgactgtagctgagtgagagagaggggaggagaatagatatatatgtgacgaaaagggcaaaccacaaggaaggagtattgctttgggctatcctcctgacgtcacttgacaagttgcttgacaactcatactgtctgtactttttaaggtggggatatggggggaagagtgtggaagtggctcatactgttgcaaactattctctatagcttgaggtcatgagatttttttcccaacatattctgcagagatggttcagaccttatgaaagtcaagtgcctgtcagcatctcaacatttgtctgacagtaaattatgatactttccttttggtggactgtatatgctaaattgtttccagcaacttgtttcaaatgttatttgtcccattttggaaacatcaaggtcaaatcatccctgaatggcaaacagtaaatccgagtgtgcattcagtctatgaggtgttaagtgtctagaaagagtttgcccttaggatccagataggccgtactaccgctgcttaccaactgtgcttcagtttgctcctctgtaaaaagggaataatatccagtttactgcaatgttttgaaggctaaataagataatatatatataagaagtctgacacatacataatggcttttagtcaagggtctctcttattgttactgcctttctttaccctaaagattaaataggaaaagctataggaaaataaattatttttatagtaagtaaccaaacttttatgttttataagttactttaaacattctagaaataataactagaataactgaaaagtgtgcatagggtgatgaattgcctcccttagagagcacacacaagagtattaaacaaggttaatttctagacttcggtagtgaaatgatgtatttggtttacgcctgctcttgttgttattgttgttgttactgctgtaagatcatagaactaggcaatctggaagtacgtgtgagtaaaagggagtaaatctgttctctgggagggaaagatgagagggagcttattttgtgctcgttaccttgaagagcctgtaagagctgctgctgagggctggggtgggaccacgtacagtgattggacacatggctccgagtcctatgtgataggcagctggttcgcttttactgagatgtctttaagcagtcacatgctggaactccagaaaaatgtctgcgagaacctaaaaccaatgctgtttcctctctcgtgcaaactatttttttaaaaaagcaaaaacacattgaaataaaacaagactaacctttgcccaaatccctttgcttttttgacaagttctcaaaaatgaattatactttcaaaatctcagtttttattttggggaaaaagaaattgtgctttttcatgtttatataaccatacagattagaggttcttaaagcagcatacccaagaatttagaaatataatattcccaaaccaaaatgggaaagttcactggtcttgaactatatttgctttgatatgtgcatctgataccctatgctgtttgattgttcatttaaatactagctttaaaatggattatcttgagaattttagttgttacaaatattggtatatagagaaaaagtactctctatatatacttatatgtatatcaacatagatacatacaaactaatcttaaatgtatatggcttgtcaggttaaaattgctcaagagtgttctgtcccctctagattctcatagccggcaatcacagataaggacgtgtccatattattgatattgattgatgttcagatctatgaagctttttggttcagaggttgcaaattgtcagtgcacagatgcgttttgtttagagtatgcagcattttaacaaactttcaatttgttttccatctttaaacatctgggctttgcatgacaatctggatttctgtcttctcttgagaaaccaaagagttggcaatgctgggcccaccttgccacatgacaacatgtagctggaactgatttatgagtgaactgacttatgagtgccctctgctttgaatgttctccagttcaccatggtccccaccacttcctgttgctcctcgtcatataggaggagtatgaattgctattttccacctaatttaggctgttctttaattaagcctacttcacatttacattatctccctaacacatggtaggcattcaagtttgtcacctctgctttaggtctcaggtttagattctcaaccaacctgattcttgtgtcatccctgctataacttctgcaaattcctcttgttgactgagtctagttcaacaggcaggtgaagcggggttttaattctgctacttatgtgctagaaggtcttgaaaaattgcctgacctcacaaaacctcaatgtgttagttccctattgctgctgtaatagattactacaaacttagtggcttaaaacagtgaaaatgtatcattacggttctggaggtcagaagtccaagattacccaactgggctaaaaatcaagggtcagcagagctgtgttccttctggagtctctagagaagaatctgtttctttgacttttctagcttgcagagatcgtccacattccttggtttatacccctgcatcactttgacctctgccatcacatcttcttctctgactctcctgcctccctcttatcctaatgattacatcggtcccaccatgataatcccggataatctccccatatcaagatccttaatcacatttataaagtctcttttaccatataagataacatattaccaggttccagggattaggatgtagacatctttgaggataatggcactcagtttctccagttgtgaaatgaggacaaaaatagaacctactgcatgtaaatacttagcacaatgtcataatagtgctctttatgggcataattctagtagtatgcattcaataaatgacatttccacccctgtccaactctccaatctcctttccctaccttaaagctttgagaggtcctgaatatataaatatacataaatatacgtattttttttgctaaagagaagctatgaaaagtagtcataaatgtcatactttaaaagtgtgacagtttggtaggcacctgttatggtctgggttaagtgaatgggagtgggattaaaaattcaggtatgtcttattcacgtgtgggcacgagggatgaaaacaacacacctggtctaaactatatgatttagttttctagaaaaataactgacaaatcagatgaattgtttgagtgccacctgattgctctgattgcttagtagttgtgtagctattgcctacaagttatttagtctcccaaatggctactaaaattgggagtaactattgggttaacagaatccatgtgctctaggaagatatgcaaaaaagattataaaattgtactataaactataacaaaaaatattgtaaatgttattatgtagtcaataaatgaagttttcatcctttgatggtgcattttctttaaaagcccaagtttttctgggctttttgtgacaagtgaattactaaacattttgaaggaattaaggaatgagaaggtatgctaagataatcagaaggttttacttaagaatgaactgattagcatatagaattatctttagaagcaacttatatagccgtcaatgtttgggataatccactttattaaatagagcaataacaggtttaataaacatccaacataaaatccctagcttatgagcagctgaatacccctacccctgcttaaaatcacttccccactcatcttgcagacggtgattttccttctctctcctttctttctactttgttccctgctatgtgatcagctgtctctggacctggctgctggtacagccttgctctcctaggaatggcagagtagagagcagggccttacctcaggcagagagttgctacatagctctctctattcccatagtatcctcccatcccctcctccctcacacataattttggagatgggtgagtacccctggcttgaagtcagccccaggttcttgtatccagataattctagatacaagagaatatgagattaagggaagtcagagagagaaagatgaaaccagatcaacttagaatccatgaaagaataaaagtaattttgctttaaatgttggcaaaagtagggtgctttcaatttcatttaaaagtgaaaaaataaacaggttcaaggcaggtgagtataataatataatgggaatttacccaggtgaagaaaaaggaaaggcttaactcctaaaattaagggagtaaaaatagaatctgtgctttccacttaaaaataggccaaaagttcccacaagtccctgtcagattcttcccttaagctagcctttatccatatccctaaagttttctacccaaacctgcttgttctgacgtccgagaatccaaggcaaaattttaaaactatcttattaatattttttacagtttaaaaagtgccttttcatgtccttggcccactttttaatggggttgtttgtttttctcttgtaaatttgtttaagttccttaaatactgcatgttctcacttataagtgggagctaaataagaagttatgaacacaaagaaggaaacaacagacacgggtctacttgagggtggagggtgggaggagggagaggagcagaaaagatcactattgggtactgagcttaatacctaggtgaaggaataatatgtacaacaacccccactgtgacacgtgtttgtctctgtaacctttgcatatacccccaaacctaaaataaaaattttagaagtgcctttatattcattatttcttttaattcctgtaataactggaaaacatatatatatattttttttcggcagagtctcaccctgttgcccaggctggagtgcagtggcataatctcagatcaccacagcctccacctcctgggttcaagtgattctcatgcttcagcctccccaggagcggggaccacaggcgtgtgccaacacacccggctaattttttgtatttttagtagaaacgggttttcaccatgttggccaggctggtctcgaactcctggcctcaaataatcctcccacctcagcttcccaaagtgctgggattacaggtgtgagccaccgtgtccagctggaaaatacatattatacttaacataaaataaaatatacattacgtacataatagaaggtaggatatacattaccgttggaactctctgtttctctgtctctctctgtttctgtatacatgttaactttattcttttcaatgtttccccagcagcagggctcttggcaatctgctgcttttgaatggcatcctcaaagtttccttcactcagtattcgtttgaaaattctagggcaggacttctttggccctgcttacatcaaatgttcatacttatgttttttctttttcttttttaaaaagatgaggtctcgctctgtcgccatcatggctcactgcaggctcaacttcctgggctcaagtgatcctcccgcctcagcctcctgagtaactggaaccataggcgcatgccaccatgactggataatttttaaattttttgtagagatggggtctcactatgttgtccaagctgttctggaactcctggcctcaagtgatcctccatcctcggtctcctagcctgttgggattacaggcatgaatcaccatgtctggccctaatcatacttctaatcactattaatcattgtgtgttggaagggcagggccgtgtaggaaaataagagttctcatttggaaccaatgtgtagaataatagaagggggagtcgtttctcagatgaagggagagagtaacagtcatggcctcctgggggaattatgagttggacagccatcccaatttatgtatattgataatcattgtttaatttattgatttaattttatgctcttttaatttacttatttgtgcttatcacactcatttctctttcatttactctagttctcattgccacttaacattttatgttttatcaccatctcaaattgaattaggaaaatccccagttttgagcatcatttcccaaagagtctatgttttataccctggtggaagttacttttttcttttattttaaaatagactttatttttttagagcagttttaagttcacaacaaaatttaacaggaagtacagagagttcccataaactccttgccccacagtatcttattcttagtttatagttttgtttaattactagtattgtaatatgcctgaaatataattgcagttggaacatttttcatatattttgctctattatgctctaatctgccatcttgaggctgatggctcctgattctccacttttagcctagacttctttcccttcttaattgtacaaacagctatccgaaggacatcatctggatgtcctgctgacccttccaacctaacgtgtatatgaatggagatcagaatcttgtttcccttcttaaaacctgtttctcttgtgtttcccatctcagtgaaggttgtactattcaaccagttactcaagccccaaatctggagtttgatcctcctagtacctcctttctcggcaagtacatcaagtagttatgtcttgctgattgtgcctcctaaattctactcttattcctggtatcattactttagttcagaaactcatcattcctggcttggattactgtaccagcctcctagctcatctgtctgcttctactcttgttcaaatccagttcttcccaaagccaaagtgatctttctaaaatgcaaatttgaccatgttgttctgatgctcaaaaccttttagagactccccttacctccaggaaaaaaaaacccatgatcctttctgatgtggttctggcccgttttcccaacaccatctcccattgtcccccagtgtcatttcatctagctctcttgactagggccttttcaggaggtggagtagtttagtgattaagagcacagacttaggggcaaatgaaggctttgccagctgggggaaggtatccttaaactctctgagtctcactttctttatttgtaaaagtgagtaacctaactccttcatagaattattatgaaaagaatttatgataatattggcaaaatgctttgcacagagtaagcatttagtacgtggtgatttgttattaaaattgggatatgttactccgttctccacttattttgcaatgtgtcctccttctttgtcttttgaattctttagtgtagcagttatttttgactgcatactatgtgccagcaagttctagacgctggggaaacattggtgaactagaacaacattctgatccagttaactcctcgttatgcttcaagatctttttgaccttcctatgtctcggagagtttgtgctatcatttccccttgtatattattctaattcctttgattacttatcaatttagttaaagaattgctgattagtaatggactctgcagttgaactgttgggtagagattgtgttttcttaatttgtgaacattcaatgcctaacagagcttgatattcatttaaatacatgaagtagacacatagaagatgttcagtaaatattgattggattaaaataaaaatataatcccataataaagttttctttcattgtttagtgtaaatacacagacaaaaaccctttgacttttagggttatcctaggaaactgccacctaattctatttgtttttataggaaataagtgcaatttgagttcaaataactctaaaataagatttagagtctatttcttcataaggttggatctacttctttagtgtgagaaaatttcgtaccagaagtgttgcaaggatctgacctggagccttacattatttttctatttgcatgtttttagattttatcaatatccatttgtaaagtgttggccttttactggcttttatgaatttaaaatttgtttccttcagttacatattttctgatatgtgctcagttgagtgtgtgttgacaattttttttccaatttcttttgttctttctttctacaggcttccttccctgggaacttgcacttggttttggttttacgtcctaccagctttcttcaacgaacgttcacagacattggattttggtttagtcaggaggattttatgcttaaattaccagtaagagtatattatttaaatgttttgttcctctaattctcatgaagacctgtaccatgctgtttatattttacatgtgcccatgtgtcatttaaaagaaaaaaattaaaatgtcttttaaaagtatacatttgaaatgcccaaaagtctttcacttctaccatttgaaaaagaaatcgattcatcaatttataacaaagcaattacttttgcaaaaaatatatgtcatatatgttatatatatgtgtatatatgtatgtgtgcatgtgtgtatatgtatgtgcgtgtatgtgtatataagcaggaaattttatttttagtaaaattgagtgtatgttttatgtatttgaactcccgtgaacttacatcctgagctagtccagagtaccatgactttttaaaaatatttttgtttgtttttaaggttaggaatagggtgctcataaattttgatacttttgaaaaggtcagcccctcctgataaattataacttactacataaagtccttttctttgttgtgagcatagcattcttttagaagctggaccattaacaatgcaaacttttagatggaggaaaattaggcgttttggtttctgtggagattgatttagctttacagaaaatgttttgtaaatagaaactgttattatctgaagaaggtagcgcatacatgtatgggggcatgtacaggagagaactgttaaaaccatttatcagaggtaactttctgctaaatgtatgccaaagttcattttacagtttaatggagggatggcatgaagggcagttaacagtatcttttttgcttatttatataggttgttatgctgagctcagttagtgatttgctgacatacattgatgacaagcaattaacccctgagttaggcggcaccttgcagtactgccacagtgaatggatcatcttcagaaatgtatgttgtctttgcccttactgtagagcctatagttcttcatgttagcctttaaatctagttctagaattctttcctatttgaaaaaaacaaaacaaaacaaaacaaaaaaaccccagctttctgggccctcatttttcacatacatataaattcaacatcttggttttcttccataggcaatatctagaaatgatgagcagtcactgaggatggcaattgaaggagaatcctagggaataaggagatcatactctgcccatcccctcctgtggctatatagtaacttgaagaaatgaagggtttggattcaaatcctggccctgctgatttttagttatatgaccttggtcaatatacataacctctctgagtcttagttttcctaactgcaaaatgggactaataataccttacctcacagggatcttaaaaagactaaatgagatagcaaaagtaaaatgttttacacagtgcctagcatatggcaaaccgtcaataagtgcaaatagtattattaatctcattattctagtgatgcttctgaggcatttaaatttgtagcaaagactgtacttctgttttagaaatttacaaataggcaagggccctgcacctcccaagtatgtctgtggtatatgagtatcttgacttctaatcccagagataggggaacccttctgaagaaattaatgatgtcccattaaattaggattccattttcctcatacttgttcttcactcaacatttcattcattaattcatttaacaatgcattcattcaacaattcattcattcacatgaagatgtattgccaaaattagcaatgcctagcctttaataacctgtaatgctataaataaacaagcaaatattttgatatgcatggttaacagatggtcatatggtctctacattttgcccttctttctcagagtaattgattttagaaacaaaagaaacaacaaaaccgtacttaccattttatggcaacaaaggctttggggccaccattccaaatattctatagtacctgaaatgagttgttgtgactagtttttcccccgtttccttcaattatcaccttgtttggaatgctaatgcttattcacaaatgataataaacaaatataaagtgactttactgttctcatctctcttcagaagtaaggttattataaggcaattttgccaattggagagtttatagaataaggaaaatactgtaattttcaagaaaataaaacaaactactcaatacatggcatctttaagaaatagttttcattagtgtccaagaaataagtcaagaaatttggataaaagatattcaggaagactcttaatcttccttcagtttcttagagttttagatgaagagttacagttgattgccaagagcaatgccatatttctctagcagaggagagttcatagtatatgtgtttgccgttatacccccaataaaaacaaatacacttactgatccagtttttgatatgctcacagagtgaccatataattaaagtaatcaccggctctttgcaggctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaaggtatgtctgatagagttgacaaacaaaagatttccatggtctttatctagagaggtgtttattatctccattttacactgactgttgcataaggggagataaaagacatttatgtaatatatttaaaaactaaaaaaaattatactttataagagaagactgtcctggatatgttagacctaagtgtcccctccgtaaatggtgcattaatttgagaagttatttaaaaacatcttataaatgctgcagaaaaagaaatatagtcttttgttttactatgtgcggtcatgtactgcataaggttgttgtgatcaatgatgaaccacatatatgacagtagtcccatatgattgtaccatatttttactgtaccttttctatgtttagacatgtttagatacacaaacgtataccgttgtgttacaactgcctacagtatgcctacaactgcctacagtatacagtacagtaacatgctgtacaggtttgtagcttaggagcaataggctataccctgtagcctaggtgtccagtaggctatccatctaggtttttgtaaatgcactctgtgatgttcacaaaatgatgaaattgcctaacaatgcatttctcggaacatatccccaacattaagtgatgcatggctgtattttttatttttgaggaggagtcaggaggccgagtttctagtcccatctctgctgtgagctagcattgtgaccaaggctaacattgctcaattgattgtaagttctcttctctgcagaatactaggtcttgatgtttcctacagtagaccaggggttgcaaattgtttgtgctctcctatccaggtctttgtggagtgttgttttgtgaaggattctgaagtgcaattcagataatcagcaagtattttttggatccactttcttcagaaagtttaagaataatctgaacaagcactgggcattcatataacttgtctctctcatctgataatagacatactgtgtgcattagaagattaaagctgtatatagagatatgtgtttaaattaaaaagataaactgagtttttttccaacttttattttaggtccagagggtacatgtgcaggtttgttacatggataaattgtgggatgctgaggtttggtgtacgaatgatcctgtcacccaggtagtgagcatagtaccagataggtagtttttcaacactctgcctcctcccaccctccttcctctagtagtccccactgtctattgttcccatctttatgtccatgtgtacctaatgtttagctcccacttgtgagaacatgcagtatttggtttcctgttcttgcattaatttgcttaggataatggcctacagctgcatccatgttgctgcagaggacatgatctcgttcttttttatgactgtatagtattccatggtgtatgtgtaccacattttctttatacagtccaccattgatgggcacctaggttgattccatgtttctgctgttgtgaatagtgctgcaatgacgtatgagtgcatgtgtcttttggtagaacaatttattttcctttgggtataaacccagtaatggcaatgctgggttgaatggtgttctgttttaagctctttgagaaatctccagactgctttccacagtgactgaactaatttacatccccaacaagtatgtgtcagtgttcccttttctctgtagcctctccagcatctgttattttttgtctttttaataatagtcattatgactggtgtgagatggtatctcattgtggtttgatttgcaagaaactgaccttttgaatcacaatctaaaaacaaagctctgtccaaggaaagaaagctctgtttttcacaaactgcatgttgtcaggcaatttgcttaccttttctgagttgcagtttctgtatctttacagtgaggttggtgatgatgatgatgcatcatacctggtaggattgctgtgaagatgaaatgaggcaaagaaactgatctatgtataacaatgttccgtacatagttggtacttcgtaaatattggcttttaatgttgatattattacccatattggtgatggtgtcatggaatctgtcctcagaataaatgtacaccaaaacttttgcttacaatttcaagggactcttggaccacctgaaagaaatcttaaatcactcttagatgtctgagaaaggtctatattgttacaccacccactgaggttaagcccttctgaatagaggcatatacttcttgatgagttaattaaacctaaatgtgaagtaaaataagacttaaggcagggagtgattggtaacaattaaggattagtagcaaaggcatttaactgtatctgaatatgcattaagtattatttgcaattgtatgctttctactgtggtggtttttattgtgctactactgctttatttgagctcattaaaagtgttagcagaacagtgccaggtgcagtggtacatatttgttgtccctgctacgcgggagcctgaggcaggagaattgcttgagcccaggagtttgtgtccagcctgggcaacatagcaagatcccatctctaaaaaagtaaataaaaataaaatattagcagaataggatggactggattggaactttctaccagttagagaaggaggctacaaatagagcacatggtacttctgcccatgatgatcttataaaaacattaattgcaacgtccatctctaaggcaagggcttcttggatcttcacagcttttagattttgtggcactgagattttgaaattttgtgaattttcagagagctatgaaagcaaaggccattctagaattaactgtttcgattcttcatgccatagttgtatgctcccttcccatcacatcattcaggttggattactaattaggtgatactccttttgtgtctttggacagaatgatattacagctgtaaccaaagaaggaaaaattctgctaacaaatctggaagtgcctgacactgaaggagctgtcagttcaagactagaatgtcatcggcaaataagtggtgactggcaaactattaataagtgagtactctctttttggtttagagttacttattttatatttttgaaaggaaattatacatttttgctgcaatatgttaagtgttaaagtattcctggacctctggaaatctgagaacttatttctaggttgtcctacagagatgattttgcttgtagaagagagtctgtggacattggttgtctctataggtagaaccaagtgtcatgggctatgactttgcctataattcttaatgtccagaccacacttatctacatacttacaaaacagatagttgcttttaggaatttattggagttttctttcttaaggttgctgactcaagtacatgatatggaaacagcttttgatggattttgggaaaaacatcaattaaaaatggagcagtatctgcaactatggaagtttgagcaggattttcaacaggtcagttaaaacatttctttgtataccttttttcattacaccagaggtttttactccttaatcatgagaaatcctgccttgcaagatgcccatttatacctacaaagaaaaaaaaggaggcaaatgtaaatgaaccttggcttagactgaagaaaatctctactaaaattctgagacttctactttttcagcttactcgtttcctttgagaaagtatcaaactgccaatatatatgacagggacaaagttactctctactttggggtttgttattcaaatttatcttagatctaaagggtattcaaggttatgaggtagctttccaagggaataataccaacttccttcttggtttttaaatcccatgtacctatgctgaccatatttaataagacctaacaagcttttatttctgatccaggagtttattcctgtgaaaagcctgagagatgaaattaaataagtttaataaataattaaaaatacattccaattggaccttcctggaaaatccatcatatatggtcaagatgcatagatttagtttcttttccttttgcggtcatgttcaaccttatcacagtctctctcacagtatatacttcaccagaggatccaaggaaaactcacttgttcctcttgcatgtgcccagcttgttttctgcccatgaatggcttacttgctttgtatttcacttgctcatcagagttaggtttcggaggagcactgtactctggacgcggggctcagttaccactagcgttttctctcctttgattcaaacatcttttgaaatgttctgcatgaaaccttccctaaagaaagaataggtcaggttgctcttggtccttctaggtatttgtgtttctccctcgtctccaactgaatacacagaaaatagcacttttcctgaacatacccattatgcttatacttacatattaatttgcatgcataccaaattcttgtcctgtggttatgttctgtttccccaagtcattaattcctgtctttaatcaatattgttgtttgtcttagattataatctcactgacatggtgtgtctcatagtgacatgtcgacaagttctgtatgtctagaaacatgactttttaaaaaaacacgtagaaacataaacttacagaaaaatggcaaatataagaaaaataaaaatacccatataccttcttcccagattaacttaatgacaatattttactccatttgctctattatttttattccctccctcatatatatacagataatatttttttctgatctgacaaataatatattttctgacccatttgagtgtaagttgcacacatgatggccctttccccctaaatgcttccattttttctagtaatagggatattctgttatataaccatagtacagttatcagattcagtacatttaacaatgcaatacttttatattatctaccattggtatttcaattttgtcagttgactcagtcaagtcttttatagcatttatttttccttcagaatcggatcctatatagggtccagtcttgcattaagttgtcttgtgtctttagtgcccttgaatctagaacatttccacagcctttctttgtcttttatgactctgacattttgaagaatatagtcctttttttttttttttgagacagttctgtctcccaggctggagtacagtgacacaatcatagctactgtagcctcaaactcctgggcttaagccatcctcccccctcagcctcccaagtagctgggactacaggtatgcaccaccatgcctggctaactttttaatttttgtggggatggggtctcactgtgttgcccaggctggtctgcaactcctaggctcaaacaatcctcccgcctcagcctcccaaagtgctgggattccaggcatgagctataaggactcatgcccagccatagtcccttttgaaatgcatttttcttcatttggagtttgttggacatcttctcatgattctatttagtatatatgaccagctagaataccacattagtgaagtgtccttcttaaggaatcatatctgcaggtgaatgaagcctacctccctcttattgttgatgtggattctgattacctattcagggtgttgttgaatttctccactgtaaagctacttttactccccttctaactagtaggaaatgtgtggggagaaaatttaaggttatgcaaatatcctccttctcataaaaatttccccgtaaatttagcatcaactgatgatgtttgcctggacaaatctttgctgtgatggttgcaaaataatgattattttcaactcccatgtccagtccacatttatcagtccacactaggcattctactgaagcaagagccttcccttctctccatttatttctttatttgattcaaagatttttacttattggtttttaaaactttcaacttttattttagattcagggcatacacatgcacgtttgttacatgggtatactgttacatgggtatactgttacatttgaggtgtgaatgatgccgttactcaggtagtgagcataatatccaatagttagtttttaagcccttgccttcctcctcttcccccttttggtagtctccagcatttattgttctgtctttatgtctatgtgtaaccaatgcttaacttccacttataagtgacaacatactgtgtttggttttcagtctctgtgttagtttgcttaggataatggcctccagctgcatcatgttgctgcaaaagacatgattttgttttttttatggctgcatagtattccatgatgtatttgtaccacattttctttatccagtccatcattgatgggcacctgggttgattccaagtctttgctattgcgaatagtgctgcagtgaacatacaattgcattgcctttttgatagaatgatttattttccattgggtatatactcagtaatgggattgctgggtcaaatggtagttctgtcttaagttcttaaatattcaggatgccttccacagtggctgaactaatttactttcccaccagcagtgtatcagcgttcccttctctccatagcctcaccagcatctgttcctttttgtctctttaataatagccattctgactgatgtgatatgttatctcatttgatttgcatttctctgatgattagtgatattgagcattttctcctctttgttggaaatctgtatgtcttcttttgagaagtatctgttcatgtcctctgctcactttttagtggagttattagtttttttttattttattattattatactttaagttttagggtacatgagtacaatgtgcaggttcgttacatatgtatacatgtgccatgttggtgtgctacacctattaacttgtcatttagcattaggtatatctcctaatgctatccctcccctcgccccccaccccacaacaggccccagagtgtgatgttcccctttctgtgtccatgtgttctcattgttcaattcccacctatgagtgagaacatgcggtgtttggtttttttgtccttgcgatagtttgctgagaatgatggtttctagcttcatccatgtccctacaaaggacatgaactcatcatattttatggctgcatagtattccatggtgtatatgtgccacattttcttaatccactctatcgttgttggacatttggcttggttccaagtctttgctattgtgaatagtgccacaataaacatacgtgtgcatatgtctttatagcagcaggatttataatcctttgggtatatacccagtaatgggatggctgggtcaaatggtatttctagttctagatccctgaggaatcgccacactgacttccacaatggttgaactagtttacagtcccaccaataatgtaaaagtgttcctatttctccacatcctctccagcacctgttgtttcctgactttttaatgatcgccattctaacttgtgtgagatggtatctcattgtggttttgatttgcatttctctgatggccagtgatgatgagcattttttcatgcgttttttggctgcataaatgtcttcttttgagaagtgtctgttcatatccttcgcccactttttgatggggttgtttgtttttttcttgtaaatttgtttgagttcattgtggattctggatattagccctttgtcagatgagtaggttgcgaaaattttctcccattctgtaggttgcctgttcactctgatgatagtttcttttgctgtgcagaagctctttagtttaattagatcccatttgtcaattttggcttttgttgccattgctttcggtgttttagacatgaagtccttgcccatgcctatgtcctgaatggtattgcctaggttttcttctagggtttttatggttttaggtctaacatgtaagtctttaatccatcttgaattagtttttgtataagatgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagtgctctgttctgttccattgatctatatctgtgttttgagagttattagttttttgcttgttgaattgtttaagttccttacagattctggatattagatttttgtcagatgcatagtttgtgaatattttctcccattctgtaggttgtctgtttactctgttgatagcttctttggttatgcagaagctctttagtttaattaggtcccacgtatcaatttttgtatttgttgaaattgcttttgaaattttagtcataaattctttcccaaggccaatgtccagattagtgtttcctagcttttctcccaagattcttgtatattgaggtcttgcatttagatctttaatccatccttagttaattgttatatatggtgaaaggtaggggtccagtttcactcttctttatatgattagtcagctatctcagcaccatttgttgaatagggagtcctttcccctttgattattttcgttgatttggtaaaagatctgatggttgtagatgcgtggctttatttctgggttctctattctgttccattggtctaagtgtctgtttttgtaccaggactatgttgttttggtatagtttgatgtcgggtaatatgttatttctgcccttgttctttttgcttatgattgctttggctatttgagctcttttgtggttccatatgaattttagaatagtttttctaattctgtgaaaaaggctgttggtagtttgataggaataacattgaattggcagattattttggacagtatggccatttgaatgatagtgattcttcaaatctatgagcatggaatgttttctccatttgtttgtgtcatgtatgatctatttcagcagtgttttgtaggtctccttatagagatttttctcctccttgggctacatgtattactgggtattttattctttttgtggtcattgtaaatgaaattgcattcttgatttggctttcagcttgaacattattggtgtatagaaatgctactgatttttgtacattgattttgtatcgtaaaactttcctgaagttgtttatcaattctaggagccttttggtagtctttagtgttttctaggtatagaatcatgttgtcagcaaagaaagatgatttgacttcttttctgattcctagttttttgattgtttataatttattagtgttcttgactattgtggtgtttcaaactgctgctgtgtccttgtgacatactccaacatttaaataaatcactttcttactttctggcataaaaatatattccaagttcatcttgtacctattctgcctcaaccctggaatcagttatttccttgaggagccctggtttctttttctgggaaatggtattaaagaccaaggtctgggtgggagatgtgcttattacttctggagggcttttgcttttaggataattcaccagagagctggggaatgatgaaaaaaacacttagatgaaaattctcaggtaagattttgttttagatatttgctatatatatatacacacacacacacacacacacacacacacaaatgtatatatacctatacatacctcacacgtatacatttatgcaaatacatgtcctcatatacgaacctacacatgtacatggtgatcttttatacatcaagagtacacattgatatctatgaggttaaattttaacagattatagctatttctgtgaataaaataaccaaattttttatatgtgtaatttctccatgtcaatatttttgtttaaaagcattttgtataaaacttgatcataaggggataaattttatgtttttaaaacctctttgtttcgtatttttagcttgtgactgaagttgaatttctattaaaccaacaagcagaactggctgatgtaacagggactatagctcaagtaaaacaaaaaataaaaaaattggaaaacttagatgaaaattctcaggtaagattgtattttagatgtctgctatattatacagtataatagtcatgttttggcgggagtaggtagtataaacccttattattaatttctttatttttatttttccataagttactggggtataggtggtatttggttatatgagtaagttctttagtggtgatttgtgagattttggtgcacccatcacccgaacagtatacactgcaccctatttgtagccttttatcgcttgccttcctcccatcataacaacattctgtatatcaggcacaattatattggtctatattctgttttgttcaatgcaggccagaggtgacactacagatatatcatgtagttagttgtaaaaggaggtcactgagacaatggcgtgaactgtttcaagcccaccaataagaacaagggcataaattattttggagaagctagaaaaatgtgtatgaagaatgatatatggtgcttggaaatgatgggaacatacaagaacataattccttaaatgcccactttaggatatatgcagtttaaccaaatggagactcacatagatatttctacttattcttactatctgtgaccttgagtaaattggtttctaatcctcagtgtcttcatctataaactggggataaaatgacctactttgcagagcaattgtgaatattcatttaggtgtatataaagcacctggcacaacactggactatatagtaaccactcaaaagaggcagttttcattatccctgctagtcttaaattttggactagtggctttaatacttaaaaaactcttagcttttatgtgagagcaaggccatgctttttatgtgagagcaaggccacgctttttaagatgaattctcagcatacaaacagatttatgggtgaaccatgagtatgtgaaaacaaatattgaagaagcaacagttatgataactagttctggaattatgcttgtagatctgtgtgatcatgggacactttacatagccctatggtatagtagaaagaggaggcaaactggtttggaaactaagggagacttaatttttttccatttaataatttttcgtttctaattgtggtaaaaacacataacatgaaatttaccgtcttaatcatttttaaatgttcagttcagtagtgataagtaaattcgcgttgttgtgcaacagctccagaactttttcaccttataaaattgaaactgtatacccattagacaacagctctccattttaaacctggttttcccactagatagagaggccagtcatttcctcattctgtgtttgagttttatttattttattttgacaagcatttcttgaacccctactatgttcgagtctctacactggggggagtgagtagttgatggagtggaggcaaggccactaaaggtcattttttgacatagaaaccctgtgacttcaggtatgtgaagtagtccaggtacatgacaactctgatgagatttctaaggctgagatgatatgaaatacacttggctggtgtgtatacctcatttaatataggtggttctattctaaatccacacatattaggagaaaaaatctcacccacattctgtgtgtgatgtgcaattttcagtttctataaccagaaatgcatgagcttctaatgacatcactgctgcagctaattattataactgtaagtttttgtttttgtttttttgtttgtttgtttgtgtttttttttttgcagcctgaagaagtagacatcaaattgtatttttggcaatgtatccttcttgctcaaacattttgcttcttaattattttcttctttttttctctataggaacagagatcatgtattcattattttttgtctttgttataatcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggtagtgtaatgggaaatgatccatttctgaaaaggaacacacatttttttccaggtcctgctagcctgaagcaccttgccctcctgtcgcatggaatacttttcatcttctcagaggttatatggtcagggactggtatagctttggaattaaatttgtaagaagtctgaaggactgagtttgattatgattttttcatccatctaccaatgaactattcatgaaagatccaatatagttcaaattttaccctttgttctaaatattgagattgtggagtaatggcttcctttgtattttcgatacatctctgaagccttcactggtgatggtttgtacttggaacatttttaaaaacctgggggggcattttgctaaagcctgaaactcctttcacatttcatagtacagaaataaaatattaaacagtgactggaaaatattcctccatggcttgtgggtttgacccttttcacgattaggcaatgaattgacaggtcaccgtatggacctggtgttggcagtggaatataaaataggggtatcacttacagacattatatctgaacataaacattttaatctttacatctcattctttgggaaggaaactttattcttgtctttagccatcattaagcatttgtattacactttatatttttctaagaatttcatatttcagttactgattttgggaaagtaacatgcaactaagtgttagtgctgagaaaatggtcggactcctgctgcagaataaattagttgttgtgaaataaatgcagtgtttcccaacctcggctgtgtatcagcagtatctgtggagctctgtaaaagtataaatgcccaacttatggcccagagctactgaatcagaatttctgggggcagaacccagatatcttttttttttttaacagctctgaaagcatttctgactcacggaagccagaggctgagaaccactcacttattggacaaatatgttttctctttattaattcatattttttttttttcttcttgattttcttaccaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggtagaggcttttttattttcaaataaatatttaaagaaaattataattgcagtactgtgggtaggaggagttttactacctcacagctaactttatgtcaaattgcacttacattgtcctcttaggggtgatagtagtgccactgtcaagcatcaaataattcaaaggcatatgtttgctatataatgaagaataatttcctttttgagctccaaatccattattttaaaactcttttatgtgctaggtgttctcacacatattttgttgtgcatcactggagaaaggcccaaagctcttctataacagaatgttgggtccatgtcaagagcactttaccccagacatctttcctttgtgctgcagtgaccatcagcagatgctctgtggatgatgttgctttcctactcagtttgagaatgaaagcataaagataggatttgggtcttcttggagaaggaggagcaggcagaagttggtgttaacagggtggacagctataggttagttcagtactgcccccttggaaatgacatgaagaattttccacattgtagataagagcatttgtgatgctatttgctgctaaaatgtgtagttgactctaagattggagcagtatctagatccatgcttagcggaatatcctaggggatgccccaggaaatcagaaatgcagtcatggcaatagccaagtgattctctggaagcaaccaagcttaactctagctgcctcaaagcatctaggagaggtacaaaggtgtattatccattggtggctctgaggagcctgctgcaacatagaagactataacaagaatgtcctacagggtaaaatgtaacaaaatattataccgatgttattcatttgattgtttttataacttggtggctttcttatgctaaacaggaaagagcaatatgccttctttcccagccattatctgattcagccaatgaaccaatgaagggcaaatcactctatgcagtgaccaatttcatgactgcttcttggtaattttttccctcaggttgttttggttgagattttggttttatatccatgtgaacataatacattaatctgtcttgttatttttctaaatgtcttgtagttatattttaaactctaaattatttttttgaccatctgagtctgagaaatgtaatggggtttgtaatgacctcatttcataaaatatttcctataattcttatacaactcgcaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcctttggggcttcttagaggagagtaatttggtctttagggccctaagtaagtggaatgggtgaagatgggagtaaatttggtctgtctgatctaaatagagtcagaagcttcattagtgtaggagaactgctttggaattcagagaaggcttgagccaaggataatgagcataaaaataatagcttatatctagcatggatcagattttcaaaaggtgatgaaagcaggtaactaggctaagattatgaaagttacatgtttaatacttatgaaatatataaatatatttacaaataaaactataagcaatgtcttaaatacaatatcaaagatatagcaaagatacagggaatattaaaactactggaaaaagagtaaagataacaaaataaaaaacagtaaggggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctttttgcattaaatataattctgcacctagcacagggcctggcacttagcaagatgtaataaatatttgtagaattaacattgaatatagagtgtagttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttggatctctgtagaacaggtttctttgaagtggagcatattagtattcattgagaaattaattttgtataattcccactgtttaatatatatttacatatatgatgatataaacttgaagtttaggtagaaaatatattttaataagtgaaagtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggctaactcttagctcaaaaaagatatccattcttttttgttgttgtttttaagtttttttagagacagggtctcactatgttgccaaggctggagtgcagtggccattcacaggggtgaccatagctcactgctgcctctaattcctgggctcatgccacccttccacttcagcctcctgagtagctgggactacaggtgtgcatcactgtgcccaatctacttacttattgttagatacaagattctgttcttctcagttatccatgataatctgatatctgtaaagaagtagactcatcatagctacaacatcccacattttcttttctctctctctttttttttttgagacagggtctcgctctgttgcctaggctggactacagtggtgcgatcatagctcactgcagcctcaaactcttgggctcaagaaatcctaccaccccaggctcctgagtatcttagactacaggcatgggccattatgccaggctaatatttttaacactttttttgatagacagggtcttgctatgttgccaaggctgatcttaaactcctggcctcaggtgatcctcccgccttggtctcccaaagtgttgggattacaggcatgagccactgctcccagtccccaagaccccacattttcttcttgtgttttttgtggtaaataaagatgagaacatatttttaaggggcagtatagcatagtggtacaaattgtaaaactaggctgcctggcttataatcccagttccatcacttactggctatataaacttgggtaagttctctggaactcagtttccatatataaaatgggcataaaaatagaacactctcatcatggagttaaagataaaataatctaatatttgtgaagcaccttgaacatgtgtggcatatgataatgctctaagttttaatataattaatagcagcctagtgaatggtctatactgatacacgaagcctggttattattctgtacggccacaacttctggtttcaagaaagaaacagggtgaatgccaaattctgtagtattacatgttgtaaaatctgtctgagcctcagttttcccatatttaaaatgaggaaaagaatgccattgcttgctaaatgctgtttggattaaatataatatgtgttaagcacctaggactgtggttgcctaatatatagaaagtcataatacatgcttgtttctttcatttgtaataagtaggtcacattttggggaaatatttagctgatagatactgtacttcattttgggttctagttgtcccaaagaaatgttacatttacttggaggtcaggcttttggcaagctcagctgtccaatacagctgagattggataccaggaatacacttcaaatgcttcttaaaagaaataatcatcacaaatcttttgcagttgactcggtaggccagtccaagtcctttagagtctgtaaaataaggcaatttattagaattagggaggcaacttatagcgactaacatgtggcagggagtagagacagagatgtacaggttacagttatttcaagaaagaatagagttctgcaggtatccctgcagcacatcattagattttatcatattcaagcttatgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacacatctatcacctcacgtagttaccattttttttttgtggtgagaacagttaagatctattctctcagcaaatttcgatatacgaaatgaatagagtggtacatcaaaaattacaaaggattatacagattgatacaatgttattttatagatgttaataattgttttgttcattgttataatggtatattaatattctagacataagaatattcatctttttaatttgatgttacagttgtaattagcaagcattttgcagcaagttgtatgtatacatatgtatgtatgagatacatatatatatatatacagacacatatttatactgtaagactctcaaatgttaaatgctttaatatgcaaaaagaaaaagaaaaaaagccaaaagtataagttaaatcaaatgggttacttatactggggacaagggaaatgagttttaaatatgatgtcaattggaaatcacattgaaaggaaaatatactttattttccagagacagtaaacaaaattattacagaaacaggtggggcgtggttattcacgcctgcaatcccagcatgttgggaggcccaggcgggcggatcacttgaggtcaggagttcgagaccagcctgacaaacatggtgaaaccccgtctctaccaaaaaatacaaaaattagccaggtgtggtggtgagcgcctataatcccagccactagggaggctgaggaaggagaatctcttgaacccgggaggtggaggttgcagtaagccgagattaccccactgcactcaagcctgggtgacagagtgagattccgtctcaaaaatatatttatatacattacggaaatataagtatgacctacacttgaggagaccagggtaaaaaaatctgcggcctcctttagaaaatttcagaacattactttgaaaagggaaaaatagtgcctaaaatgctaatacttattttttagggaaaaaaagggtattaaagttcataaactatgctacccccaaacaataaaaacctcagacatttaggaatagttattgtgagtttttagtacatttattcctaatctcagtgagttagaaataaagttctttaaagctaatagtaacccttgagcatatatatgtgtatatatatgaaagaaagcgggatatatatatatatatatgttatatatataatgaatataaatacaatgtataaaaaccacccataagactatatatatatatagtttttattctagaaaccataaaagtagtttcatattttgatgctaaaacgaaaaccattgataattcctatgcattagctatttttaccttctcatgatgataatacttgaaacattgcaatatagatctcagtaataaaataactgataaatatggtcttttcattttagccacgtactaaatgaactgatacagactgagagagtttatgttcgagaactgtatactgttttgttggtaagcgactcaaattgtatttgccctatcttttcccgaatgatcccttgctacattcattagaaagtgtttaggggcaatcttctacttccgtctccttccttggttgtcatatggcagcagtgggcatttcttttattgtttgatgcagcatgtcggttaaacgtgcacattcaggctctccctcagtaatgggaatgattgattcagaatttattacagaagagaaaatgttctcttagggatacagccgattgttacaattattcccagggtgctatttagagatcgtgatgtaaaaaactgagaatgggataaaatattcttttgacaaaaatgtcatgatattaatttggtctgaaaaaacctaagcacgtattgccaatttaaggagaagctgatgacctgtagtctatgtttttatcttggtttctatcttgtttcctacactacaagctactctgaaggccaaagagctattactttattctgcctatttgattggaaaacttgacttcctttccttgccctgccttctaaaaaaaaaaaaaaaaaagtcatggataactttgggaagtaggagatttgaattgaattaaaattgaaataaaattcaaaaaacttcaccatcaaatcccttaatattctgctgtacctacaccattagtagcccaaccaaatgtgcatgtaattattttaaaatgcatgaatgtatttattttgggtagggttatagagcggagatggataatccagagatgtttgatcttatgccacctctcctgagaaataaaaaggacattctctttggaaacatggcagaaatatatgaattccataacgagtatgtaattgctgaattgaatatttattttttataaaactatttaaagtgctctctttaccagtttattatatttcacataaaatcatgcaattttttttctctgaaattttcacagcattttcttgagcagcctggaaaattgtgctcatgctccagaaagagtgggaccttgtttcctggaaagggttagttaaattattttttaaatatatataaatatgcaccaccaaaatagcaactcacttataagaacagatttggagacaagataggtactttatgtctttatgtttttggagaggacacattactccagcaagtatttaataccaaaccaagttttgctgcagaaatggatgcactgggatatccagagcataaaaataccccttccattctgtggtatcaaatgcttcagtggctcagctcttgaacactgactcctgggtaatcctagtaatccagggaccatcctgactatgaagatgtaagagttgggatcatgataacaaaaccatctggggcttggttaatttttttttttttgcctaaaaaacaccttattatttatattatttgtcttattaaaatacatgtaaagttttagaattggatctagtctgactttcagccatcaaggcatctatcacaggaacttcacagaaacagagagctgtcagttcttttcattcaacaaaagcatttagggaggcccattcctctgtgtcccaagtatggttaatacaattgacttcccaggttagtgatcatactctcctccattagttttcttttagaatattttttgtgtatgcttctctgcttatgcagtttctcttcttcctgaaagatcagttttgtcttgatttaagagttaattcaatagaggtgattgttgaaagcttcaaaatagatgtcttatcccagaaagtgtttatgaaatgagaagagaataaggataagaaagaactgtgtgtcaaccttgctcaacgtgttctaactttatttattttatttttttatttttatttttgagacagtctcactctgtcacccaggctggagttcagtggtgtgatctcggctcactgcaacctccacgtcccgggttcacaccattctcctgcctcagcctcccgagtagctgggactacaggtgcccaccaccacgcccagctaattttttgtatttttagtagagacggggtttcaccgtgttagcgaggatggtctcgatctcctgacctcgtgatctgcccacctcagcctcccaaagtgttgggattacaggcgtgagccaccgtgtccggctaagatgttctaactttaagcatatttaaattatgaccaaattctttcccaacctcatcaagcaatagcagtttatccttcctttagactccatagtatgtaatgtctatcctactcatgggagattttatatttactgtgcttgtgcacctttacatatatacgtgaattttctcccaaacttaatggacagcccttagaacgagagtccatatcctatatattgttgtatctctcattgggttagcagcgttcttagcaaccagttgtggtttaataaatgtttattgatgaattgtttatttattcaacaaccatttactggtcacctactatgcaccaagcattgtgccagataatgtggataccaagcccaaatctatttagatataaaaacagggaaattattaattgtgtagaagatgagttgcattagatttgaaatatacaaatggtcctgggaaaatccagaagaggggcgtcttgcatagaatgggggtataaacaatggttgtatagaagagataactcatgagataaatgttaaataatgagtaggaggtagcccattcatgagggtcagagaaagaggattccagggaaagagaattgcataagtgcctaaatggattatgctacagtgataaagtcccagtgatgaacctaggactgtaggctctaacttggaagtcagctacaagttcattcactagggaatcaagagactaataacagaatatatttcttggcagcctattagttcatcgttatgcaaaaagtaggtttttatagttcagacagagaagcctccatctaagcctcaagcttggcaagtggaagctctgatattacttagataattatgtgtcctcccaccagatgcaatgggcatgctgttcttggaatataaaaaaggcttttgaccagctgctagtacagtaggccctttaggccacatttcctaggatgcttggttacactcttgtttagcctttcttgatggcaaaagtcatattcacaaattagtaatacatttgaatttgttttttatcacagaaggatgattttcagatgtatgcaaaatattgtcagaataagcccagatcagaaacaatttggaggaagtattcagaatgcgcatttttccaggtacagtaattattcaagtattggatatattctttctggaagatattgcggtatttcttaattataaattcattttctactttaagtacgttacatgtgcatatacgtatatgagttaaagagcaaatccaccctcccccccaacacacacaaacacatttgtaacttcccagaggcaaacactttcagcacttttagctacatcctttggtatttacctccatagctccaaatgacatgcttatctttatcctttatactatggaagatgaagatttagctctctttcacgcccctccacccacccaactaccacatatacaaatatacttcttttctttcaaaatctccactatagtcatatcgtaattttggttagattgatatacagtattaaattaagactacgtaatttctttgctcagatgaatcatgtggtataatagggttgcttttcctacccttctgtttgtcttgcagtggtttttttactcagttttctagatacttatcgttattctaccccaacctctcccagatgtgggagttacaaaaatctcttcttattacatttaaacacattctattttctctgaatttcatattcttaaagaaatatctcctggggttttctgtcttgcttgtctagactcactaggcttgttgcgcagctgtcatctggggatcttggtgaacataatttttggaattctcctcacctgtctattgcataggctctcctcattcctaggtgccatgtctttatttttcttgtttacctcccttgtttggtggaacacatcctccagtagttttcccaagaaagtgtacacagtacataaaagtttttgagagtgtatgtgtctgcaaatatctttattctaccctaagacttcattgctagtttggctgtgtatagaattctaggtaagaaataattatactcagaattttgaaggtattgcttgattgtcttctagcttccagtgttgctattcagaaatctgatgccattttaattgttgttcctttgtaggtgacttagtttctgtcctctgaaagcttatgaaaacttattttcagtgttcaaatgttggcactatttttatccattatgctagtattagggtgataactttgaatttggaacctcctgtacaaatttacttggaggttttctttgatttcctccacccaattgtctccattttctctttttggaatttctgttgtacggatattggatatcctggactggtcctctaattatcttatcttttctattttccattctttgtcttattactctactttctagttcttccattgaggtttccatttctgccattgtgtttttaattttgaagagccctcatccttttactgttttttcaatgtttcttttaatagaattctattttcattttatgaattcagtatcttcattcatctatacaaagatgataatagatttttcttttaaaaatggctttcttctccctgcacatcttctgttgtcttcactttgctttttttcttctatttctctttgtttggttcctattacccatgtttgatgctctcctcaaatgtctggtgatacttgtctgtccacttacattaggagtaaacactaaaaagctcattggaagtttccagggcatatgtgggtttattgaccatgatcctcattgttgagttatttgtctcaagctatttgcttgaagggattcccaaatacctgtatctttagagcatttctattaggctggtcagattccttgaactgctaccttgtgtataatgatctggatgctagtgttgtggtagcagagttgggagaaaaggctgagggtcacttgtttgagatataacatggagagtacttgaatatttttcaatatggtactctgccctaagttgaaccttgtatcctttggtccatagggcctgtgttttactctttctagataaacatccatttttctgccaaaggaagggaagagaaggcacccagctgtgcaaagtggtgtggttatctgagagccttattgcttttgtttagattttcatgccatttattttcttcttgtaacagctttattgagctataactaaaatgccatcagttcgcccttttaaagtatacaattcagtggttttactagattcacaaggttgtacaaccatgtttttatcactaaaaagaaaccagtcttaccctcccttttttccccaatctaagcagccctaggcaatcactaatctgcatcctgtcttcaatagatttgcctattctggacatttcatataaatggaatcatacaatatgtggtcttttgtgtttgacttctttctttcatttagcataatagtttagtggttcgtccatgttgtagcatgtattagttttttattcctatttatggttgaataatattccattatatggatgtatagcattttatttatccattcattgattgatgcacatttggcttgtttctaccttttgattattatgaacaatgctgctgagaatgcttttgcataagtttttctgtagacatatattttcattcctcttggctatacacctgggagtgaaagtgctggatcatatagtaactctacatttaactttttgagaaactgctggactcttttccaaagttactgcaccgttttgcatttccaacagcagtgtatgagggtattaattgctccatatcctcaccaacacttgttattatctaattacttcttaaaaagactttcaacaagcatcctttcttgaaccgcacctttacctcccactttcagaggtacttggtgtctataatccctgagactttgtggagggcagggaagagatgtttataacataaattgagttgttccttggctttttcctccaccaacttgaaatccacttttctccagtgtgcttggttgttgaccacttctaagtttggtttccagtttccaaattttgcggaagttttccccttgcttatcttcttcataactttgtgattttgcctagtaaaataacttttccatcattttagttggttgtcatgagtgaggagatctaaacgcatgtatcaagttggtgcaaaagttactgtggtttttgccactgaaagtaatggcaaaaaccacaatcacttttgcaccaacctaatagcagtcccccatctttaagtctcatttgaattagattgtatgttggattttacccatattcagaggagagccatggttcttattcaggcgtatttttccccaatccctttgtgttctatactttctctatgcacatttcatcctaaatatctgcatcttgccctaactatgggcccctacaatgttcccggaacccaacatcatgacccttatatttatagtggcaatgggccaattactgaagtatagcaccagttgatgatggctttttcttgttatattaaaaattttgttctcatatccagtctgatttatattcagcacaaccaatttcttttctgagccttggcttgtagagcttggtctttcgtgaattttcttgaatatattaaagaacgttttaatcatgttaatctatagtcattccctgctttcacaccttttaagcattccacatcaatatgaatttatatttgaaaacttttaaatctttgaaatgttgaaattgtttacctctccaatccttgaaatagtgtttatggtagtttttcagatatattgtgtcttataatttctgtactataacagtgatttttccaataaatattctttgagatgtaagaaacattggggcattaggtttaatcaatgaacacttggcattttcacaggtacatgtcttaatttaattttattgatatttatcttttaatgacaggaatgtcaaagaaagttaaaacacagacttagactggattcctatttactcaaaccagtgcaacgaatcactaaatatcagttattgttgaaggtaattatatgaagcatttgtttgtttctttactttttgagtcagatatgacagagccattaaaaaggaaatagtttactaggaagcactagaaataggtaggctcaatgactgggaaggctggatttggcagaattttgcagtgtgctccatcaattcactgtggctacaaatgccataggcatagatatcaggctgagaatatctgggatcttagctatttaatttttcatacaagttgtgttgatttccgcacaatgttttactgaagaactttaaatattagtaagaagaactaaacaaagcaaatatttcttatagttttgaggctgcatttcataggggccttcctaatgaaaaatgcgaatggcactcccctagtataatgcgaaaggattgctagaatcttgtgttaagtataaatacaatatggcttgttttaaagtgaattttcataatattctatgctatatgcattatgagtgcatcatggctaaaacaaattactgtatgtagaggacaaaagaaccctacatgtaatggctttaaaaattgatctctgatgtgtcttaatagctattatacttcaactccagaagcattaaatgtcctttgttttatactattcagtcactattctacttcctctattttgacagccattaaaaatattactgcagcaaagggcatgtaaaaggaattactccaaaatgtgacattatatttggattccagcttgaaagcatgttagccaaaaacttattcatttcaaccagatattaatatctgcctaatattaattcctgatttctaattacaggagctattaaaatatagcaaagactgtgaaggatctgctctgttgaagaaggcactcgatgcaatgctggatttactgaagtcagttaatgattctatgcatcagattgcaataaatggctatattgtaagcacattttaataattgttggaattttagagggtcggcatctcaacatcccttttcccctcctggaaccaattgagaaataacgtataagaatcagataactggagatcaaaatgttgatgttactactgataatgctaagtggagaattggcttcagatcagcagccaaatggatttatgagatcccccttgtccccaacagtcttcccccaatcccagacctgggagatcctgcttaaggaatgtttgagtcagctaagaaaacgtattgctccataattgctgcttgcccctgtagataggaatagataggaaagaaaagaatcaaatctttagcacttgtgtagccttttaacaggttagctccacccagtgggaaaacttgaactggtatatatcatgcaccaatcaggattgaagaagagatggggagacttaccctagctgaaatacctccagatgatatgaagccagagaaaaggaagtttcttttgtcccccacccccacagtaattttgtacttatgtggtgcatgccatgttttaacatacaaagttaagtttttaaaaaaacataaattattcttcagggtttgagtagcttaagctgaaccctaacatgttggtgtcagagagctgaatgtagctttgctttctactaatgggttttgattttccattctagggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaagtaagacaatttgtatcgggtaatgtagtattgtttcgtgtgtgtgtgtctcccagtttgtacattttttttgtttcaaatgagtaggttttatactttcgctgcacatctttgttttttttaaaaaatcttaagtcttatgtagaagtcagatgaatcataacttctctgcttgaagtgaaggtgaggtaattcagagctttgattcctccctttcttctcactacgatcctaggtattccccaagggggctccctagcgtcctgaagagcacagtttgaaatgataaggagtgtcccagcctcctcataagcactctctttcgagtgacactgggtggagttcttggtcttgttagaaaggagccttatgctacaggagagacagggaggaaagagtttcctccttttcctcaatgcaatttaaaaatgggtaacttttgtgtttagcatgtccccaccttcctttctgtgttcctcctccactccctagctccaccctacctgggtgttcaaagccacctatagctgaatcctttccttatctgtcctgttccgtctttcaaaattactttattctctcctataaacaaaatccccattttgtcctaatattagtttgttattaaaaagagaacagtattgtttggggaagttattgacaacccaatgatacttacagctggtttctccaatagagaagaagaacttccaattcacatgagacccataattgacaaatttgaatttttttacatctaatgcatttcatcttttgaattttaaatttttttttattttttatttttttattttattattattatactttaagttttagggtacatgtgcacaatgtgcaggttagttacatatgtatacatgtgccacgctggtgtgctgcacccattaactcatcatttagcattaggtatatctcctaaagctatccctcccccctccccccaccccacaacagtccccggagtgtgatgttccccttcctgtgtccatgtgttctcattgttcaattcccacctatgagtgagaagatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttgattccaagtctttgctattgtgaatagtgctgcaataaatacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccactaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttgtcatgtgttttttggctgcataaatgtcttcttttgagaagtgtctgttcatgtccttcgcccactttttgatggggttatttgtttttttcttgtaaatttgtttgaattcattgtagattctggatattagccctttgtcaggtgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatagttttaggtctaacatttaagtcttcaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagtgctctgttctgttccattgatctatatctctgttttggcaccagtaccatgctgttttggttagtgtagccttgtagtatagtttgaagtcaggtagcgtgatgcctccagctttgttcttttggcttaggattgacttggcggtgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttatatcctcttttatttcattgagcagtggtttgtagttctccttgaagaggtccttcatgtcccttgtaagttggattcctaggtattttattctctttgtagcaattgtgaatgggagttcattcatgatttggctctctgtttgtctgttattggtgtataagaatgcttgtgatttttgtacattgattttgtatcctgagactttgctgaagttgcttatcagcttaaggagattttgggctgagacaatggggttttctagatataatatttctattgagataatcatgtggtttttgtgtttggttctgtttatatgctggattacatttatcgatttgcgtatattgaaccagccttgcatcccagggatgaagcccgcttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctgggctctttttggttggtaagctattgattattgccccaatttcagagcctgttattggtctattcagagattcaggagctggttttttgaaaggatcaacaaaattgataaactgctagcaagactaataaagaagaaaagagagaagaatcaaatagacgcaataaaaaatgataaaggggatatcactaccaatcccacagaaatacaaactaccatcagagaatactataaacacctctatgcaaataaactagaaaatctagaagaaatggataaattccttgaattttaaattctaaaaccaatataacatttgtcacaaaaaatttcaaaaatagagaaaacgattgtccttaattccccaaccactatcatgttagttacttttcatgagcatgttctttcatagttctcatcaccagtatatttgacaattgatgaaattttcagtagcagttataaagaggacaggcaatatgttttgagacaggcatgaggtatttgtattaggagactacctgtaagcaggccttgcttttgattcttcccataggatcagcagcccctagttgttcccaacaaggttcctgcccagggtcgggtcaaaaagaagtagttcttcctattgtgtattttccctgcttcactctgaacccacagcagcttctttaaaactcttggtttcgtcacaaagggccagttgctcctttgattttagcagtccacctctaagcccccaaatctcaaagggccttctaagtaattaataaacatagattgagaaccataaatttgtaatccatgtcagagagggttcaaatctcttgctgtctgtatacctattccttgggaaggtactttaccttcataggcatatttgacccaaatgcatttgatgtacattttatcatgaggtgacctaatttctacctaatatagtatttctatttcatattaattttctattttacctttaatttgttacaatgatggacatgccaacaaaatgtttcttgagtacattaaagtaagggggatattaggtgattaagtcatgaaaactgaaactgcaataggtaccatggaaacagagaaggtgggatagattcaagaaacatttcaatagaaggtagacagatgggcttgatgacttactagctacaaaaattaaataatacctgacattgaaggaagaaaatctttctgattcttctttggttccccagtaatgccaagtatccttaataaacaatattagccagtgatgcctacaaggctttagaccaggattacttggaaaatggtgataccactaaaaattaggatatttcttagggttcactacgctcacttctgcttgcctgcttatcatgagattccagcattaagcaattgctagcattcctagtcaatgtgttatttaagaatctgggttattagtttcacagtcttacccttggtagagaggatcattgcagatattccactgctgaaccttctctctcacttttttttttaacttttattttagattcagggggtacatctgcaggtttgttacctggctgtattgcatgatgtttaggtttggggcacaaatatcccatcacccaggtactgagcattgtccccaagagttagttttccaacccttgtccctctccctccgtccctcctctggtagtccccagtgtctgttgttgcctttgtctatgtctctcactttaaatgaactcttgttttgactgcaccatacaaagctgggatcccatggcctgaccatgtactttctaattatttatatgttatattttaagttggctgcttatatgcaaggaaaggccctatctaaagtcaaagttgaccagatggggagattcgagtccttcagattccttagttcatgtgtttattatcatcgatttttaaaaattttacaaattgcacatagtccttactatgtgcaacacataatggttagatttccagggcaacttagaaaagttcacttaattgataatgatgtactatatgtttgcaataaaaaaataacaaaacaattgcaacttaaataggggaaagagtagaaagcaaactcacactttagaaagctcattataggatctaagcatttactccatgctatttagtccttatatcaaccctatgaaataggtgttctttctattttatagttgaggaaactgaagtttagaaaagttaagcaacttgcaccaagacacatagctagtgaatggtagagatgtattccaatccagacctctctaacttcaaagcctgtgggccttccagcttatcatgttattaagacaaaaccatgtaatgaaacaaaattaatttttaaaaatattgaatatgagattactattcatcttaaattgtgatatttgagcagaagtaggttagttggaatgatggagtgagaatataaagatagtttgggacattgtgaaaataacttcttactacgttcagggtggatgttacaggttctttcattaatatgttatgttaaattacatttctaagcataagtgcttttcttctccttggtatggcgatctccctagcactatctttaatgcttattagctctaataagggccatttggggggctcataactagaacagagagtgagatactcctttagataattaggttaagaattgaaagaaaagaggaaggcagaaaggaactaaaagaatgtttgtgcaaaggagtgagattgcccaaaatgcaattagccaagctgttagcagaaaatgatgaaagaaaatggaagagtttatgacttgcacaatcacgctgaggaaaagaaaaaattgtggtaaggaataaggaagagatattgtgtacagaagtttcactgggtacaaaaagacaacaatgtcccattacatattattattattattttttttttagaaaggccaagggattggtggaaaatagagagatccttgtgtacctggctggttctctcctgtcccatgaattagatgtttataacttgtaggacttctatcaaaataaattataatttgtaggattaagtggtctgtcaaatgattattctaaataactatttaaattaattttcagtggcttttctttattgatgtttaatgacttctgtgtttgactcaataatttgttttaatagtgtactattaatttataacataattagatcttagatgggctacttggatgttcagatttataacatttgtgtcaaccactgaaatgaagcgtgcaatctgaactataaagtgcatagttcaatgaaaacatttaaatactctcgtctatgattgtaattactatttcatattcatttaatataacatgtatttttctgcccaagagaaattctgtttcacttagaatatgatagggtagatttaatgtaatttcatattcaaaataaaatgctcatgaaaattttgacttatttattatagatggatgaagttggaatcactgaatatgtaaaaggtgataaccgcaagtttgaaatctggtatggtgaaaaggaagaagtttatattgtccaggttggtcatttgaaaattcttctagaaacccaaacctgcattgaaatacaaaagcccgaatttataaacaaaaataattttggtcgcatttcaaaatttccacccctttcatgtaggtcagttaaatattatttgaatattctttgtgatgtatttaaatgttttctagtagttacattgagatatgcctgtggtgttctctagggcttcaagttttcacaactacataagagacttatcaactagagctgacagcttggcaggtacttctctgtccccatcaaatttccaagttatggaattataatagttctgagttcctcttatgctaagcattctaggggtacctgattatgagacatggggatgtgacagttcagacttgctttctgcttctaaagaacatggttaaagccctggccagttgtatagggtccaacatgtttcagggaagggaagaggaatcagaacatttcaagaggatgttgtcattgcaataaatatttgtatctggagttgtcaatgtgctgttatctgttaaaaatgctcagtgttttttgtttgttgtaattctttactaggtgactgcaatctataaaaatatgttttcttggcttgcttaagatataatatttggtatcatttaacaaacatcttgtaagtgatgggaggatatttaaggaggatttcatgttaccatcagtcaccaaggttattctgcaatagatggccttttcagaaatagtagagcttgttttattttactaaaattaaacatcaaaatgttatattttaaaaagaatcctcctgtaaagacaaaataagtgaaattatatttcacagtttcatccaagcattattttaccattatttaagggcaatttcaaaatggattttttttttttgagacagcgtctcaccctgttgctcaggctggagtgcagtggtgtgatctcggctcacttcaacctctgcctcccaggctcaagcgattctcccacctcaccctctcaagtagctgggactacaggcacatgccaccacacctggctaattattattattattattagtagtagtagtagtagtagagatggggtttccctatgttccccaggctggtctcaaactcctgggctcaagagatctgcccaccttggcctcccaaagtcctgggattacagcaaaaatggttctgactgtattatttcatctaatctgatagcaaattatttgcttcataaaaattttaacaatcaaacggttaagatttgagtatggtgttatagggagtagatcatattttatgtacacaattacatttgttttattatagtacatcctttttaaaaggaaatgtgtaccacctccctcccgctttttttttaatctttaggcttctaatgtagatgtgaagatgacgtggctaaaagaaataagaaatattttgttgaagcagcaggaacttttgacaggtaaattcaagcctgcattcttcagaacaagaagtatagtaacagcttattgactcagatttttaaattatttttccagagaatggggctgatatttactttatactattacaatgagaagatttgttaatttaattagtaggagattgagattcagaggattgtttaaactattttgaagaatgaactttacactagaaaatgaacccttgtgcttaagaagcagttgagaagcaacacagtgaactgattgtggtaatccccagtcctttccatgaggtgactctgcttaatatctcgagtaatcattgctctataatgatggaatgggagccagttctacttctaaacttgaacttcttgaataaaatattatatggtccagacctttccaaattcaaacttgagactggccttccctctgattatttcaagtctgtgaagcttaagtctaatggcaaggatgcgtgtgtgtgtgtgtgtgtgtgtgtgagagagagaaagtcattggccttcaaggaagtaagaagtgtgacttctgaatgataatatgctttgttttatttctcagttaaaaaaagaaagcaacaggatcaattaacagaacgggataagtttcagatttctcttcagcagaatgatgagtaagtgattattctttaagaaataccactcctgcaatcttttgttttctgtatgtaacatgaagcaatgtaattaaagtatctctgacaagaaccatccaccaatttagcaataactcatcaaattccataaacatcattttctgaggtccagccttatactggaggctgatagttcttaatagttatcccttgggttgatttctaaacatgattgaaaatgctttatttttaatatatcattggaagaattacatgtaggctgacaggaaaggaggctgtgctcataagctttttttttcaaagtatttttggtcacctttgatctgactggaaaaagagggttgtaagaatatgggaatagagcaaatgaaggactggctcacagttttacagtcccttgatggggacctcttgctggtgatttggcctctctctacatagagagaaggtatggatcctgggagggaactgagcctggacacaaccaggagtcattaaggaagcctctagaaattccaaaaggtggagttctcgctgaacatttgcatatatacagaaagaattctctcattgattctgaaggcctggcacagagattcaccacacagcatctgcttgctgtggtgatcattgaatgacttattagaaatactgttttttccttcgctgcatgtcatctttctgaggtagctaaaatcagatgaaacatatggtggttcacgtggagatttaggagaaccatttaaaagttgcagataaagtctttatctttcagagttcaaaaagctccatcttttatcgtacattataggagtaacatctttaggttttatgcagtaattgacttaatagtagctggtacatactcaacaatatgaatcagttgaaggtttcatcttcatttatatacaacaacttacctaattcattaatgttataagtccacagagcaacggggattgtatacaatacccttactttgggtctagaagggagtagtttttctccttacataatagagaacctgctggcttggatctgagatttaagcttttgtatattataacctattgccacacagatttaaatagggagtattggctgtttggatggattctcagcatgttcttaacacttggtatcaatggaagaaataccactttaaatttctttttacttgtaaactgtacaaaagctcacttagttttatacatcactatttcagaaagcaacagggagcttttataagtactgaggaaactgaattggaacacaccagcactgtggtggaggtctgtgaggcaattgcgtcagttcaggcagaagcaaatacaggtatgtgtcatggtcatcttaagacgagactcatgggtgtgcaaatttttacctcgtattattaatttggaaatctacccacttggtatttttgtataaacaaaatacagttaacccatttttataaggctctcatgtcttgcatatgcaggacactctgatgggcactagagagtattggttgtcaaagtgtggtccctggaccactagaatcaacatcacctggaaacttttacagaagacaaattctcttgctctattcagaccttctggatcagaaactctgggaacaaggcccagccacttgagttttaacaggctctctctgtgattttgatgcatggtcaagtttgggaacccctgctataaaggatatagtgatgaataaaacatatatactggcttcaaggaatgcgcatttcacttaccgttggtttaatgaatagagaagagtcattaacagccgaaatatttattcttcctctgtgaatggttttatttgaagtgattttaaatactttatttaattcaacaaatattgacatagcatgatctgcattccaggagttatgcaaagtgctaggcatatagtctaactaggatacactcagctgccatcctcatgaagctaggagaatagaaagatagttaaacaagcaattaaaagtaaatttggcgagtgttacagcagggaagtacgaagtgctgtagaagcatacatgaggatcacctaaacaactctaggatcaacagcatagacttctttggagaaatgcctaacagagtgcctgatactcaacactttaatatgatgatccttaatatggaagagttctctactggttgaggagaaaaaggtaatgatagccttgtagagtttccatttatccaattaaaggtcacttccctcaggtcatctatgctgtggcccccaaagaagtaaggagagagcatagtactaatgccttcatttgacaggtgaggaaaccaagttagaaaaagatgacaatgacttttcccaggttgcatgaatagtttaatgtggccaggatgagatctgttaatttgctgcttacattagattggttaatccatttttttaaattcaactttttaaaggattacagctagttttacttctcaccttgtggtaaattagcaccatgaagtaactgccacattccacacttttcttatagtttggactgaggcatcacaatctgcagaaatctctgaagaacctgcggaatggtcaagcaactatttctaccctacttatgatgaaaatgaagaagaaaataggcccctcatggttagtaataatatagtaaattaaaattattgaggcagttttactgatgaaatataggtggagcacataggggcaatcttttgtcagcatccttgaggccattaggagtaagccattgctaaaatagttgaaataaatcttattatgaacatcaggaagcacttctgtctttaagtagaacctgtttgacctatacatagagcttctgctgatgttgatgaaatagatagtcaatctttccaaatctctaaaatcccagttttatctttagtagagcttcaccactgtgttttccatccaggcatgtgaaataaaatcagagaacaaaggggcttcaaatacactttaaaaaccagtttggattccagattagaaaataaaggaaataagcattatacattaaaaacgatttaataacatctgggggatatattttagtgtgttctcaaaaatacactaatgatataaaatctcagcatattagagcaagggagcaccctgtaaaattaaaggaggttgctttaaggttaaagtgtttatagaaggaatagtttgcaagttggtaggataccagtgggctattaaagaggaggtaggactgtttgggagtaaatccctacttttctaaagtcaccagcttggaaggtaggagtgatgcttggaggtagagtgctccttggtgcccttcagaggaatcaattacatttggcagttctactgttagtataagagggtaaacctcgtctctactaaaaatacaaaattaggcggttgtggtggcgcatgcctgtaatcccagctattcaggaggctgaggcaggagaatcgcttgaacccaggaggtgcaggttgcagtgagctgagatagtgcccttgcactccagcctgggcaacaagagcgaaactctgtctcaaaaaaaaaaaaaaaaaaaaaaaaggataatggcatggataatcacaaagctgtacagcattgactctgaaatgcagtctttaaaaaagtagatattgtttctcctaatactatgatgaccataatacatatttgtgtgatagtttaccgtttcccaaatgatttctcaattaatattcacagtattagtatgaaaaagagcgggctttattaccttcaatttacagaggaggaaactgagacttagatctggtaagatatttgtccagagttaattgtctatacctgcagttcccaaactttttaatgaaagaagcctttacatccttgaaaattgaaaaccccaaagaactcttgtttatgtaggttatatcttttaaaaaatactttcaacttttattttagattcaggaggtacatgtgtaaggttttgttacatgggaatactgcgtgatgctgagatttggagtatgaatggtcctgtcacccaggtagtgagcatagtacccaacatgtagtttttcagcccttctgccaaccctctttcctccctctagtagtccccagtgttcattgtgcccatctttgtgtccacgtgtacccaatgcttagcccccacttataagtgagaacacgtggtatttggttttctgttcctgcgttaatttgcttaggataacggtttccagctgcatccaccttgctgcaaaggacatgattgcatttctttttatggctgcagagtattccatggtatataggttacatctattgatatttaccatgtgataaaactaagaaatacaaaattttgaatgtaataattgtttaaaaatattaataaacccattgtaagtttatatcaataagatttttgtttaaaaagttacatttttcaaaataaaaatcagtgagaagactgatttaaatacttaaatacttacaaaagaaatacttttgtaaatcactttaacttctggctcagtaaaaggtgaattctcatatccacttttgcattcaatttgttgtgctaccatacacctagtatcctctagaaaactccactgtgtacttgtgagaggatgagagtgaaaaaggcaaatagtgtcttaatgtaggttgaccttgcagaccccttgaaagggtctcaggaacccacaacagtctgtctcccacactttgggaatctcaggcttagactaataataaaaagaagtttaatttctttaattaatgttagctggggatggaatggatagtagtagttgttaaatgcgagcaaaaagtcagaggaagccagtttgtgtttaaccgtttgctgtagatgatctatgaaggcattgtaaagaactcagttttaagtaggcatttttttttctagctatggtatcagaagataaagtaaatatgcaaaattgaagaatgctttaatcacagaggatgggaatatagaaaaacctattagtttctctctctttgtccaataattctctgagatgtgctactaaggaaaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttt

SEQ ID NO: 3904 - DNA, 110386 bp, human
cctgggttcgccaaggcgggcggccaggcacatgccccaagctgccgcttcggcgccgtggacctcagtgtcctgcggcaggatcccaggcctgccccagaacccagatggctgcactttcatgccgatagcccaggcgatccctctgcaggtggacatggccatggccctgcagcgcgtgaggattgccgagaagtacgggaagaactacctctgcctcctgcaagcagtcttcgtggcaggtaagtcccctcctctcatctcctccccggcggcctcgggctggcttgcccttcttctcagccgctgcctccccagcccggccggcttttctttattttccagtccacacccctccccgcgcgcactttattttccagtctatacaacccccccacctcgcccgcccgcccgcccgccgcgcacacacacactttcctgctgcagtggcgctcccagccacgaactcgctgggtcatccgttctccgttcctctggccagctgccgcgctgcaggcgtgcagctctggtctcagctcgcaggaggtgagatcaggagctctggtcccgcaggaggaccgtgggaaagtgcaggaagcagtatgaaactgtctctgccattgctggttcaggtctcctatccccttctcacccactttggtgcgtccccggagaagtgggaatagagtgtatcttcccacactgcatctcacacaccagaacccagcctctttgaggagtgcacttcccttgtaatattccctgaagttgaaaaagcaatttttttttgtttttgtttttcccataacgcatgtggaggaaaccaagtcaaaaaggcactcaggttcggaaaccagcagcagggccgtggcagggcaggtgggggaggagttgtagggaaacagctgctgccactgacttgggctttgcacccagaaaagcgcatcttttcatcttggtccatgagcttgttgcttccctacaaaggcaaaagctcttgtttgtctggaaggacaaacaaaagcaaagacaagtaactcacaaagtctttacggccgctgccatggtttgattaaggggagtaagtggggtaacatggacttggtcacttgccagtcgtgatacactcacatttagcaagctgaagttgcccagctttggggttgatgtagcagggaggatgctgcaggctgtggggctgcgttcctatggggccattctgactggggcaccggggctgcctcagaacagagtgcaactctgagacctgaagttcagccagagcttttcagagaagtctgcaaggtgctgcaattgatgtgcgcgccttcctgtgcacccaaggtagttttgacttagtaggttctaagccttgcagtggaagttttggtattcaaaaaatagacttggtggcaatttcccacaaatcagatagccacaacacatgttccaaatatacctccctattcagtgctatccacaaatctaaaggaggccatgcaaacatcttcagttagaccagaggaattaattcaaggctgtggtctgtgcatcttcatcacacagaactctttggtcttgcttgttttgttttgagctggtctatattattttctagatgtaataaatcattaagggcaatgtggtgatggggcacaaactagttccggtcttaagagcaatttaaatagtttttggagactacaaaaaaaaatcttgctgaaacattccgtgcagtacagtggaaagtactttgcgttttgttctcatttaccttctgcatcatcttgggagctaaaaaaaaaaaaaaaaaaaaaactcctttggaggaatgcatgcttaatcacaaaggttaaattagttatgctatgaaatgtaagttgatatttttgctgctagtgatttctcttatttctagagttgtgtgatgtgtcatctgttcacacttttgaaggctcctacatgttgacaggcccccattcctgtggcattacaatgtgtcataacacctaaatgacaccagttgctgtgctgtgtttttacctgggcttgcaatacttttgtaccttttcagcatttgccctggaagggatttgtagccatgtgattagagtacacactatagtacaacaattttaaatgtaaaatggatttccatatacttcgaagctatttatatattaaaatatgtttacaaagtttttcattgtggtaaataactttctgaacaatcacgtcaaaaatgaccatttgtggattgctcaggcccagaaattatactacagagtaataagctaatgacatatgtgtgtgcagaatcttccctggggcaaccagaagagaaaatgattggcttcacttagggagttaggggaagacttgatggagagagtgatgcatgagttgaatcttgagagatgcacacaaatgtccagctggacagcgggtggggattgaacgtggtagggataggtgggtgaatggtattccaggcaaggaaataagatatgcaaagacaagcagagagaggagagcagagtaggtttggggaattgtaaattccttttaaatgactggagtgtaaaatatggggggtaaaggagagagagagatttggagaggtaggaggggcctcgtaaggcatgttgagtggttttactttatttccagagcaatcggaagccactggagtgttgtaagcagggcaatagagaaagctgctgcatatgattgaacaggttgtgcactgcaaaacccctggggcctccactgacacagaccacaccaggaatgatgcccttactatggctgtacagtgcacagtatacacagtggtcaacagcagctatgagtgatggaactttttgctttcacaaagatcatccaagttgtgtggaggattcagtgtgtggcttatgccgtggagaggaagaagactggagataaaatgactagttagaacacagttgaagtaagctggctctcagtggatagaggcatggactgtcacttctggggatgaggagaaggggagaggtctgagcggaattaagagggtaaattgatttgacttggtgactagtcgtggtgttcgagggacagggaggagactaggttaatttcaggtttctggttagggtgactgaatggaaagagatgccattaacacagggaatggaagaggaagaggtagtttgattttcaattctgggtatgtggtttctgtggaatattcaggtagagctgacgaatgggtctgcagctgggaagaagtaaatgttatttcttattctcatcatctatagggttcattaaacatctcctggcactgaagttctttccttaaatctacttctccatgggctatattgataactcagcaagtctagtacagaagtaggcacacattataaaattacctttcagacttgttctttatattttccctcacacatttctttacctgatgatgaaaaaaaatgaaaaaaagaaacgtcttgtattcatcacaggaggaaagaatgtaagctattctgatctaatgtaacctcagataacttacataattagttgtgaaaacctgttcactgcaaattttactcatcagagtatagctcagggagatatgtaaatcacaacaaaatttattcagtgtgcattccagtatggtatgaagatttatttcaatgatgatgggtcatctattaggccacacgatactgtgagtgttccacgtaactgatttttctgggtaactgaggttcaacacttttagtgcctgactttttccccttaaaatatgtatccattttggatgagaagcttttcaaaaatactatttaccttcctgacccctgaacctggaaataattgcatccttttttgatgggttaagattgtccttataatagcattagttctttcaatgtgctgtattcagtgctgcctctgggctcctaaactgtggagggctgtttgtccctatactaaatggggacagattgttctgctttttaattttcaatgcctgacttttaccctctaacttttccgtagatttcctctctgttagctgatattttttgctgctgttaatttaactgtttctactggccagttgttattgcctaatcctccatgccccctcctccattgccttctctgagtgttacgaactagggaacaagataatcaagcttgttcgaactgtgtgaaaagtataatagaccatgagtaggcctgtggggaatctacctcaactaatgtatatgagctttagtacatggactctgtgatatctattccaattgcaaaacatctttttcttttctttctttctagttcctttgtgtgttttggagggttgatgcagttaaataagttatcagtaaaaatctatgttctcctgctaatcgaggcataataacatgtgaaattgtaatattttacttccttgtaaaacaaacaagtgtgttcagaatctatcagcaattccacgtgcattttatccactgcatttctcagacatgcctgtgcttggcaccagaaggcacttcattcttaaaatttgcccccaggtttgaaagcaattgtccctgtctctgctcagcatcttcttaagcaagcatcctctgaaggctcaataaacaacttgcaccttacctactctagggcaggagcagaggccaatcccatgaggagagatgccttctatctgatggctgacaaggccagtgcctctttctgttgcttcgacgtcttgttccagagacagttagctcctggccagaggccagtgtcacagaagttacatttattttttcacccaaacttcccctcattgtatgtttatggcagatgtaagaatctgagtgacttcttgttacttccagcactgggaagatgccattgagcaaaatcctgaaggaggtaggaagtgaactaccagaggtgactgggggagagtgtttcaggaagagggggcagtcagtggaaaggccttgagacaagagcatgctgacaagttcaaggaacaagaaagagacgggtatggctgaagcagagtgagtgtttgcatatgtgtgtgtgtgtgtatgtgtgtgtgtgttgtgtgtgtgcatgcgtgcctgcatgagatgaagccatagatgtaataaagtctggatcacatagggcttggtaagaatttaggcttttaacctgagtcagatgatgagccattggaaggttttgagcaaaggagtcacttctgtgttaacagaatccctctggatgctgtgtagagaataggattaaggtcagacaaagatggaagcagtgaaaccagttaagaggctattagcattaatgatggcaacttgaaccagagaggtaatttgtggaggtggtaagagtgatcaaatagattctggatatattttgaggatagagtcagaaggatttgctaatggtttggatatggagtatgagagaaagaggagttaaggataatgctaacatttttggctttagcaagtggatggcagaaattttcatcagtggagatggagatgcctgcaggaggcgtaggtttacggggaaaaattatgaatatcagaagtttggctgtttgaacctgttaactttttttttttccgagatagagtctcactctatcacccaagctggcatgcagtggcacaatctcagctcactgcaacctccgcctcccacgctcaaatgattctctcacctcagcctcccaagtagctgggattacaggtgtgcaccaccacacccagctaatttttgtatttttaatatagaatcatgtcgtctgcaaacagggataatttgacttcctctcttcctattgggatgtcctttattttttttctcttgcctgattgctctggccaggacttccaatactatcttgaataagagtggtgaaaggacatcttttcttgtgccagttttcaaagggagtacttccagcttttgtccattcagtgtgatgtcggctgtgggtttgtcatagatggctcttattattttgaggtacgttccatcaatacctagcttatcgagagtttttttttttttttaacgtgaaggggtgttgaattttgtcaaaagccttttctgcatctattgagataatcatgtggtttttgtttttagttcccatttatgtggtgaatcgcatttattgatttgcatgtcttgaaccaaacttgcgtcccagggataaagcctacttcatcatggtggattagctttttcatatactgctggattctatttgctagcattttgttgagtatttttgcatctctgtttatcaataatattgccctgaagttttagaattgtgtctctgtcaggttttggtttaaggatgatgctagcctcataaaatgaattagggaggagtccattttggaggagtatttagggttttctaggtgtatgattgtagcaggacaagccacagacaaaacccctcagacaccgagttaaagaaggaagcagtttattcggctgggagcatgggcaagactcctgtctcaagagccgagctccccgagtgagcaattcctgtcccttttaagggctgacaactctaagggggtccacttgagagggtcgtgatcgattgagcaagcagggggtacatgactgggggctgcatgcactggtaattagaacggaacagaataggacagggattttcacagtgcttttctatacaatgtctgtaatgtatagataacataaccggttagatcaggggtctatctttaactaccaggcccagggtgtggcgccgggctgtctgcttgtggatttcttttccgccttttagtttttacttcttctttctttggaggcagaaattgggcataagacaatatgaggggtggtctcctcccttatgatcatgtcatcagcaaacagagataatttgacttcctcttttccaatttggatatcttctatttctttgtcttgttttattgttttggctaggatttctagtactatgttgaataggagtgataagagtggacatccttgtcttattctagttcttaagggtaatgttgtcaacttttccccattcagtatgaccttggctatctgtttgtcatatatgagagcctatttttaaaaatagcttttgtagagctataattcacatacaattaacctacttaaagtatgcaattcaatggtttttagtataatcacagagttgtgcaacctttaccacaatctaggtttaaaatattcccatcaccccaaaaagaaaccccatactcgttagcagtcactctccattttctcccaaccacctttttcctcagcccctggcagtcactagtctactttctatttctatagatgtgcctattctggacatttcatatacatagaatcatacaatatgtgatctcttgtgactggcttctttcactgagcgtaatgttttcaatgtccattcatgttgtcgttgtgtcattcttaaaatggctgcatcttattgcagtgcatagatgtgccacattttaattatccaataaaaatgataggcatttgtgtggtttccaccttttggttattatgaataatgttgttatgaacattcttatacaagtttttatgtggacatatgttttcatttccctgtggtatgtatctaggtgtggaaattgctaggtcctagagtaactgtatgtttcatccttgaggaaatcccagaccgtttttcaaagcagctgcacccttttacattcccaccatcaacatatgagggttataatttctctacattcttcctagtacatgttaatctctctttatttcccagccatcctagtgggtgtgaaatagttttttattgtagttttgatttacatttcctgaatgactagtgatgttgagcaccttttcaggtgcttattggccatttatatatcttctttggataaatgtctacatggattatttgcctgatttaagattgggcttttcctcttttactgttgagttttaagagttctctatatactctggaatggagatctttatcagacatttaatgtgcaaatattttctcccactctgtgggttgtctttttacgtacttcatggtttccttgaatcgcaaatatttttaactttgagaaggtcgaatgtatctatttttttcttttattgcttgtactttggatgtcaaatataagaaaacattgcctaatccaaggtcataataaattacaactatgtgtttgtctaagagttttatagttttacttcttatacttagatctttgatccattttgagttgatttttgtgtatagtgtgcggcaaagattcagcttcattcttttccatgtgcacctccaggtttcccaacatcatttattaaaaagaatatcctttccccgttgaaatgtcttggtgccctggatgaaaataaattaaccttcggtacaaagatctatttctggactttcaattatttcccactgatgtatctataagtctatcataatacctatctttattactgtagctttgtactaattttgaaatcagaaaatataaactttccaaatttgtttttctttttcaagattgctttggttattccaggtcccttgcgtatccatatgaattttaagactagcttgaaaatttctgtgcaaaaagccatctgggatgttgctagggatggcattgaatctgtagatgaatttaggaagtaccttaacctcatttttatagtggcacaaattgaggtttcccaaactatggaccattcacatttaacatatttggaattatttactataatggatattggcattctgcccttcagtgctcacattggatagttattcatctttagtttgtcatgaatttacaaagtttatggctgggcgcggtggctctcgcctgtaattccagcacttttggaggcctaggtgggaggattgcttgagcccaagattttgagaccagcctgggcaacatagtgagacctcatatctacaaaatatattttaaaaaattagctgagcatggtggcacactcctgtagtcccagctactcaggaagctgaggtgggaggatcacttaagcccaggatgtcaagactgcagtgagctgtgatctcgccactgcactccagcgtgggtgacagagtgagaccctaactcaaaaaaaaaggagaaagtttgcaacatattcattcctagtatgagaattattctagacactgtgctgaagtcttaaaaggcaagaaggtatcaacctgatctctcccaagggaaaacaataatacaaatgaaaacaacaacatcatcactaactcagtcgcctttgtgtttgtgattcagcatttggcaggcacgtctgtgtaggactggggtgggataacagaagaaatgagaggcatatgtttggataccacactgccacgaatcggcaaaggctttttcatgctggacaagacaatttgtcaatcaagtgtgtagttatcctccctgtggcaggagatattttttaggaaaatagactgcagtggctcgataaatggacttggaccagatctacagtggatttgctgatgctttaagcaggaaaaatatttacttatttctatttttacatattgtaaatcaccacgtatgtagttcttctttacagactgattcagttcctctcaaaatttacctacatgttttggatttctgaataataaattcattcagctgtgattattagggaggttcccaagacaatgtcagctcctgctgctgtacagggaaaacctgccatctctactgaatggtttttaatctgaaggaaggctgaaggaaaaggtttccacagacatgctcttaattaaacacctacaagagatatagtcaaggagcagcaacctgggacactaagcctgtggggggaggtcttctcactgtcacttcccaccagctgtttctcattttttctcatgcatttttcctgccctctctctttcatccttctcttttctcggttcttccccttatttctcccttcttactcctgtcatttcctagtgcctttgagtcttctttttcctgtttttgttttctgtttttggtagggaagtatcttttatttcctcttcttctattcttataattaaattatgtatatgtgatctttgtaaaatatctaaacaaaacaaatgcccataaactaataaatgaaagtcatccatgtgcctagcccagtcctgctccttggtggtaaacactgctaatagtttgtgtgtgaggacataggaggttttctatgaatatagatatatcaattcaattcaaacatttattgatcacctccagtgtgctagacactattgagatattatggtgaacaagtaaataaatctctgccttcagggaacttatttctaatggtgagagcaacaataaaaaatccacatatatctagatattttaccaaactgggatcatacaccatatgttgatctaagacttgtattggaatgtgtgtatttaaaaattacttcattacgaaaattttgatacacataaaataatgcaagaggaaaagtaaagtatataatataaaatcatgatgctaagatattttaaaatttccctttcatagagcacaaagaggctactgtatcttttcagcataaagcatttgcccagttttgtcttaatgggcttatagtagaccctgtagatgctactggaatatgaattttgcataactttgtggctggagggtgtggtagaggttgagctgccctttcataaatgccttgactaggtcagcatcagccgctgctatcagccaagagtattctttacattcaaggatactgagagttctctggtcatcacgtcttcatttgtactcttgtaccattgttaagtggaagcaatagctgttgcatatacactgtgatgagaagaataacctttgagagttattttaaataacattttctctattttaactgaaattgtgtgattaggtatatgtattctgagactctttgatggcaattagaaggaatatgcatatttgggggcatctttgagtttgcaattgcaggctagatcatgggattagccatagagcaaaaagcagtggccctgtttttatttgtaattttgcacttgtcagtttacaaaagagggtcaggtttactttcttcattaacatattcaaaggaccatgaacagatattgtgtgttcttctgcatgcattacaaactaaaataagtcattttaattggatttaccattgcagatgttgtacatttcaaaatgattttatgaacccaagaagaggtgaatagctacagagtaggagatctggcatttagtcacgtctacatggatattgtgagttctgatatcagtgggtcatcttgtctctttttatagcttgtgctttaaatagctgctctcaaaaggtctgatgccataataaaaaattaaataggggttaatgtaaatatttacctattgctaaggtagtatgtttggaaatatttagtggtggctgtggctgtagtggtcagggactagtgtttctttaagctcatgttcaaacatgcccctactcgtttacactgcaagaactgaatggtgattatttgggtgaataaagtaatgccctttcagtgccttttccccacatttctgttgttgaggaatactctggcatattcaaaatgtcggatgaagagatttctttttaactgtgctttgcaaattatccaaggaatctaattctcaaaggcagttatattcatgactacaaaaaattttttaaaaacccacacaattagccggatgtggtggcacttgcctgtagtcctagctactcagaaggcttaggcgggaggatcgcttgagcctaggagtttgaggctgcatgaagctatgattgcaccactgcactccagcttgggtgacagagtgagaccctgtctctaaaaataaataaataaaataataaaaaataagtaaagatggagattaaagttttaaaaccctccattttaaacacttaatattttcatgtctgcacactatatgaatgcacatatacgtgtaaatattgatgtttacaaaaattacagaaatgaatggcttccctttatttgcagcacatacaaacatgtctggcctatgaaaaggcatgtttgaaaagatgagggagctcactatcatattgctctcatccttggaaacaggtcttaattattaatatacttaaggttatattgtaaccttaatataatattgagtcaggacctgaagaggtggaaggtctttcaggtcctgactcaatattatgtgctgaaagcgtcccaggaggtacttggcgtaggttaagtataaaacctttttattttttcatttttttaatacatgatctattttatcagtttagtgctggatgtcctttcactgtgtgctcttggcatcctgggctcaatactactgtaacacttatcactctgggctttcactgcttcctgcctctagatgtagagtcccaggagatccagaccagtgtctaactggtttctgtatctatccccagtgctgcacagggcctgatataagataggagcctaacaaaggtttgttgaaagaacaaattcatgaatgattagagtggctgaaaaacacatggaaaaaaaagttaaagttgtgtggaattgtagattcctgttttgtattcctattctttccttccatcctctcattccttccttacatttcacatcttccttagaattccactttgtgctactgagggtaaaataatcctgtggttccttcctttaaaacacacttaaaagtctgagcatctgagaacagtcagatctgtgcatgtttttttccagatgtggacactattcattattatgtgctctgtaagcacgtggtaaaatgacattgaatgcatagtaggtgctcaggcaaacactaaaagtttgggttgacattgtacatgtctttaatgtgatctcagagttcatttgatctttgttgccacatctaactgattttgtttctccattttagattgtttgtgtcaagtcattcgtatttacccttcagctctagaggggtaaaattctacttgggatgttttctttcagttatgactaaaataattttaaggtggtccttcaaaatggatgttttgtgaaaaatgaaaagtaaacctgtgataagagcaaaatccaaaaccaaaacacatctgtaatgatgttgttgcacatataagtgcttgctattgttagattttttaaaaaatgttgcttaagtggtgagtataaaaggttatcctgctctccttgaaatttacatttcacacactacaaatgcagtggagcatcttttcaagtgttcattggccattcttatttcctcttctgtaaaatgcctgcttgtgttttatttttcatgtatttatgggttgtctttttcttattattgacttataatcttttatatatccttgatattaattactaattctttgtcgttacatgtgttgaaattatcttcagtcaggttttggactgtctcatcactttctttatcatgtattttgaggaaagaaatgaaaaattttaatgtagcataattaatcagtttttttattttatgctttctgcttcttccatcttgctttaaaaagtctatcctacccataggttacacagatatcatactatattttctctgatctgattcccaacagtgtaagatttgaatcctcaccaatgcatgaccattagcgtgaaggtggaaattgttagatatcccaggggtaactgctattatttgttggcttctcccacaagatattcgcctaagtaatgattttggcctctgaggatttgcttgtctttccagccagctcagcgatgcattaaaaaagatttttttttgagacagggtcttggtctgtcacccaagctgtagtgcagtggtggaatcacagctcactgcagcctcgacctcctgggctcaagcgatccttccacctcagcctacccagtagctgggactacaggcgcctgccaccacacttggctgatttttgtatttttagtagagacggagtttcactgtgtcggcccagctgcccttgaactcctgacctcaagtgatctgcacgccttggcctcccaaagtgctgggattacaggtgtgagccatcgtgcctggctgaaaaggatttaatttgatttttcccaccatgtttttgtattttgtactagaaggtttttcaggatttttagttacccatatgaccaagaaggggagctcctccatgtttttcaaacttagacgttcaatgtttagattcaaatatgatatctaatgtaggagtttttcttgtacacaagacgtgagatatggatcgggaaacataacccattaccccatccacagatggcttaaagggggaaaagatgggagtggtgttctggctctggggtcctttgtgattgtttggagaaggtgatgcagaattaaaatctttgcagaactatagtggtaataaactcagcatgttacctgtggcgtattcgtatggtctgcagcaacctcaattcttgcctcctcagaagaaagaattcaactgaaggtcataaggcagaagaagagaccgaggcaagttttagagcaggagtgaaagtttattagaaagctttagagcaggaatgaaaggaagtaaagtacacttggaagagggtcgggtgggcgacttgagagatcaagtgtatggtttgacctttggtcttggggttttatatgttgggatgcttctgggatcttgtgtttcttctcccctgattcttcccttgaggtgggctgttcacacatgcagtggcctgctagcacttgggaggggagcatgcacagtgtgtttactgaaattgtatgcatccttacttgaggcattcttcccttaccagtcaaatgtcctagaaggtcataataccagttaaactccaccacttttcctcttagtgtgcatgcatgagcccacttacccaactcctgagatcttatcaggagctgctgatcaccagtttcagatgtttctgtttattgggagatggcctttccttggcactggctgtgaccaattattatcttagagagacagtttcataactgcctgatcatcacctgttggttgcctgacattcctggtgggaaggtgtccctctcctgccctgctcatgtctgactagctaccctctgtaacaagcattgtctgtgactgcatgaatgctaacttttacatgaaacctttgaaattgtaatgtcattttttctttataacaatggccgacatttatcgagcacttactatacactaaggtaagtgctttgcatgtatgaaaaacttattcattacaataaccctgtgaaataggtgctgccattttttccactttaccaataaaagaaacagacacagattttaagtagcttgcccaaggtcacataactaccaagtggtacagctggaatttgaatccagtcaatctgtttctggagtgagaactcataaggagtatgctatatgacctctataggaaatgcttatttgttcagaaaaataagaatttttttccattccaagatggccaaataggaacggctccagtctgcagctcccagtgtgatcaacacaaaatatgggtgatttctgcatttccaactgaggtacctggttcatctcactgggacttgttggacagtgggtgcagcgcatggagggtgaactgaagcagggtggggcatcacctcacccgggaagcacaaggggtcaggggatttccctttcctagccaagggaagccgtgatagacggcacctggaaaaatgggacactcccgcccaaatactgtgcttttccaatggtcttagcaaatggcgcaccaggagattatatctcacacctggctcagcagatcccaagcccacagagccttgcctactgctaacacagcagtgtcagatcaacctgtgaagcagcagcctagcagggggagggggtccgccattgctgaggcttgagtaggtaaacaaagcagccaggaaagctcaaactgggcagagcccactgcactcagcaaggcctgctgcctctgtagtctccacctctgggggcagggcatagctgaataaaaggcagcagaaactgctgcagacttaaacgtccctgtctgacagctctgaagagagcagtggttctcccagcatggtgtttgagctcggagaacagacggactgcctcctcaagtgggtccctgacctccgtgtagcctaactgggagacacctcccagtaagggcctactgatacctcatacaggcaggtgcccctctgggacaaagcttccggaggaaggatcaggcatcaatatttgctgttctgcaatatatgctgttctgcagcctccgctggtgatacccaggcaaacagagtctggagtggacctccagcaaactccaacagacctgcagctgagggacctgagtcttagaaggaaaactaacaaacagaaaggaatagcgtcaacatcaacaaaaaggacatccacagcaaaacgccatctgtaggtcaccaacattaaagactaaaggtagataaaaccacaaagatggggagaaaccagagcagaaatgctgaaaattctaaaaaccagagagccttttctcctccaaaggattgcatctcctcgccagcaatggaacaaagctggacagagaatgactttgatgagctgacagaagtaggcttcagaaggtcggtaataacaaacttctccaagctaaaggaggatgtttgaacccatagcaaggaagctaaaaccttgaaaaaagattagacgaatggcgaactagaataaacagtgacctgacgagctgaaaaccatggcataagaactacgtgacacatgcacaagctttaatagctgattcgatcatgtggaagaaagggtattaatgattgaagatgaagttaatgaaaccaagcgagaagagaagtttagagaaaaaagagtgaaaacaaacaaagcctccaagaaatatgggactatgtgaaaagaccaaatctacgtttgactggtgtacctgaaagtgacagggagaaagaaccaagttggaaaacactcttcgggatattatccaggagaacttccccaacctagcaaggcaggccaacattcaaattcaggaaatacagagaacaccacaaagataatcctcaagaagagcaaccccaagacacatagttgtcagattcaccaaggttgacatgaaggaaaaaatgttaagagcagccagagagaaaggttgggttacccacaaagggaagcccatcagagtaatagcagatctctcggcagaaactctaccagccagaggagactgggggccaatattcaacatacttaaagaaaataattttcaagccagaatttcatatccagccaaactaagcttcataagtgaaggagaaataaaatcctttacagataagcaaatgctgagagattttgtcaccaccaggcctgccttacaagagctcttgaaggaagcactaaacatggaaaggaacaaccagtatcaaccactgcaaaaaacatgccaaattgtaaagaccatcgatgctaggaagaaactgcatcaattaatgggcaaagtaaccagctaacatcataatgacaggatcaaattcacacataactatattaatcttaaatgtaaatgggctaaatgctccaattaaaagacacagacaggcaaattggataaagagtcaagacccattggtgtgctgtattcaggagacccatctcatgtgcagagacacacataggctcaaaataaagggatggaggaatatttaccaagcaaatagaaagcaaaagaaaaaaaagcaggggttgcaatcctagtctctgataaaacagactttaaaccaacaaagatcaaaagagacaaagaaggccattacataatggtaaagggatcaattcaacaagaagagctaactatcctaaagatatatgcacccgatacaggaacacccagattcataaagcaagtccttagagacctacaaagacacttagattcccacacaataataatgggagactttaacaccccactgtcaatattagacagatcaacgagacagaaggttaacaaggatatccaggacttgaacttagctctacagcaagcagacctaatagacatctacagaactctccaccccaaatcaacagaatatacattcttcacagcaccacatcacatttattccaaaattgaccacatagttggaagtaaagcactcctcagcaaacgtaaaagaacagaaatcacaacaaactgtctctcagaccacagtgcaatcaaattagaactcaggattaagaaactcactcaaaaccgcacaactacatggaaactgaacaacttgctcctggatgaccactgggtaaataatgaaatgaaggcagaaataaagatgttctttgaaaccaatgagaacaaagacacaatgtaccagaatctctgggacacattcaaagcagtgtgtagagggaaatttatagcactaaatgcccacaagagaaagcaggaaagatctaaaatcgacagcctaacatcacaattaaaagaactagagaagcaagagcaaacacattcaaaagctagcagaagacaataaataactaagatcagagcagaactgaaggagatagagatgcaaaaaacccttcaaaaaaatcaatgaatccaggagttggttttttgaaagattgacaaaattgatagactgctagcaagactaataaagaagaaaagagagaagaatcaaatagacgcaataaaaaatgataagggggatatcaccaccgatcccacagaaatacaaactaccattagagaatactacaagcacctctacgcaaataaactagaaaatctagaagaaatggataaattcctcgacacatacaccctcccaagactaaaccaggaagaacttgaatctctgaatagaccaataacaggctctgaaattgaggcaataattagtagcctacgaacaaaaaagagtccaggaccagatggattcacagccgaattctaccagagatacaaggaggagctggtactattccttctgaaactattccaatcaatagaaaaagagggaatcctccctaactcattttatgaggccagcatcatcctgataccaaagcctggcagagacacaacaaaaaaagagaattttaggctaatatccctgatgaatatcgatgtgaaaatcctcaataaaatactggcaaaccgaatccagcagcacatcaaaaagcttgtccaccatgatcaagttggcttcatccctgggatgccagactggttcaacatatgcaaatcaataaacataatccatcacataaacaggaccaacggcaaaaaccatatgattatctcaatagatgcagaaaaggcctttgagaaaattcaacagtgcttcatgctaaaaactctcaataaactaggtattgatggaatgtatctcaaaataataagagctatttttgataaacccacagccaatgtcatactgaatgggcaaaaactggaagcatttcctttgaaaactggcacaacacaggggtgccccctctcaccactcctattcaagatagtgttggaagttctggccagggcaatcaggcaagagaaagaaataaagcgtattcagttaggaaaagaagaagccaaattgtccctgtttgcagatgacatgattgtatatttagaaaacccaattgtctcagcccaaaatctccttcagctgagaagcaacttcagcaaagtcttaggatacaaaatcaatatgcaaaaatcacaagcattcctatacactaagaacaaacaaacagagagccaaatcatgagtgaactcccattcacaattgctacaaagagaataaaatacctaggaatccaacttacaagggatgtgaagtccctcttcaaggagaactacaaaccactgctcagcaaaataaaagaggacacaaacaaatggaagaacattccaagctcatggataggaagaatcagtatcgcgaaaatggccatactgcccaaggtaatttatacattcaatgccatccccatcaagctaccaatgactttcttcacagaattggaaaaaactactttaaagttcatatggaaccaaaaaagagcctccattgcctagacaatcctaagccaaaagaacaaagctggaggcgtcatgctacctgtcttcaaactatattacaaggctacagtaaccaaaacagcatagtactggtaccaaaacagatatatagaccaatggaacagaacagaggcctcagaaataacaccagacatctacaaccatctgatctttgacaaacctgacaaaaacaagaaatggggaaaggattccctatttaataaatggtgctgggaaaactagctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagggcttcatgactaaaacaccaaaagcaatggcaacaaaagccaaacttgacaaatgagatctaattaaactaaagagcttctgcacagcagaagaaactaccatcagagtgaacaggcagcctacagaatgggagaaaatttttgcaatctacctaactgacaaagggctaatatccagaatctacaaataacttaaacaaatttacaaggaaaaaacaaagaaccccattaaaaagtgggcaaaggatatgaacaggcacttctcaaaagaagacatttatgcagccaacagacacatgaaaaaatgctcatcatccctggccatcagagaaatgcaaatcaaaaccacaatgagataccatctcacacccattagaatggcgatcattaaaaagtcaggaaacaacagatgctggagaggatgtggagcaataggaacacttttacactgttggtgggagtgtaaactacttcaaccattgtggaagacagtgtcacaattcctcaagcatctagaactagaaataccatttgacccagcaatcccattattgggtatatacccaaaggattataaatcatgctactataaagacacatgcacacgtatgtttattgcagcactattcacaatagcaataacttgaaactaagccaaatgtccatcaatggtagactggattaagaaaatttggcacatgtacaccatggaatactatgcagccataaaaagggatgagttcatgtcctgtgcagggacatggatgaagctggaaatcatcattctgagtaaactatcacaaggacagaaaaccaaacaccgcctgttctgacccataggtgggaattgaacaatgagaacacttggacacagggcagggaacatcacaccccggggcctgtggtggggtgggtggaggggggagggatagcattaggagaaatacctaatgtaaatgacgagttaatgggtgcagcaaaccaacatggcacatgtatacctatgtaacaaacctgcagattgtgcacatgtgccctagaacttaaagtataataaaaaaagaattaaatgtgtttaagataataatccccaaatataacatattggtgctgtgatgtcattgcagtcttttttccctagcatacatttccaaaagtgtagcctacttcttatgtttttggtatttttttctttcatatctcttttttaaataattaaatccttttgaaaagataagtggaaaaaagtacattcatcgttcaaatgaacttttttcttataaataccaaatttttccttgagctttttggtaatggcttagttgggatataatacacgtataatacaatttacccatttaaattaaatgtttttagcatattcgcagaggtgtacataaccatcactgcaatcaattttagaacattttgttactccctaaagaaaccctgtatattttagctatcatttccgaagctccctgattcccctagccctaggcaatctctaatctattttctatctttctctctatgcttattctagacatttcatagaaatgaaataacacaatatttggtcttttgtgtctggcttctttcacttagcgtgtttttttcaggattcatccatgttgtaggatgtattagtccttcgtttctttttattgccaaataattttccactgtatggatatgctgcttttgtttacccattctacagttaatggatatttgagttatttccacctttggggttttatgaataatgtggctattaacatttgtgtataagtttttgtgtagtaatatgttttcatttctctttgctgtatatctagaggtagaattgctgggacatgtggtaaatctatgtgtaaccttctgaggaattgcaaaactctattccgtaggggatgaaccattttacattttataataacattttacatttacatgtatgagggttccaatttgtccacgtactaatcaacacttgttcttgtccatcttttttgttacagacatcctcttgggtgtgatgtggtatcattgtggtttccatatacattttcctaatgactaaatgatgttgagcatccttgcatgtgctcatggaccacttgtatatcttctttggagatatgtctattcaaatattttgcccattttaactcaattctttgtctttttgttattgatttataagtgttctttatattctagatacatgtcccttatcagatatacgatttgcaaatatatcctcttattctgtacgtcatcttttcactttcttagtatcttttgaagcacaaagttttaattttgatgaagcccaatttatataattttaaacatttgtacttttgatgtaatgtataaataagaaggttttgccaaatgcaaggtcacaaagatttacttctataatttaatattttgattgttttagctgctacattttggtgtttgatccacttttagttaatttttatatatatacatatatatatgacatatgtagatatcctgttatttcatcactgtttcttgagaatacttttgttttccccagtgaatttatttgttcttgtcaaaagtcatttgagagacgtatcatgatggctgaatagaaacgtttcatacttgccccctccacttagaaaaaccaaaatagcgtatagacaatcacacattttggatacattatccaagaaagaacactgaacttcaacagaagagtgacaggaaacaccaaaatcaaggaaagagaaggaagagaggcagcctgcttggccgggattggcaggcagctgggagtgacttcccaacacagggaaaggttaagtgagagacttttagtgactcacatccccacactggaagcatgcaatcctggccatggaagaggccctctatcttctcaaagcctgaaacaaacataaggagttaccaggagaccgtgagatggaactgctccagggaaggaactagcactaggacccacacctgttctgagtcttgagtggctacatcaagacactatttgcagtcttagcctttaacagactgcacagtatcctggaacccagcggtgttgggactgaggtgttattgctgctggaaactggggaatcagcctgctgataactgccaacattgctgtcagtgtacactaccctggggcacaaagataggcatgctcagagactgggagtgagctgggaatgaacttacgcagctggagctgagaagcaagtgcatgggttgcagctgccggtgctagaaagggaggaccactgggactaagctgggacatgagtgaagcatgagttgtggctgcaactgagtcatggggctcctacagctggggctgaggcacaagctaaaaatgggctaccactatgttgctcaggttagtcccagtcatcagggttcaagtgatcctcctgccttggcctcccaaagcactagcattacaggcatgagccagcatgcccaagcagtatgctaccactgctagagctggggagtgtgccccactgggatcggagtgtgagagttacatgtgctcaccacccaccagcttggactgtggccaccaacagccccaccctctccagtgacagggccttagcatggctgctaccaccctttccccaaacactgcccaaaacctgaagatcacccagatcctacctaccacaagcagtgcctgctctcaccattggagacctgagcatgagcctgcccacaccccctgagacagagcacatagcctggaatcatgagggatgaacaacccaattcaccactttgggcacctgaacattcctcctaggggctggatgtacgacctaaactcctggctactaccacctcagctgacacctacctgcaaatgctacctgcaggcctggagactggcttggccagcacattgcagccaccacctacatcagtgcataccgcttgggcatgctggctcatgcctgtaatgctagtgctttgggaggccaaggcaggaggatcacttgaaccctgatgactgggactaacctgagcaacatagtgagaccctatctcttaaaaaataaaataaaataagccaagcatggtggcacatgcctgtagttctatctgggtaacagagcaagaacctgtcaaaaaaaaaaaaaaaagaattcaaaatattgattttaaagaagctcagtgagatacaggagaattctgaaaaataatacaaagaagtcagaaaaacaatcagggtatgaatgagaagtttaccaaagagatggatattttaaaagagaaccgaatagaaattctagaactcaagaattacttgaaagaaatacaaaatacgtttgaaagcatcaataatacactagatcaggcagaagaaagaatcatggaacatgaagacaggtcttttgaaataacccagatagagaaaataaagagattaggataaaaaaagagcaagcaattttttgggacatttgggacaaaataaagctactgaacatatgaattatcagtatccctgagggcaaagagaaaatgaagagattagaaaatctatttaaagaaataatagatgaaaactttccaaccctagcaagagattttaggtgttcagatgcaggagtctcaatgatccccaggaagatataatgcaaaaggtcttcttaagggcacattatattctgactttcttaagtcaaagataaggagtgaattctaaccacagcaaaagaaaagtgtctagtcacctgtaaaagaaactgcatcagactaacagcagatttctcagcagaaacttcagaggccaatagagaatgggatgatacatgtaaagtgctgaaagaaaaaaaataccagccaagaatactatatccaataaactatcctttataaatgaaggagaaataaagtattttttaaacaagcaaatgctgaggaaattcactttagggccaccagactggccctaaaagaaatgctcaagggagtcctaaacctggacacacatttactggacatacatttactaccataattgaactcataagcatagagagtagaaggatggttaccagaggctgggaagggcatggggtgttgggggagaggtggggatggttaatgtgtacaaaaaaaaaaaagaatgaatgaataagacctactatttgatagcacaatagagtgactatagtcaataataacttaattgtatatttttaaataacttaaagaatgtaattggattatttgtaataataaggataaatgcttgaggggatacatactcctttctccataatgtgcttatttcacattgtatgcctgtatcaaaatatctcatgtgccttgtgtgtgtgtgtatgtgtgtgtgtatatatatgtatatatataatatacatatatatatggtttgtgtgtgtgtgtatatatatatatatatatatatatatatacacacacacctaccatgtacccataaaaatcaaaaggaaaggattataatatccttataaaaaacacatgaaaacacataactcactgataaagcaaacacacaaaggagaaagggacacagatactaatctgaggagcagagcaggatggcagaatagaaggccccaccaatcataccccctgcaggaacaccaaattcaacaactatctacataataaaagcacctcataagaaccaaaaatcaggtgagcattcataataccaggttgaaacttcatatcactgaaagaggcactgaagagggtaggaaagacagtttgaattgccaatgccatccctcccccactaccctgcagtagccacatctctgcagcatggagaaatctgtacacttgggagagggagatcacagaaactgtgggactttgcattgaactcagtgctgccctagtcacagtggaaagcaaaactgggctgaactcagctgatgcccactcacaaagtgagcattcaggccagcttcagccagaggggaataacccatatcagcagtaggaacttgagttccagcaagctcgctgccatggggtgaagtgctctgggaccctcaataaccttgaaaggcagtctaggccacaaggactgcaaatcctagtgtggagttgggttcagagccagtggacttggggaacatgtgactttactgagacaccagccagggaagctaagggagtgcttgtgccacctctctcacaacccaggcaacacagcttgcagctccaaaagagacctcttccttccacttgaggaaaggagagggaagagtaaagatgacttttgtcttatatcttgggtaacaactcagccacagaaggataaaccaccaagcagagtcatgaggcccccattccaggctctagctcccatacggcatttctagacacaccttggaccacaagggaacctactgccttgaaggggaaaagcctatccaggtaggatccatcacttgctgactaaagagaccttgggccctgaataaccagctgtgatacccaggtagtatgccatgggccttgggtgaaactctgagatgtgatggcttcaagtgagacccaacacatttttcagctgtgatggctatggggagagactactgcttgagaaaagcagagggaaaagtaaaggggactttactgtcttccactttaggtactagctcagccacagtgggatagagcaccaagagggctcatgcggtccctgattccaggccttgcctctgggagggcatttctggacatgccctgggccagagggaaacctgttgccctggagggtgattcccaggcatggcaacattcaccacaagctgattaaagatcccttgggccttaagtgaatggaaggacagaagcctgtatggcttcaccttaccagtaaagaaacacatagactcaatgtaaaggaatggacaaaatatattccatgtaaatggaaaccaaaggtgaccaggaatagctgtacatatatcagataaagcagattttacatcaaaaatggttttttttttttgttttttgttttaaaaaggctgggcgcggtggctcaatgcctgtaatcctagcaccttgggaggccgaggcaggcagattacttgaggtcaggagttcgagaccaccctggccaatatggcaaaaccctgtctactaaaaatgcaaaaattagctgagcatgggggcttgtgcctgtagtcccagctacttgggaggctaaggccggagaattgcttgaacctgggaggcagaggttgcagtgagccgaaatcgcaccactgcactccagcctgggtgacagagagagactctgcctcaaaaaacaaaaacaaaaaacaaaacacaaacaaaaaaaagccaccccaaaaaacaaacagtaaaaaaacaaaacaaaacaaaaactggagaaagagaaaggaggtcattatatataattaattggtcaatccagcaagtggatataacaattctaaatatatatttacccaacactaaagcacccaggaccataaagccaatattactagatctaaagagagatatagactgcaatacaataatagtggggcattcaacaccccactctcagcattagacagatcacctagccagaaaatcaacaaagaaacattcgatttaaactgtaaattagtgggagctaaatgataagaacttatgaacgcaaagaaggaaacaacagacattggggtcagcttgagtgggaggatgggaagaggaagaggagccaaaaaaaaaaaaaaaacaaagcaaactattggctattgggcttaaaacctgggtgattaaataatatgtacaacaaacccctgcaacacgtgtttatctatgtaacaaaccttcacatgtacctccaaacctagaataaaagttaaaaaataatgaaaaagtctgtacattagactgaatggacctaacagacacttacagaagattctattccttaactgcaggatatatattcttttcatctacacatggaacattcttcaggatagaccacattttatgccacaaaacaagtatttaacaagtatttaaagggaattcttatatactgcgggtagaaatgtaaactagtacagtcactgtggaaaataccatggagatttctcaaaaaattaaaaatacaattaccatttcatccagcaatcctgctactgggtatctacccaaatgaaaagaaatcagtatatgaataagggatacttgcactcacatgtttattgcagcattattcacgatagaaaaatatggaatcaacctaagtgtccatcaacggatgaatggataaagaaaatgtggcatatatacacaatggaataatatttggtcataaaaaatgaaatcatgtcatttgcagcaacatggatgaaactgtaggtcattattttaagtgaaataaaccaggtttaaaggtaaatattgcatgttgttacttaaatgtgagagctaaaaaattcatcacatggcagtagaccatgaaaagacagataacagagactgaaagggtgaatttggagaagggggagggtgaagagaagtgggtaaaagggtacatacaattagaaggaataaattcagtgtttcatagtagagtagggtgactatagttaacagaaatgtattgtacctgggtacccaagcacttgggtacttgggacaccttaaataccattttgatccctacacattatatacatgtaacaaaattttacatgtaccccattaatttgtacaaaaaaatcaactgaccctcaatatatgggctacttttttggactctccattccattccattgatctttatgtctatccttatgtcagtaccacactgtcttttttattgtagctttgtactaagctttgaaatcgggaactgtgagttctctaactttgtccttttgtttcgagactgttttggttaatttggctcccttgtatttccatatgagttttaggttccacctgttaatttctgtaagaaaaaagcgagctaaaatctttataggggttcttttcaatctgtatatcaatttagggagtattgctacttcaatagtattatattccaagatatgaacatggattggctttcaatttctcagatatttaatttctttcaataatattttatagttttaagagtatgttttccatttatgctttgtacaatagaaataaaattgattcttctatcttgaccttgtatcctgcacccttgctgaatttgttagttgtaacagcttttgtgtgtctgtctgtctgtctgtgtgtaaattccttagtgttttttatgtacaagatcacatcatttataaatagagatagttttactttttcctttggggaagtgactatgagcagtgggttccccaagactatcccaggtaagatggtttatgaggtggactcacatgactcgaacatagttgaactcatggctaatattattacaacaaatatatttatatacatatgtgtcatatatatgtcggttataaaaagactggaatttattttttgaattttctttttctttttttatagttgtatgtgcttggctctaaggtacttaatatagggttttggacagaaaaatgaaaaacaatcaaatgtgatgatggcattcagatctaagatacctccagatttcagaaatgttaacatttgaatagaatagtacttagcatcttagaatagtattcaggacaagttttgtttggagttttataactgataagagagagccttcctcctacttttcctttctccttctccttcccacacattttgttgtatacgtgcttgtacaaaacctgagtcatagggaatcttcagtgaattgcctgaggttatatcaaaagttggtagctaattcactgtagaagccaccagttcttatatccctgccattctgttgtaggcgttgactgcctggacaacatctttgtgttaagtcagtgatgctgaatcagaggctttcaagaagcctgttttcctcctctgtcagcatgcaagatcctacactttctgcttctggtcttgctttctagctttaactagatcatcctatctctatactcaaaccatatcagtccctataaagtccctgattctttcacctactcctatattgatgccttgtttctttcacttgggatgacattctctgttcccctgtccatgtatttgaatcctaatcaattttgaaggctcagcttacatgtctcattatctattaaaccttcccttttctctcatcctcaatttagatgtaatcatttctcctctctccatgctttatattgcatatttctattctagcatgtactataccctgccttatattatggccagtagtttgtatatatttccatcttctcttaatttttatgctttgtgaggtgaggaactctgtttatattcccatgggccacagcacctagcagagaggagcaaatgagaatccagtggatatttgctgaattgaattacacaatggattggaaggcggctccagtaggtgttagcaggaaaaggatttaatatgaatcttggttttattctgttagcacagaattatgaatgccttttatattgtacctttactgcagaacaaagcactgcatagattgttttactgtagtccaatgggaattcattttgtgatggtttcagaattacccttttatttgtttcaccttttaaagcataacatttgtcaagacaacatttcagtttattgcatgtgctaagtcattactatttacagatggtatagagtatcgatgttcagattgaaaggaaaaaaatacacacatagaatcccatctgccttgcacaggatttaggactcaaacaaaacctaattttatctgtcctgcacatcagaagtagggaactttcaaagaaatcattgctaaaagtaagcatcattgttgagaatttcaggctgtaaaaataatggagtttctttcaaaagattgtttataaacattcttgatatagtttgggatgaaacccatcctggaagaaaatgggaggttatggagtcatatctagttagtaatttgcattagagctatttgggtataaccttctgagtacagattttagatgacctatctgaaggttagggaactagatagatgacatggtaaaagctttgctgaatctcctactagattctactttgcatctgaacagtgcctggcacctggcatttgttcagtatgagtctttcaaatgaataagagaagtttgaatgaatggtatgtatgaatggtatgaatgaatgaagtatgaaaggtagcctccctgaggctgttaacttatctgcaagataagtgttttaatatcaaccctggaggattgttgttaggaccagagaaactgcatataaagtgccttgtgtagtgcctggttgatactagttgctcagcaaatggtagcgattgttcatttactacactttctcagtctgttttcatattggtggtggcaatgagtttattgccatggaagagactatctttctggctgacatttccctttctatttttatttgtttgtgctctgtttttacctcttatttatttttaggaaaccatgtgagagtagaggcatttcctcttttaagtagtttatttgctatggctccgtagtgcttggatgacatggcacgtgtgtgcagcctggttcagaactcatatttttctattgtatatgaatagaaaccccagagaggttggataaatggacatgagagagcgtcgctgtgaaataaagttcaagtgttggaattattgctgttacactctgggatctgaagtaaaaaaatgttttctataaaatgggaaagcttatagataccaatttacttaatttttaagctatcattagccccatagaataactaataaacttagtatagtttaaattcctggaatggtgatatgtactcaaatcatgaaggcaaagactctcagagaaatagttttttttttaatttttaaattttttatttttttttttagacgaagtcttgctctgtcaccaggctggagtgcagtggcacgatctcacctcactgcaacctccgcctcccaggtttaagcaattctcctgccgggcctcccgagtagctgggactacaggcacgtgccaccacgcccagctaatttttgtatttttagcagcgacagggtttcaccatgttggccaggatagtctccatctcttgacctcgtgatccgcctgcctcggcctcccaaagtgctgggattacaggcgtgagccaccgcacccagccagaagtagttcttaaaagatcatttgaccgggcctggtggttcacatctgtaatcccaacactttgggaggtcaaggtgggaggatcacttgatcccagagttcgagaccagcctggacaacacagggagacacccccaccccgtctctacaaaaaatagaaaaattagctgggcatagtggtgtgcgcctgtagtcccagttacttgggaggctgaggttggagcatgggttgagcccaggagatgggaggttgcaatgagccaagattacaccactgcactccagcctgggcaacagagtgagaccttgtctcaaaaaaaaaaaaaaaaaaaaaaaaacacatctttttttagcagaggcttcactctgacagggtaggcttaaagaattttgaccctctatttgtaactactcataatgtatcttaaatttcaagtttcttgaactgttaccaaagaaagtttccttgttaataactgcttgtcaggaaatttttattttatatttgtgaacttaatttctgtgttgtcacataatgagacaataggatgttacatagattttctataatctttctggagcatttaacaacgtatctccatacactgatttccatgctgaaaataatttcacaaggaaatcattcattatggggaaaaaaaaaacccacattgcttaatccaatttaatttactgaaggaacaatattcacttaagtccccaatctcttccttcttatagaggactcttggacattgaagatgaacttttacatattcttaaggtaaaaaatataaacaaatcccaaaacaaatgaatatgactcagaattctattaatttcaaatttggaacataaaaactaagttcctcctgcctcccttactgacccctcccaaattcatgagtatatagattttttttgctttcttttcctagaatcacttactgttgctgagaatataccattaaatcttattctaaaagataatctattccagtcaactatatgcttgattttcctctcttttctttaccacagagcagcttggcctttgtttgaatgctattaatgataggaaagggattgtctatcttccatgaaagtcatttcatctacagacagttctgactttagaacaaagtgcttcttcatatggagtctttctagctctctctcttgctttctgtttgtcttctgtctctctctgagggtaaaaaccaaccaatgaacaaccaaccgaccaataaactgactgagcaaacctgatcaataggtttgagaaatactgcatacatagcccatacccaaggagtcacaatgtgtacatgtgtatttactaggaaatattgcagtgtgtttaacccctaatatttcacaaacttacttgattgtgaacttttactttttttcagaacatctgtccaaacacagcttagagcagaatctggcatatagtagacactcaataaatatttgtttaaaaagtgaatgaatgcaaaataaatctttaaaaactttaaagcacatgctgtattgagatgatccatgttctgcatttttacaagtgacacagccagactagagctactgattggatgcgtataccttccttctctatgtgagcctttctaaatcaattatttatttccacacattttagaactttaaaaattcatatttggatttctaagtttgtatcctcattggcacaactaccttttaaataataaaataaatattagtgatgtgtttgcttgactcttttgctttttgatcatatgtaggaatgaattaattggaaatgcttattttgacttttgatttcaatttgtatctgattgtgtttgattgtacaagcacatggattttcagcagaagtcttaaaatgaagatttgctccagtagggtgtttttaagggtgtttatcagattacctgttgagttacagccctttatttggcttctaagtcagctcctttttgggcttagcaacgagtccaatgtaaggagaatgaatcctttttatctgtgagtagttgagttttctacatgagacagcttgacaaccttcctatcaaacgtaaatctagtcaacaaggaacatgctgtaatgtggacttgatccaggtttggtgatctaggctttttatttctcatgctctaagtgaatgcatttaaaaggtcagcaataggaacagtataaattatttgttctcacttttatatttcaggaaaaaatccgtgtggaaattcgagagggtcagctacaaagctgggtgtaactcagtgtcacaactttatctaaagtcagtattttctgtttctctttgttctcagcaacaatcttacctcgtcccttgcagctgctcaattgataactgtgtgtcttctgttgtctttcctgtgttatcttcttccccttcagtctgtttccaacccagaacttgatcatttattaaagtagtaatattttctcttgtaaccgtgatttcatcctttctctttagtgtggaaatgttattttattggcacagttgtgggctacattttatgatagaaaacatcagtctgtttttacatctatggattttacatgttgttggatctcatagaatgtagggtaccttaaaaagcatttactggccgggtgcggtggctcacgcctgtaatcccagcactttgggaggccgaggcgggcggatcacgaggtcaggagatcgagaccatcctggctaacacggtgaaaccccgtctctactaaaaaacacaaaaaattagccaggtatggtggcaggcacctgtagtcccagctactcgggaggctgaggcaggagaatggtgtcaacccgggaggcagagcttgcagtgagccgagatcgcgccactgcacttcagcctgggtgacagagcgagactccgtctcaaaacaaaaacaaaaacaaaacaaacaaacaaaaaaaaacagcatttactgtattgccctcatttctaaagtgggagtaatgaccacagctaatattgtactgaatgtggaaaaattgaaggccttttgtccaagaactggagcaagacaaggatgcccacttttgccacttttattcagcacaacactggaagtcctggccagagaaactaggcaagagaaagaaataaggggcatccatactggaaagaaagaagccttattagttttgtttgtagatgacatgatcttgtacccggaaaaacctaaagactccatcaaaaaactgttagaactctatgagaacacttggacacaggaaggggaacatcacacacaggggtctgctgtgcggtggagggaagggggagtggggagggataacattaggagaaatacctaatgtaaataacgagttaatgggtgcagcacaccaacatggcacatgtatacatatgtaacaaacctgcacgttgtgcgcttgtaccctagaacttaaagtataataataataataaaaaactcttagaactgataaacaaattcagtaaaggtgcagaatacgaaatcaacgtacaaaagtcagtagcatttatatacaccaacagcaaacaatctgtaaaagaaatcaagaaagcaatctgatcacatttacaatagctacaaaaatataaaatacctaggaatcaatctaaccaaaaagtgaaagactataaaatttgatgaaagaaatagaagaggacacacaaaattggaaagatatttcatgatcatggattggaagaattaatattgttaaaatgacaattctacccacagaaatttacagattcgatgcaatctctatcaaattccagggcatgcttcagataaatagtaaaaaattctaataacgtatacagaaccacaaaagacctgaaatggccaaagcagtcctaaccaaaaagaacaaagctgcaggcattgtactaggtaacttcaaaacttgctacaaagctgtattgaccataacagcatgatactggcataaaacagacacatagaccaatggaacagaatagagaacccagatgtaaatccatacatttacagccaagtcatattcgacaaaagtgataagaatctacaatggggaaaggaaatattttcaataaatgatgctggaaaaactggataactgtatgtggaagaatgaaactagatccctatctctcaccatacacaaaaatcaaatcaaaatggattaaagaacttaaattgaagacctgaaactatgaaactactagatgaaaatgttggggaaactttccagaacattggtctgggcagagttttttgtgcaaaacctcaaaagcataggcaaccacagcaaaaatagacaaatgggatcacatcaagctaaaaagcttctgcatagcaaaggaaacaatcaacaaagtgaggagacaattcacagaatgaaagaaaatattcgcaaactatccatttgacaagggattagtaaccagaaaatataaggagctcaaacaactcaatagcaaaggacccaaataattcaatttataaaatgggcaaaagatctgaatagacatttctcaaaagaagacataacaatgaccaacaggtatatgaaaaaatgttcaacatcactaatcatcagaaaaatggaaatcaaaactacaatgacatatctcaccccagttaaaatggcttgtatcaaaaagacaggcaataacagatgctggtgagggtgtggggaaaggggaattcttgcacactgttggtgggaaagtaaactagtacagccactatgaagaacagtatggaggttttgcaaaaaacgaaaaatagaactaccatagaatccaacaattccactctgggtacatattcaaaagaaagaaagtcaatatattgaagagatatttacactcccatgtttattgcagcactatttacaatagccaaaatatggactcaatctaagtgccattcaacagatgaatggataaagaaaatatggtatatatacaccatggaatgttattcatacataaaacagaatgaaatcctcttatttgcagccaaatgaatggaaatggtggcaattatgttaaatgaagtaagccaaacacagaaacacaaatactgcttgttctcactaatatgtgagagctaaaaaaatggatctcatgaagatagagagtagattggtggttaccagaggctgggaagggtagaggggaggggatgaaggggaaaaaagaatgtaaatatatttattaccactgaactgtacacttaaaatggtaaattttgtatgcatattttaccttgataagaaatataaaataaaatggaggtaatgaggtgaggagtggggagtgacttgttgaaaattacagagcagctaagtggtcaagcccacactaggccctggtgctcccactcccagcccacagacttttattttgggtcctgaggcctctctcattacatgagtgcttaaattgtagagtaagtggacatagtttccatagctatgcaagagtctgagtggtatcagagaatcaagttgttcatattaatacttccagatctgccacctgacataaaatgcatcaattcgtctttgtacttgttcctactgatcaaagcaagggagaaatttgggtctcctattatgtaggaatatttttatgtctgatgctttctcatttaaaaagtagaacacattttaactattgccacttttgcaggctcctcaggggagaaagtgttcttgtatcttttgcattaccctcattctcacccttcttccatggctccatgcctgaaaatgtcaatatgtgacacatgtttgtagctgttataaacacattcttttatctgattaaacatctagcatggaaagaataactgcgagtgtaaatgtgcatgccttgatctgaaatatatcgagtctaaatatataaaattacaagacatttttaagaaatgactttatgtattgacaaattagatatttgtaatggcatgtatcttatgaaaataaacatcaattaaaattgctttatgtttctaatcatgtgtcgggggggtgtctataacagataacctattccactgtctattgtggaaccattgagaacttttttttttaattcccttgaggattgtcctttataaaccacatccatgtggtgtgatttgaggagcactgagaagggtaatgcatcatcagcctgacaccaccagagaccaggactttgaaggcactttgtgtcagagagcaggtgaaaaacatggcttcagtaagagatgtgaaaccacaggcattaaaaccgacaagccaaaatagcctagtttgatgacccgttttcttttaaaaagttttccttgttcatggaccagaggcaggtagtgtactttgatttttggcccctatagagttcactagaattgaacattgtaagttaacacttaagatctgggacaatcaaagcacattgaacaatgcatggacattgttccatctgtaatgataaaaaatgagttaatatgctactttttattgaacacttaccattatgccaggtatttcacatttagtttgcatggtaccttgtgaggtagatatcattatgcccagtttatagctgaggaaactaaggtttagagaggctaactaacttgcccgcgtttgcatggccagtaaatgcaacaagctggatttgaatccacgtctatctagactaagaagcctatatggttaaccacttgtaaaatgggataacagtacctaccttagagattttttaaggattcaataagattaaaaaatccaaaaagcactttgtaattgctaataaagctttgtagagtgaaaggcattatcagaagtagaagacaatctgctacagtgtctccccatgaccatctacccttcaaataaatccgaatgtcctggagtttgtgcctttgtccttggctttctggtgagtgagagtagtttatgttttgggcatagattctgagaagtaggtcactggttctacttattcagtgatattttcgagtgtgatttctttgccatgtagttgagaggaggaaagagatcgacagtgtctgtggacacagacctgtggggctcccagaataattttagacacagtgagaaatcatgtgtctaaaatcatgtaaggctgtaccttaacatgtatgtcatttcttctattttcgtttgtcatagaaaccgatctgctcctccgtataaaggacatcagtcatttcttaatgcaagacatcgccttcttgtctggtaagcaaactttcttatatatagtccagatagatatatgacttgattagcagttagtttggtacctattatataaatagctcgctctctatatatagagctattatatatattcatttgagaagcactatttcaataaacatttgtacattgtgcacctagttgctaaacaaatggacatttagagaataattggaggttttaagcattttagatatatgagtaaaaccgaccttaccactcttatacatttgactttcagacgagtcttcagaaatctatgatagttgaaagtagaatatgtctcctaggtggttgcaggctgggtgggaggggagcagctgaggtagcttctttgattactcaaatgtgtattacaaatggtggcaagttgcactaaataatcagcatgcactaagtatttttttttaggatttcatttacacattataaagaaagttgatttttctcaaagatgtatatacacttgtatataatttttagtaattatggtaaaataaatttaacatacaacttatcattttaaccattttgaagagtacagttcagcggcattaagtacgtttacatttttgtgccaccattgccaccaccatctccggagtttcaggtcttgcaaaattgaaactctatatccattaaacaattactccccgtttcattccttcctctctctagcccctgtcaaccgcaattttactttctttctctatgaatttgactatcttaggtacctgatgtaaatgaatcataaggtatgtgtctttttgtgactggcttatttcacttagcataaggtcttcaagtttcatcgatgttgtagcatgtgtcagaacttcctttttaaggctgaataataatccattttatgtatattccacactttgtttatctgttcatccattgatagatactttggttgcttctaccgtttggctattgtgaataatgccgctaaatagcattacccatttttagagacgtaactatggtaaaccatcctgcccctttagcttctggtcagactttggggaaagttttgcttaaaaacaagcaaattactttcaggtattagagtaatttgaattatatcattaaatattacatttagcatattaaacagataaagaaaacttactggtatatattaatacattgtttttataaagacgaatgcttcttaggagtacaagaaactatcttattccttctaaatagtttaattaattctctgaaaaatggcactcacatgctcagtttactaaacaagcttttactttataagtgatcctaattagacacttcaatctggcctctgcttttattatcattattattatttttaaagacaacttcttgctcttttgtccaggctccagtacagtggtacgatcatagctcaatgtaaccttaaactccttggttcaagtgatccttccacctcagcctcctgagtcactggaactataggagtgtgccaccacgcctagctaatttttatatttttgtagcaaaagggttttgctatgttgcctaggctggtcttgaactcctggcctcaagcgatcctcctatcctggcttctcaaagtgctgtgattacaggcatgagccgtcgcacccagcctggcctctgcttttaaatgattataattatacctatgataaagcttaattaaaaatgattctaattagtggtaactgtgaattaatgatgacttaattaatatggctttatgttttattttataagtggcagaaatgtgtgagtgtcagtaaatttagcagtatgttacgttcacttttaagttttggagattttacttaagattatctgtgttttccaaaccgtgttctaaatagaaccatcctcagggcttgctgcacccatccagacccctctctacacctttccttccttaactgctttttgtatttgttttaaaaatgcttctacctatagcttcctttgaagaaagggttcccaatggtaaaaaataattaaaacttcctgatttggaatgtaaatatctcttttgatctcttctcataaagtttactcgtaggacagtacttgtaggtgttcagtggtaataatcatttatagattagtcaatgataatttactcttataggagccttgccacctttcctttgataagtgtagtttgcctaagtgctagatggttctgtccttaactagagtgctcaccagcttgcttggcaagtatgtagttatatttaagatatttattacattatatattacatatcatttatattactagttctataccatactgtatctatagaggccctttgcttaaagattcactaaatctcttggttcagaattgtacagtttctcctttgagttttttaaaaactcttcagtggatgccattattctcagtgattattttcactctactctaattctggaatatcatacagtgaagattaataaccctttgatttaatactttggactagtttgattaaaaaataatttgggaatgaatactgtctctcaagtttcccttggtaaatattgaggcaaataattaatttgatctttttccatgtgcactagagaagaaagtgtattctgcttttgttggatggagtgttctagaaatgtcaattaggtcatgttggttgagactgttgttcaggtatacaatatccttgcaaattctttgtctacttgttctatcaattattgagagatgggtggtgaaatatctgactaaaattgtgaatttgtctatttcctcttgccactctatcagtttttgctttgtgtattttgaagctctgttattaggtgcataagcatttaagattatgtcccattgatgaatcgaccactttatcatgatcaaatgatcattttaatatctggtaatattttcgactctgaaatctactttgtcaaatattagacagctttgttttgattagcactgtcatggtatatctttttctatcctttgcttttaataatttgtacttttatatttaaaatgtgtgtttcttgtgggcagcatataattcagtctttctttttatccagtttgatgatctttgacttttaattgcagtgcctagatcattgacattttatgtgattattcatatggatggatttaaatctaccatcttactatcatataataagcaaaatacaaatagtgagatggtagcttttcccatttgtcccatgtgttctttgttttcctccatttctgtcttcttttgcgttgagtattgttgtgattccattttatatccttttctttttctttctttttggggggggcgtggagagacggggtcttgctctgttgtccaggctggagtgtagtggcatgatcttggctcaccgcaacctttgcctcccaggttcaagcgattctcctgcctcaacctccggagtagctgggattacaggcgtgcaccaccacacccggctaatttttgtatttttggtagagacagggtttcaacatgttggccaggctggtcttgtactcctgacctcaagtgatcctctggcttcggcctcccaaagtgctggggttacaggcatgaaccactgtgcccggcctgtatccttttctattgtcatatttttattgcagattgaattaaaaatatttttacatctttattcacttaaattcagccaaataaaaattacaactgaactaaaaaaatttctattgctgagctaatttcaaaggccaccttgcaactttcctcctaaaataattcttcagattctatttggcacttagtatttattgagcattcgctctctgtgtaggtgctaggctggctgcagatgtgaaccttaaacacatgtaaggctcatctctgcacttaagtggctttcgttttcaatatttctcatccttcaggctgcatagagggctattgggctgggtggagaaacgggtagaaaccaaaatgaaagcccagagctggtgcaatcattccctcaccaagaacccctatgacagttaccattattcctggttcctatggaaatgggcttagggcagcctcacctatgagcactgggatccatgctttccaggagtcaaggtcacccacttggtcaagatactgctggatgcaactgctccaggttaatggctgcatgggtctgcggggagcttccacaaccctacacctctgcctggacccctacccaggctgaacattgaattttgacccacagataatttgtgatctttctttgcattaataaaattcctatgtcattcctgccatcattccttttgttgtttcttccataaacacattagaccatcacctatttcctatagggtgctctgtatcttttcctgctcaccatgacactaagagatcgattatatcaaattttccacttgctgtcaagccatcattcactcattttaaatttaggctcattggtatagaaacagttatttcccaaccccttggttgtccagattggggaatcagctattttccactgtatttattatatgcatttcatgacattttcttctgactatattcattcattttactctctttctttttctttttttattgagaaactactctgccaccttttaaacttaaagtgtcaggaacttggagccattttggttttatgtggagatcatcatctttgcaaaaaagttgtgttgctgcaaaacagtattcaaatctaaaatcctcttcttgcttcgttgttatatacatttttaattcagttgattatttttctattgttgtaggtggccggggaaaggacaatgcttggatcattacgtttccagaaaactgtaattttagatgtataccagaggaagtaatagcaaaagtacttacttacctgacatctattgcaaggtatagtatttcattacatttttttcaattcgctttatatcagatatccatctgaatgtcataacatgaaaatggcttaatatagctattattatcatggtgaataaccaactgacttaacttcagagtagataagaagtacaacttagaaggagaagctggcagctacctaaattgttacaaaaattatcctgagaatctatgaaaataaaattggggatctaggagtatttgttcccatcaaaaagaacataggttgagaacgatggtcatacatatatgctttaatttgcttaaaaggaaatattaccagccaagagtgagtacagccatttttcatttcttctgaatataacacaagaagactgaatcttaagtagattcaatagtggtactgggagatactaggaggaatgtcttgaaattaaaaattatttggaactagaatgctttaaaatggaaagtttaaaaaggtttcttagagattttatgtgtgttaaagacaaaattttcaaaggaagaattttctagttactaaccctgaagaacaagaggacacaaatctaggatgataaaattcaaagtctcatgaacaaaaatcaaatctcagaaaatgaaacttacaatgtacctattgaagcttgaaagtgatatttttagggcaaatagaagttatattttccattaaactgcatttcctcaggagcagactagagttagaaaaatagatttagcagtgtgattttgaatgagtgaatggatcattgactcatgatggattgcatggaaagttaaatctgatatcatgaaggacacttatcttttgagttttcccacacccaagattacagtattctaaatcaattttagtgacctatcttcattacactatcactttcctatttaaaagattgacattaatgctgcaaaagaaattttaaatagtgagtaagggaatatgtattcagattagttttctaagataggactttgtgatagctttccaattccaaatctgtcttcagtcaagacatcaaatgtagatgaaataatcagaaatagaatgaaggcatatataacaaatttgcattattattaagaaaaagttcttatttcttcttatcgttcaggcaaaatggatcagactcccggtttaccattattctggatcgaagattggatacatggtcttctctcaaaatctctctccaaaaaatctcggtaagtatctatgcattatacagtaactttttatttttgttttatattatactttctgttttgggaggtatagattactttggtactgacggagacaataaaaattgatggaatgtgaggagggaaagtagaaggagaggttgtagcagagactgagataaataactctacccaaaataaaacctagtaagaatgagtgagtagtttgtggctccagttatgagtgagaagagattcatggttctatgtgcctttcaggacaaggcaagtttttatggaagctttttaaaattatttatttatttatttattttggtggaaatagctgtgttgcatactcgtatgtgaaaaagtataaagaagaaagtttaaaacaatagtaatccaaccaccccaaaataagcagtttttaacatttcagtgtacaactttctagatttgttttaccctaggatagggtagggagatgagtcacatataaaatgatatataacttccctactggtatctagtccccaggttcccaagacccagagagagaaacattttctctaattaaaataacgagaggtacaattctgcccatgaccaagataatcttttacacttttaggctcacaagggtatcacaaaattgtttgacacttcactttcatagacgaggagggagatgagggacccccagactccttctgagctggcaagatatgggctctctgtggaagtgccatgtggccaacttcctctatcagactagaatagctgggaatcaatatattttttttctttgagattccaacattgccagccatctgaaattcttactttgtctcctgactgattgaggaggtcacgcccaccacaagaacttgatttagttgcaaaggcaaaacaaaaatctaggttgttggacttccaagccaatgttctagcacttgcaaggtaaaatgggtaagatcattattcttttaatactcagaatgaattattcctcactttggacaaataagcaaaaagtggtttcctgtttatttaacagaggtgtttaatcattagcagtggagagaagagttaacattagatatactcaaattactaaaataaaatagaagaaaatttgactttctatagcatattagtgctttttcaaaagcattcacatttattaagtattgttgattctcttcatttcctgattaagtactgcaagtaggtatcactataattgtcttatagatgatgaaatcacattgatatttatactttggaatggctatgtgatgaatccaagctcaaatagccaagtaaccaaaaaagccagagcaagaattgaaatgtcaagaattccagttggtgatggtttctatcattttccaattggcttacaaatagacaaatacattcaatgttatttagataaaggtaaaatttcttttgagagattagatctgtcctccatatacaattgagccttatcagtggggctaaataaagtaaaagctatttcccttgctccggtcttttaggattggtccttgggcttgctgagtagaccttggtttatgctaataattgcttctcttatactaaataaagcacttgttacattagaacattttttatcacccaggtttttttcttttggccaacactgcacccgcctgattaaattaattttcattttgtgactggtttggcacctgacgttagtttttttggtagagttttatttttattattcaaaataggtggcttgtaacagaggttctatttttcataaaagagaaatataagattaggtcatgatcctgtcattttgaagtcaacagagggtaattacttgtctaccggggagtgatactcctctttctgtattcccagggctgctttctcagtggagaattttgacctatgctcagtaaagaacttggatcccagggtccctttattttcataactgccaaattgatcgtgctgggcaagggaggggtacagattctgaccacatgtaactggctataggttgttttaggtgtttcttttttaacatgttaaatgtttttgcttgtggtatagtttctatactcatactcaagagcacattaattacatctcaaccattagtaactgttggttactgtttgaaataaaggtaaatattgaatgcaagctaatttcaagtgcaaaagttggcattcagaaaggatttctagtgaaatctaccattgtgtagctaggtataattgcctgtggtgtattatttcaaacaagtgtctgtgaaataatcatacaattcaatttgaatacctttatttgtagatttcaaaacaaataaaagcatttaggttgtatttcataattaatgagaggagactttattttagttatacattttggggaaaggttaatttgggagagaattgtatccgtcttagaaagtttgcatgttctattctttctagattattaccaggacaaaattttgcaaactatagcctttcacaaggcttaaacccagaatacaataacagagaaaacaaaacagaattgaaatttaagtcacataccagggtaggacgagagtaaaaagcatgagttaatactaccttcacaaagattcttagcattccaccttaaaaatcaaactgcgcagaggagaaagccagtcccatcaagcctgctcctaggaagagagctggtttttttttcctcctccttccactcttaggacatgcctgatcttcttgagcagtccagcacaagctaatccacaaggttcaatcaggctaagtaattggaggaatgtgttaactctgaattacaaggagcagaagggaaggatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggtaagggctctgtctgcactcctggaaagcctgttcccaagttcaagtgctgggatgctgcagcatggtgctatagcacaaactgctgagtagggtttttaaggacagatggagagaatggagacttatatttgcatggattgcattgatgtgattactgtgatattgacatagggtaattttcaggcaattgagggggtagaatataatttcaaaatctaaatgtcatcaggtttatgaatgagcaccttagtcatgttattcgtttaagactgtatgaacaattttgaatcattggacagcatagctttaaataatgacttaaaacaatatctaacaaaaggattcatcctttctttcaccatgatcaagtagagtatattgccatggataggtctggaggggattccatcatcacttaaaaatgcagcctttcctgggtgttaccgtataagtgaataaatttaaaatctgtaatgatttgaaatccttatggtttcaattcttctccaaactgaaacttcgtaggtacaaaattgtcacctgctgacaacttttttcttttagggaaaaagacagtaactcacttttcaatatagactagaatttggaagtctctcctctcaggtacatttcatgcagtcttttgcctaaattttcccttcattcatttattcatatagtaaattcccagcaaatttctaatgtgatctttagatgtattttggagaaatgttgaaataacactagctaatttaataaaaaactaatcatcaaaaaggctttaaatgccactctttttctttcaaagattaatataatgttattgatgttatggtttaaaatataaacttgctcactaaaaatatcgagataacacacacacacagataagaaggtaaaaattgaccataggaaaaaaatgacagtttgaattaaaattatgataaggaaagtaagacttttattattgttgaatgacagtgaacatcaataggtgtgtaaatgatttattttctaataaagctcttagcacagactgctattttaaaaactatagttggctttattttgacaaaattatatctttggctctatacatgtttttatattatgagaatatagattcagacttttaacagacgatttatggtgcacaagaaatgtttgtgtatgtactttgcagtattgtaggcaactgatattagcacttttgttatcaaaggttaacttaagctttcagaaagttcctaattatatatatacatatatttatatatatatttatatatatatatattctcagtgctgaacttagttttatgtctatacacatgcattaatatacacacaataaatacagcacaggggtactcactgaatagacatatctagcactgtgatatatacaacataagttacaaaggtaaatatggaatggctactgggctgaaggaactctcaatctaatagaaagggtaagacatgttcgtaaatgactattttgaaaagaaattctggctggtggagaaggccttatacaggagatggcatatgtttgggtgttaagtaagagtatatgttgctgttacctttccttgattctttcctgtgtttttttttctcataaatgaattaagtgatatgtaggaacagatatgagtgggattaattggattaattctgaagcctagaactatagtagaagacacatatgctttccttatatggataggacttgaccagagtaaagaatttgaaccttagctagtaaaaaaatggtttcaccttgaagggtctctggaattgggctgattctggaggctgtggacaggtaacatctaaaaggatggtccaatgccacttgaagtccaaaaaaatgtttgaactagttacttggtagaaatttcaatgactgtagctgagtgagagagaggggaggagaatagatatatatgtgacgaaaagggcaaaccacaaggaaggagtattgctttgggctatcctcctgacgtcacttgacaagttgcttgacaactcatactgtctgtactttttaaggtggggatatggggggaagagtgtggaagtggctcatactgttgcaaactattctctatagcttgaggtcatgagatttttttcccaacatattctgcagagatggttcagaccttatgaaagtcaagtgcctgtcagcatctcaacatttgtctgacagtaaattatgatactttccttttggtggactgtatatgctaaattgtttccagcaacttgtttcaaatgttatttgtcccattttggaaacatcaaggtcaaatcatccctgaatggcaaacagtaaatccgagtgtgcattcagtctatgaggtgttaagtgtctagaaagagtttgcccttaggatccagataggccgtactaccgctgcttaccaactgtgcttcagtttgctcctctgtaaaaagggaataatatccagtttactgcaatgttttgaaggctaaataagataatatatatataagaagtctgacacatacataatggcttttagtcaagggtctctcttattgttactgcctttctttaccctaaagattaaataggaaaagctataggaaaataaattatttttatagtaagtaaccaaacttttatgttttataagttactttaaacattctagaaataataactagaataactgaaaagtgtgcatagggtgatgaattgcctcccttagagagcacacacaagagtattaaacaaggttaatttctagacttcggtagtgaaatgatgtatttggtttacgcctgctcttgttgttattgttgttgttactgctgtaagatcatagaactaggcaatctggaagtacgtgtgagtaaaagggagtaaatctgttctctgggagggaaagatgagagggagcttattttgtgctcgttaccttgaagagcctgtaagagctgctgctgagggctggggtgggaccacgtacagtgattggacacatggctccgagtcctatgtgataggcagctggttcgcttttactgagatgtctttaagcagtcacatgctggaactccagaaaaatgtctgcgagaacctaaaaccaatgctgtttcctctctcgtgcaaactatttttttaaaaaagcaaaaacacattgaaataaaacaagactaacctttgcccaaatccctttgcttttttgacaagttctcaaaaatgaattatactttcaaaatctcagtttttattttggggaaaaagaaattgtgctttttcatgtttatataaccatacagattagaggttcttaaagcagcatacccaagaatttagaaatataatattcccaaaccaaaatgggaaagttcactggtcttgaactatatttgctttgatatgtgcatctgataccctatgctgtttgattgttcatttaaatactagctttaaaatggattatcttgagaattttagttgttacaaatattggtatatagagaaaaagtactctctatatatacttatatgtatatcaacatagatacatacaaactaatcttaaatgtatatggcttgtcaggttaaaattgctcaagagtgttctgtcccctctagattctcatagccggcaatcacagataaggacgtgtccatattattgatattgattgatgttcagatctatgaagctttttggttcagaggttgcaaattgtcagtgcacagatgcgttttgtttagagtatgcagcattttaacaaactttcaatttgttttccatctttaaacatctgggctttgcatgacaatctggatttctgtcttctcttgagaaaccaaagagttggcaatgctgggcccaccttgccacatgacaacatgtagctggaactgatttatgagtgaactgacttatgagtgccctctgctttgaatgttctccagttcaccatggtccccaccacttcctgttgctcctcgtcatataggaggagtatgaattgctattttccacctaatttaggctgttctttaattaagcctacttcacatttacattatctccctaacacatggtaggcattcaagtttgtcacctctgctttaggtctcaggtttagattctcaaccaacctgattcttgtgtcatccctgctataacttctgcaaattcctcttgttgactgagtctagttcaacaggcaggtgaagcggggttttaattctgctacttatgtgctagaaggtcttgaaaaattgcctgacctcacaaaacctcaatgtgttagttccctattgctgctgtaatagattactacaaacttagtggcttaaaacagtgaaaatgtatcattacggttctggaggtcagaagtccaagattacccaactgggctaaaaatcaagggtcagcagagctgtgttccttctggagtctctagagaagaatctgtttctttgacttttctagcttgcagagatcgtccacattccttggtttatacccctgcatcactttgacctctgccatcacatcttcttctctgactctcctgcctccctcttatcctaatgattacatcggtcccaccatgataatcccggataatctccccatatcaagatccttaatcacatttataaagtctcttttaccatataagataacatattaccaggttccagggattaggatgtagacatctttgaggataatggcactcagtttctccagttgtgaaatgaggacaaaaatagaacctactgcatgtaaatacttagcacaatgtcataatagtgctctttatgggcataattctagtagtatgcattcaataaatgacatttccacccctgtccaactctccaatctcctttccctaccttaaagctttgagaggtcctgaatatataaatatacataaatatacgtattttttttgctaaagagaagctatgaaaagtagtcataaatgtcatactttaaaagtgtgacagtttggtaggcacctgttatggtctgggttaagtgaatgggagtgggattaaaaattcaggtatgtcttattcacgtgtgggcacgagggatgaaaacaacacacctggtctaaactatatgatttagttttctagaaaaataactgacaaatcagatgaattgtttgagtgccacctgattgctctgattgcttagtagttgtgtagctattgcctacaagttatttagtctcccaaatggctactaaaattgggagtaactattgggttaacagaatccatgtgctctaggaagatatgcaaaaaagattataaaattgtactataaactataacaaaaaatattgtaaatgttattatgtagtcaataaatgaagttttcatcctttgatggtgcattttctttaaaagcccaagtttttctgggctttttgtgacaagtgaattactaaacattttgaaggaattaaggaatgagaaggtatgctaagataatcagaaggttttacttaagaatgaactgattagcatatagaattatctttagaagcaacttatatagccgtcaatgtttgggataatccactttattaaatagagcaataacaggtttaataaacatccaacataaaatccctagcttatgagcagctgaatacccctacccctgcttaaaatcacttccccactcatcttgcagacggtgattttccttctctctcctttctttctactttgttccctgctatgtgatcagctgtctctggacctggctgctggtacagccttgctctcctaggaatggcagagtagagagcagggccttacctcaggcagagagttgctacatagctctctctattcccatagtatcctcccatcccctcctccctcacacataattttggagatgggtgagtacccctggcttgaagtcagccccaggttcttgtatccagataattctagatacaagagaatatgagattaagggaagtcagagagagaaagatgaaaccagatcaacttagaatccatgaaagaataaaagtaattttgctttaaatgttggcaaaagtagggtgctttcaatttcatttaaaagtgaaaaaataaacaggttcaaggcaggtgagtataataatataatgggaatttacccaggtgaagaaaaaggaaaggcttaactcctaaaattaagggagtaaaaatagaatctgtgctttccacttaaaaataggccaaaagttcccacaagtccctgtcagattcttcccttaagctagcctttatccatatccctaaagttttctacccaaacctgcttgttctgacgtccgagaatccaaggcaaaattttaaaactatcttattaatattttttacagtttaaaaagtgccttttcatgtccttggcccactttttaatggggttgtttgtttttctcttgtaaatttgtttaagttccttaaatactgcatgttctcacttataagtgggagctaaataagaagttatgaacacaaagaaggaaacaacagacacgggtctacttgagggtggagggtgggaggagggagaggagcagaaaagatcactattgggtactgagcttaatacctaggtgaaggaataatatgtacaacaacccccactgtgacacgtgtttgtctctgtaacctttgcatatacccccaaacctaaaataaaaattttagaagtgcctttatattcattatttcttttaattcctgtaataactggaaaacatatatatatattttttttcggcagagtctcaccctgttgcccaggctggagtgcagtggcataatctcagatcaccacagcctccacctcctgggttcaagtgattctcatgcttcagcctccccaggagcggggaccacaggcgtgtgccaacacacccggctaattttttgtatttttagtagaaacgggttttcaccatgttggccaggctggtctcgaactcctggcctcaaataatcctcccacctcagcttcccaaagtgctgggattacaggtgtgagccaccgtgtccagctggaaaatacatattatacttaacataaaataaaatatacattacgtacataatagaaggtaggatatacattaccgttggaactctctgtttctctgtctctctctgtttctgtatacatgttaactttattcttttcaatgtttccccagcagcagggctcttggcaatctgctgcttttgaatggcatcctcaaagtttccttcactcagtattcgtttgaaaattctagggcaggacttctttggccctgcttacatcaaatgttcatacttatgttttttctttttcttttttaaaaagatgaggtctcgctctgtcgccatcatggctcactgcaggctcaacttcctgggctcaagtgatcctcccgcctcagcctcctgagtaactggaaccataggcgcatgccaccatgactggataatttttaaattttttgtagagatggggtctcactatgttgtccaagctgttctggaactcctggcctcaagtgatcctccatcctcggtctcctagcctgttgggattacaggcatgaatcaccatgtctggccctaatcatacttctaatcactattaatcattgtgtgttggaagggcagggccgtgtaggaaaataagagttctcatttggaaccaatgtgtagaataatagaagggggagtcgtttctcagatgaagggagagagtaacagtcatggcctcctgggggaattatgagttggacagccatcccaatttatgtatattgataatcattgtttaatttattgatttaattttatgctcttttaatttacttatttgtgcttatcacactcatttctctttcatttactctagttctcattgccacttaacattttatgttttatcaccatctcaaattgaattaggaaaatccccagttttgagcatcatttcccaaagagtctatgttttataccctggtggaagttacttttttcttttattttaaaatagactttatttttttagagcagttttaagttcacaacaaaatttaacaggaagtacagagagttcccataaactccttgccccacagtatcttattcttagtttatagttttgtttaattactagtattgtaatatgcctgaaatataattgcagttggaacatttttcatatattttgctctattatgctctaatctgccatcttgaggctgatggctcctgattctccacttttagcctagacttctttcccttcttaattgtacaaacagctatccgaaggacatcatctggatgtcctgctgacccttccaacctaacgtgtatatgaatggagatcagaatcttgtttcccttcttaaaacctgtttctcttgtgtttcccatctcagtgaaggttgtactattcaaccagttactcaagccccaaatctggagtttgatcctcctagtacctcctttctcggcaagtacatcaagtagttatgtcttgctgattgtgcctcctaaattctactcttattcctggtatcattactttagttcagaaactcatcattcctggcttggattactgtaccagcctcctagctcatctgtctgcttctactcttgttcaaatccagttcttcccaaagccaaagtgatctttctaaaatgcaaatttgaccatgttgttctgatgctcaaaaccttttagagactccccttacctccaggaaaaaaaaacccatgatcctttctgatgtggttctggcccgttttcccaacaccatctcccattgtcccccagtgtcatttcatctagctctcttgactagggccttttcaggaggtggagtagtttagtgattaagagcacagacttaggggcaaatgaaggctttgccagctgggggaaggtatccttaaactctctgagtctcactttctttatttgtaaaagtgagtaacctaactccttcatagaattattatgaaaagaatttatgataatattggcaaaatgctttgcacagagtaagcatttagtacgtggtgatttgttattaaaattgggatatgttactccgttctccacttattttgcaatgtgtcctccttctttgtcttttgaattctttagtgtagcagttatttttgactgcatactatgtgccagcaagttctagacgctggggaaacattggtgaactagaacaacattctgatccagttaactcctcgttatgcttcaagatctttttgaccttcctatgtctcggagagtttgtgctatcatttccccttgtatattattctaattcctttgattacttatcaatttagttaaagaattgctgattagtaatggactctgcagttgaactgttgggtagagattgtgttttcttaatttgtgaacattcaatgcctaacagagcttgatattcatttaaatacatgaagtagacacatagaagatgttcagtaaatattgattggattaaaataaaaatataatcccataataaagttttctttcattgtttagtgtaaatacacagacaaaaaccctttgacttttagggttatcctaggaaactgccacctaattctatttgtttttataggaaataagtgcaatttgagttcaaataactctaaaataagatttagagtctatttcttcataaggttggatctacttctttagtgtgagaaaatttcgtaccagaagtgttgcaaggatctgacctggagccttacattatttttctatttgcatgtttttagattttatcaatatccatttgtaaagtgttggccttttactggcttttatgaatttaaaatttgtttccttcagttacatattttctgatatgtgctcagttgagtgtgtgttgacaattttttttccaatttcttttgttctttctttctacaggcttccttccctgggaacttgcacttggttttggttttacgtcctaccagctttcttcaacgaacgttcacagacattggattttggtttagtcaggaggattttatgcttaaattaccagtaagagtatattatttaaatgttttgttcctctaattctcatgaagacctgtaccatgctgtttatattttacatgtgcccatgtgtcatttaaaagaaaaaaattaaaatgtcttttaaaagtatacatttgaaatgcccaaaagtctttcacttctaccatttgaaaaagaaatcgattcatcaatttataacaaagcaattacttttgcaaaaaatatatgtcatatatgttatatatatgtgtatatatgtatgtgtgcatgtgtgtatatgtatgtgcgtgtatgtgtatataagcaggaaattttatttttagtaaaattgagtgtatgttttatgtatttgaactcccgtgaacttacatcctgagctagtccagagtaccatgactttttaaaaatatttttgtttgtttttaaggttaggaatagggtgctcataaattttgatacttttgaaaaggtcagcccctcctgataaattataacttactacataaagtccttttctttgttgtgagcatagcattcttttagaagctggaccattaacaatgcaaacttttagatggaggaaaattaggcgttttggtttctgtggagattgatttagctttacagaaaatgttttgtaaatagaaactgttattatctgaagaaggtagcgcatacatgtatgggggcatgtacaggagagaactgttaaaaccatttatcagaggtaactttctgctaaatgtatgccaaagttcattttacagtttaatggagggatggcatgaagggcagttaacagtatcttttttgcttatttatataggttgttatgctgagctcagttagtgatttgctgacatacattgatgacaagcaattaacccctgagttaggcggcaccttgcagtactgccacagtgaatggatcatcttcagaaatgtatgttgtctttgcccttactgtagagcctatagttcttcatgttagcctttaaatctagttctagaattctttcctatttgaaaaaaacaaaacaaaacaaaacaaaaaaaccccagctttctgggccctcatttttcacatacatataaattcaacatcttggttttcttccataggcaatatctagaaatgatgagcagtcactgaggatggcaattgaaggagaatcctagggaataaggagatcatactctgcccatcccctcctgtggctatatagtaacttgaagaaatgaagggtttggattcaaatcctggccctgctgatttttagttatatgaccttggtcaatatacataacctctctgagtcttagttttcctaactgcaaaatgggactaataataccttacctcacagggatcttaaaaagactaaatgagatagcaaaagtaaaatgttttacacagtgcctagcatatggcaaaccgtcaataagtgcaaatagtattattaatctcattattctagtgatgcttctgaggcatttaaatttgtagcaaagactgtacttctgttttagaaatttacaaataggcaagggccctgcacctcccaagtatgtctgtggtatatgagtatcttgacttctaatcccagagataggggaacccttctgaagaaattaatgatgtcccattaaattaggattccattttcctcatacttgttcttcactcaacatttcattcattaattcatttaacaatgcattcattcaacaattcattcattcacatgaagatgtattgccaaaattagcaatgcctagcctttaataacctgtaatgctataaataaacaagcaaatattttgatatgcatggttaacagatggtcatatggtctctacattttgcccttctttctcagagtaattgattttagaaacaaaagaaacaacaaaaccgtacttaccattttatggcaacaaaggctttggggccaccattccaaatattctatagtacctgaaatgagttgttgtgactagtttttcccccgtttccttcaattatcaccttgtttggaatgctaatgcttattcacaaatgataataaacaaatataaagtgactttactgttctcatctctcttcagaagtaaggttattataaggcaattttgccaattggagagtttatagaataaggaaaatactgtaattttcaagaaaataaaacaaactactcaatacatggcatctttaagaaatagttttcattagtgtccaagaaataagtcaagaaatttggataaaagatattcaggaagactcttaatcttccttcagtttcttagagttttagatgaagagttacagttgattgccaagagcaatgccatatttctctagcagaggagagttcatagtatatgtgtttgccgttatacccccaataaaaacaaatacacttactgatccagtttttgatatgctcacagagtgaccatataattaaagtaatcaccggctctttgcaggctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaaggtatgtctgatagagttgacaaacaaaagatttccatggtctttatctagagaggtgtttattatctccattttacactgactgttgcataaggggagataaaagacatttatgtaatatatttaaaaactaaaaaaaattatactttataagagaagactgtcctggatatgttagacctaagtgtcccctccgtaaatggtgcattaatttgagaagttatttaaaaacatcttataaatgctgcagaaaaagaaatatagtcttttgttttactatgtgcggtcatgtactgcataaggttgttgtgatcaatgatgaaccacatatatgacagtagtcccatatgattgtaccatatttttactgtaccttttctatgtttagacatgtttagatacacaaacgtataccgttgtgttacaactgcctacagtatgcctacaactgcctacagtatacagtacagtaacatgctgtacaggtttgtagcttaggagcaataggctataccctgtagcctaggtgtccagtaggctatccatctaggtttttgtaaatgcactctgtgatgttcacaaaatgatgaaattgcctaacaatgcatttctcggaacatatccccaacattaagtgatgcatggctgtattttttatttttgaggaggagtcaggaggccgagtttctagtcccatctctgctgtgagctagcattgtgaccaaggctaacattgctcaattgattgtaagttctcttctctgcagaatactaggtcttgatgtttcctacagtagaccaggggttgcaaattgtttgtgctctcctatccaggtctttgtggagtgttgttttgtgaaggattctgaagtgcaattcagataatcagcaagtattttttggatccactttcttcagaaagtttaagaataatctgaacaagcactgggcattcatataacttgtctctctcatctgataatagacatactgtgtgcattagaagattaaagctgtatatagagatatgtgtttaaattaaaaagataaactgagtttttttccaacttttattttaggtccagagggtacatgtgcaggtttgttacatggataaattgtgggatgctgaggtttggtgtacgaatgatcctgtcacccaggtagtgagcatagtaccagataggtagtttttcaacactctgcctcctcccaccctccttcctctagtagtccccactgtctattgttcccatctttatgtccatgtgtacctaatgtttagctcccacttgtgagaacatgcagtatttggtttcctgttcttgcattaatttgcttaggataatggcctacagctgcatccatgttgctgcagaggacatgatctcgttcttttttatgactgtatagtattccatggtgtatgtgtaccacattttctttatacagtccaccattgatgggcacctaggttgattccatgtttctgctgttgtgaatagtgctgcaatgacgtatgagtgcatgtgtcttttggtagaacaatttattttcctttgggtataaacccagtaatggcaatgctgggttgaatggtgttctgttttaagctctttgagaaatctccagactgctttccacagtgactgaactaatttacatccccaacaagtatgtgtcagtgttcccttttctctgtagcctctccagcatctgttattttttgtctttttaataatagtcattatgactggtgtgagatggtatctcattgtggtttgatttgcaagaaactgaccttttgaatcacaatctaaaaacaaagctctgtccaaggaaagaaagctctgtttttcacaaactgcatgttgtcaggcaatttgcttaccttttctgagttgcagtttctgtatctttacagtgaggttggtgatgatgatgatgcatcatacctggtaggattgctgtgaagatgaaatgaggcaaagaaactgatctatgtataacaatgttccgtacatagttggtacttcgtaaatattggcttttaatgttgatattattacccatattggtgatggtgtcatggaatctgtcctcagaataaatgtacaccaaaacttttgcttacaatttcaagggactcttggaccacctgaaagaaatcttaaatcactcttagatgtctgagaaaggtctatattgttacaccacccactgaggttaagcccttctgaatagaggcatatacttcttgatgagttaattaaacctaaatgtgaagtaaaataagacttaaggcagggagtgattggtaacaattaaggattagtagcaaaggcatttaactgtatctgaatatgcattaagtattatttgcaattgtatgctttctactgtggtggtttttattgtgctactactgctttatttgagctcattaaaagtgttagcagaacagtgccaggtgcagtggtacatatttgttgtccctgctacgcgggagcctgaggcaggagaattgcttgagcccaggagtttgtgtccagcctgggcaacatagcaagatcccatctctaaaaaagtaaataaaaataaaatattagcagaataggatggactggattggaactttctaccagttagagaaggaggctacaaatagagcacatggtacttctgcccatgatgatcttataaaaacattaattgcaacgtccatctctaaggcaagggcttcttggatcttcacagcttttagattttgtggcactgagattttgaaattttgtgaattttcagagagctatgaaagcaaaggccattctagaattaactgtttcgattcttcatgccatagttgtatgctcccttcccatcacatcattcaggttggattactaattaggtgatactccttttgtgtctttggacagaatgatattacagctgtaaccaaagaaggaaaaattctgctaacaaatctggaagtgcctgacactgaaggagctgtcagttcaagactagaatgtcatcggcaaataagtggtgactggcaaactattaataagtgagtactctctttttggtttagagttacttattttatatttttgaaaggaaattatacatttttgctgcaatatgttaagtgttaaagtattcctggacctctggaaatctgagaacttatttctaggttgtcctacagagatgattttgcttgtagaagagagtctgtggacattggttgtctctataggtagaaccaagtgtcatgggctatgactttgcctataattcttaatgtccagaccacacttatctacatacttacaaaacagatagttgcttttaggaatttattggagttttctttcttaaggttgctgactcaagtacatgatatggaaacagcttttgatggattttgggaaaaacatcaattaaaaatggagcagtatctgcaactatggaagtttgagcaggattttcaacaggtcagttaaaacatttctttgtataccttttttcattacaccagaggtttttactccttaatcatgagaaatcctgccttgcaagatgcccatttatacctacaaagaaaaaaaaggaggcaaatgtaaatgaaccttggcttagactgaagaaaatctctactaaaattctgagacttctactttttcagcttactcgtttcctttgagaaagtatcaaactgccaatatatatgacagggacaaagttactctctactttggggtttgttattcaaatttatcttagatctaaagggtattcaaggttatgaggtagctttccaagggaataataccaacttccttcttggtttttaaatcccatgtacctatgctgaccatatttaataagacctaacaagcttttatttctgatccaggagtttattcctgtgaaaagcctgagagatgaaattaaataagtttaataaataattaaaaatacattccaattggaccttcctggaaaatccatcatatatggtcaagatgcatagatttagtttcttttccttttgcggtcatgttcaaccttatcacagtctctctcacagtatatacttcaccagaggatccaaggaaaactcacttgttcctcttgcatgtgcccagcttgttttctgcccatgaatggcttacttgctttgtatttcacttgctcatcagagttaggtttcggaggagcactgtactctggacgcggggctcagttaccactagcgttttctctcctttgattcaaacatcttttgaaatgttctgcatgaaaccttccctaaagaaagaataggtcaggttgctcttggtccttctaggtatttgtgtttctccctcgtctccaactgaatacacagaaaatagcacttttcctgaacatacccattatgcttatacttacatattaatttgcatgcataccaaattcttgtcctgtggttatgttctgtttccccaagtcattaattcctgtctttaatcaatattgttgtttgtcttagattataatctcactgacatggtgtgtctcatagtgacatgtcgacaagttctgtatgtctagaaacatgactttttaaaaaaacacgtagaaacataaacttacagaaaaatggcaaatataagaaaaataaaaatacccatataccttcttcccagattaacttaatgacaatattttactccatttgctctattatttttattccctccctcatatatatacagataatatttttttctgatctgacaaataatatattttctgacccatttgagtgtaagttgcacacatgatggccctttccccctaaatgcttccattttttctagtaatagggatattctgttatataaccatagtacagttatcagattcagtacatttaacaatgcaatacttttatattatctaccattggtatttcaattttgtcagttgactcagtcaagtcttttatagcatttatttttccttcagaatcggatcctatatagggtccagtcttgcattaagttgtcttgtgtctttagtgcccttgaatctagaacatttccacagcctttctttgtcttttatgactctgacattttgaagaatatagtcctttttttttttttttgagacagttctgtctcccaggctggagtacagtgacacaatcatagctactgtagcctcaaactcctgggcttaagccatcctcccccctcagcctcccaagtagctgggactacaggtatgcaccaccatgcctggctaactttttaatttttgtggggatggggtctcactgtgttgcccaggctggtctgcaactcctaggctcaaacaatcctcccgcctcagcctcccaaagtgctgggattccaggcatgagctataaggactcatgcccagccatagtcccttttgaaatgcatttttcttcatttggagtttgttggacatcttctcatgattctatttagtatatatgaccagctagaataccacattagtgaagtgtccttcttaaggaatcatatctgcaggtgaatgaagcctacctccctcttattgttgatgtggattctgattacctattcagggtgttgttgaatttctccactgtaaagctacttttactccccttctaactagtaggaaatgtgtggggagaaaatttaaggttatgcaaatatcctccttctcataaaaatttccccgtaaatttagcatcaactgatgatgtttgcctggacaaatctttgctgtgatggttgcaaaataatgattattttcaactcccatgtccagtccacatttatcagtccacactaggcattctactgaagcaagagccttcccttctctccatttatttctttatttgattcaaagatttttacttattggtttttaaaactttcaacttttattttagattcagggcatacacatgcacgtttgttacatgggtatactgttacatgggtatactgttacatttgaggtgtgaatgatgccgttactcaggtagtgagcataatatccaatagttagtttttaagcccttgccttcctcctcttcccccttttggtagtctccagcatttattgttctgtctttatgtctatgtgtaaccaatgcttaacttccacttataagtgacaacatactgtgtttggttttcagtctctgtgttagtttgcttaggataatggcctccagctgcatcatgttgctgcaaaagacatgattttgttttttttatggctgcatagtattccatgatgtatttgtaccacattttctttatccagtccatcattgatgggcacctgggttgattccaagtctttgctattgcgaatagtgctgcagtgaacatacaattgcattgcctttttgatagaatgatttattttccattgggtatatactcagtaatgggattgctgggtcaaatggtagttctgtcttaagttcttaaatattcaggatgccttccacagtggctgaactaatttactttcccaccagcagtgtatcagcgttcccttctctccatagcctcaccagcatctgttcctttttgtctctttaataatagccattctgactgatgtgatatgttatctcatttgatttgcatttctctgatgattagtgatattgagcattttctcctctttgttggaaatctgtatgtcttcttttgagaagtatctgttcatgtcctctgctcactttttagtggagttattagtttttttttattttattattattatactttaagttttagggtacatgagtacaatgtgcaggttcgttacatatgtatacatgtgccatgttggtgtgctacacctattaacttgtcatttagcattaggtatatctcctaatgctatccctcccctcgccccccaccccacaacaggccccagagtgtgatgttcccctttctgtgtccatgtgttctcattgttcaattcccacctatgagtgagaacatgcggtgtttggtttttttgtccttgcgatagtttgctgagaatgatggtttctagcttcatccatgtccctacaaaggacatgaactcatcatattttatggctgcatagtattccatggtgtatatgtgccacattttcttaatccactctatcgttgttggacatttggcttggttccaagtctttgctattgtgaatagtgccacaataaacatacgtgtgcatatgtctttatagcagcaggatttataatcctttgggtatatacccagtaatgggatggctgggtcaaatggtatttctagttctagatccctgaggaatcgccacactgacttccacaatggttgaactagtttacagtcccaccaataatgtaaaagtgttcctatttctccacatcctctccagcacctgttgtttcctgactttttaatgatcgccattctaacttgtgtgagatggtatctcattgtggttttgatttgcatttctctgatggccagtgatgatgagcattttttcatgcgttttttggctgcataaatgtcttcttttgagaagtgtctgttcatatccttcgcccactttttgatggggttgtttgtttttttcttgtaaatttgtttgagttcattgtggattctggatattagccctttgtcagatgagtaggttgcgaaaattttctcccattctgtaggttgcctgttcactctgatgatagtttcttttgctgtgcagaagctctttagtttaattagatcccatttgtcaattttggcttttgttgccattgctttcggtgttttagacatgaagtccttgcccatgcctatgtcctgaatggtattgcctaggttttcttctagggtttttatggttttaggtctaacatgtaagtctttaatccatcttgaattagtttttgtataagatgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagtgctctgttctgttccattgatctatatctgtgttttgagagttattagttttttgcttgttgaattgtttaagttccttacagattctggatattagatttttgtcagatgcatagtttgtgaatattttctcccattctgtaggttgtctgtttactctgttgatagcttctttggttatgcagaagctctttagtttaattaggtcccacgtatcaatttttgtatttgttgaaattgcttttgaaattttagtcataaattctttcccaaggccaatgtccagattagtgtttcctagcttttctcccaagattcttgtatattgaggtcttgcatttagatctttaatccatccttagttaattgttatatatggtgaaaggtaggggtccagtttcactcttctttatatgattagtcagctatctcagcaccatttgttgaatagggagtcctttcccctttgattattttcgttgatttggtaaaagatctgatggttgtagatgcgtggctttatttctgggttctctattctgttccattggtctaagtgtctgtttttgtaccaggactatgttgttttggtatagtttgatgtcgggtaatatgttatttctgcccttgttctttttgcttatgattgctttggctatttgagctcttttgtggttccatatgaattttagaatagtttttctaattctgtgaaaaaggctgttggtagtttgataggaataacattgaattggcagattattttggacagtatggccatttgaatgatagtgattcttcaaatctatgagcatggaatgttttctccatttgtttgtgtcatgtatgatctatttcagcagtgttttgtaggtctccttatagagatttttctcctccttgggctacatgtattactgggtattttattctttttgtggtcattgtaaatgaaattgcattcttgatttggctttcagcttgaacattattggtgtatagaaatgctactgatttttgtacattgattttgtatcgtaaaactttcctgaagttgtttatcaattctaggagccttttggtagtctttagtgttttctaggtatagaatcatgttgtcagcaaagaaagatgatttgacttcttttctgattcctagttttttgattgtttataatttattagtgttcttgactattgtggtgtttcaaactgctgctgtgtccttgtgacatactccaacatttaaataaatcactttcttactttctggcataaaaatatattccaagttcatcttgtacctattctgcctcaaccctggaatcagttatttccttgaggagccctggtttctttttctgggaaatggtattaaagaccaaggtctgggtgggagatgtgcttattacttctggagggcttttgcttttaggataattcaccagagagctggggaatgatgaaaaaaacacttagatgaaaattctcaggtaagattttgttttagatatttgctatatatatatacacacacacacacacacacacacacacacaaatgtatatatacctatacatacctcacacgtatacatttatgcaaatacatgtcctcatatacgaacctacacatgtacatggtgatcttttatacatcaagagtacacattgatatctatgaggttaaattttaacagattatagctatttctgtgaataaaataaccaaattttttatatgtgtaatttctccatgtcaatatttttgtttaaaagcattttgtataaaacttgatcataaggggataaattttatgtttttaaaacctctttgtttcgtatttttagcttgtgactgaagttgaatttctattaaaccaacaagcagaactggctgatgtaacagggactatagctcaagtaaaacaaaaaataaaaaaattggaaaacttagatgaaaattctcaggtaagattgtattttagatgtctgctatattatacagtataatagtcatgttttggcgggagtaggtagtataaacccttattattaatttctttatttttatttttccataagttactggggtataggtggtatttggttatatgagtaagttctttagtggtgatttgtgagattttggtgcacccatcacccgaacagtatacactgcaccctatttgtagccttttatcgcttgccttcctcccatcataacaacattctgtatatcaggcacaattatattggtctatattctgttttgttcaatgcaggccagaggtgacactacagatatatcatgtagttagttgtaaaaggaggtcactgagacaatggcgtgaactgtttcaagcccaccaataagaacaagggcataaattattttggagaagctagaaaaatgtgtatgaagaatgatatatggtgcttggaaatgatgggaacatacaagaacataattccttaaatgcccactttaggatatatgcagtttaaccaaatggagactcacatagatatttctacttattcttactatctgtgaccttgagtaaattggtttctaatcctcagtgtcttcatctataaactggggataaaatgacctactttgcagagcaattgtgaatattcatttaggtgtatataaagcacctggcacaacactggactatatagtaaccactcaaaagaggcagttttcattatccctgctagtcttaaattttggactagtggctttaatacttaaaaaactcttagcttttatgtgagagcaaggccatgctttttatgtgagagcaaggccacgctttttaagatgaattctcagcatacaaacagatttatgggtgaaccatgagtatgtgaaaacaaatattgaagaagcaacagttatgataactagttctggaattatgcttgtagatctgtgtgatcatgggacactttacatagccctatggtatagtagaaagaggaggcaaactggtttggaaactaagggagacttaatttttttccatttaataatttttcgtttctaattgtggtaaaaacacataacatgaaatttaccgtcttaatcatttttaaatgttcagttcagtagtgataagtaaattcgcgttgttgtgcaacagctccagaactttttcaccttataaaattgaaactgtatacccattagacaacagctctccattttaaacctggttttcccactagatagagaggccagtcatttcctcattctgtgtttgagttttatttattttattttgacaagcatttcttgaacccctactatgttcgagtctctacactggggggagtgagtagttgatggagtggaggcaaggccactaaaggtcattttttgacatagaaaccctgtgacttcaggtatgtgaagtagtccaggtacatgacaactctgatgagatttctaaggctgagatgatatgaaatacacttggctggtgtgtatacctcatttaatataggtggttctattctaaatccacacatattaggagaaaaaatctcacccacattctgtgtgtgatgtgcaattttcagtttctataaccagaaatgcatgagcttctaatgacatcactgctgcagctaattattataactgtaagtttttgtttttgtttttttgtttgtttgtttgtgtttttttttttgcagcctgaagaagtagacatcaaattgtatttttggcaatgtatccttcttgctcaaacattttgcttcttaattattttcttctttttttctctataggaacagagatcatgtattcattattttttgtctttgttataatcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggtagtgtaatgggaaatgatccatttctgaaaaggaacacacatttttttccaggtcctgctagcctgaagcaccttgccctcctgtcgcatggaatacttttcatcttctcagaggttatatggtcagggactggtatagctttggaattaaatttgtaagaagtctgaaggactgagtttgattatgattttttcatccatctaccaatgaactattcatgaaagatccaatatagttcaaattttaccctttgttctaaatattgagattgtggagtaatggcttcctttgtattttcgatacatctctgaagccttcactggtgatggtttgtacttggaacatttttaaaaacctgggggggcattttgctaaagcctgaaactcctttcacatttcatagtacagaaataaaatattaaacagtgactggaaaatattcctccatggcttgtgggtttgacccttttcacgattaggcaatgaattgacaggtcaccgtatggacctggtgttggcagtggaatataaaataggggtatcacttacagacattatatctgaacataaacattttaatctttacatctcattctttgggaaggaaactttattcttgtctttagccatcattaagcatttgtattacactttatatttttctaagaatttcatatttcagttactgattttgggaaagtaacatgcaactaagtgttagtgctgagaaaatggtcggactcctgctgcagaataaattagttgttgtgaaataaatgcagtgtttcccaacctcggctgtgtatcagcagtatctgtggagctctgtaaaagtataaatgcccaacttatggcccagagctactgaatcagaatttctgggggcagaacccagatatcttttttttttttaacagctctgaaagcatttctgactcacggaagccagaggctgagaaccactcacttattggacaaatatgttttctctttattaattcatattttttttttttcttcttgattttcttaccaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggtagaggcttttttattttcaaataaatatttaaagaaaattataattgcagtactgtgggtaggaggagttttactacctcacagctaactttatgtcaaattgcacttacattgtcctcttaggggtgatagtagtgccactgtcaagcatcaaataattcaaaggcatatgtttgctatataatgaagaataatttcctttttgagctccaaatccattattttaaaactcttttatgtgctaggtgttctcacacatattttgttgtgcatcactggagaaaggcccaaagctcttctataacagaatgttgggtccatgtcaagagcactttaccccagacatctttcctttgtgctgcagtgaccatcagcagatgctctgtggatgatgttgctttcctactcagtttgagaatgaaagcataaagataggatttgggtcttcttggagaaggaggagcaggcagaagttggtgttaacagggtggacagctataggttagttcagtactgcccccttggaaatgacatgaagaattttccacattgtagataagagcatttgtgatgctatttgctgctaaaatgtgtagttgactctaagattggagcagtatctagatccatgcttagcggaatatcctaggggatgccccaggaaatcagaaatgcagtcatggcaatagccaagtgattctctggaagcaaccaagcttaactctagctgcctcaaagcatctaggagaggtacaaaggtgtattatccattggtggctctgaggagcctgctgcaacatagaagactataacaagaatgtcctacagggtaaaatgtaacaaaatattataccgatgttattcatttgattgtttttataacttggtggctttcttatgctaaacaggaaagagcaatatgccttctttcccagccattatctgattcagccaatgaaccaatgaagggcaaatcactctatgcagtgaccaatttcatgactgcttcttggtaattttttccctcaggttgttttggttgagattttggttttatatccatgtgaacataatacattaatctgtcttgttatttttctaaatgtcttgtagttatattttaaactctaaattatttttttgaccatctgagtctgagaaatgtaatggggtttgtaatgacctcatttcataaaatatttcctataattcttatacaactcgcaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcctttggggcttcttagaggagagtaatttggtctttagggccctaagtaagtggaatgggtgaagatgggagtaaatttggtctgtctgatctaaatagagtcagaagcttcattagtgtaggagaactgctttggaattcagagaaggcttgagccaaggataatgagcataaaaataatagcttatatctagcatggatcagattttcaaaaggtgatgaaagcaggtaactaggctaagattatgaaagttacatgtttaatacttatgaaatatataaatatatttacaaataaaactataagcaatgtcttaaatacaatatcaaagatatagcaaagatacagggaatattaaaactactggaaaaagagtaaagataacaaaataaaaaacagtaaggggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctttttgcattaaatataattctgcacctagcacagggcctggcacttagcaagatgtaataaatatttgtagaattaacattgaatatagagtgtagttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttggatctctgtagaacaggtttctttgaagtggagcatattagtattcattgagaaattaattttgtataattcccactgtttaatatatatttacatatatgatgatataaacttgaagtttaggtagaaaatatattttaataagtgaaagtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggctaactcttagctcaaaaaagatatccattcttttttgttgttgtttttaagtttttttagagacagggtctcactatgttgccaaggctggagtgcagtggccattcacaggggtgaccatagctcactgctgcctctaattcctgggctcatgccacccttccacttcagcctcctgagtagctgggactacaggtgtgcatcactgtgcccaatctacttacttattgttagatacaagattctgttcttctcagttatccatgataatctgatatctgtaaagaagtagactcatcatagctacaacatcccacattttcttttctctctctctttttttttttgagacagggtctcgctctgttgcctaggctggactacagtggtgcgatcatagctcactgcagcctcaaactcttgggctcaagaaatcctaccaccccaggctcctgagtatcttagactacaggcatgggccattatgccaggctaatatttttaacactttttttgatagacagggtcttgctatgttgccaaggctgatcttaaactcctggcctcaggtgatcctcccgccttggtctcccaaagtgttgggattacaggcatgagccactgctcccagtccccaagaccccacattttcttcttgtgttttttgtggtaaataaagatgagaacatatttttaaggggcagtatagcatagtggtacaaattgtaaaactaggctgcctggcttataatcccagttccatcacttactggctatataaacttgggtaagttctctggaactcagtttccatatataaaatgggcataaaaatagaacactctcatcatggagttaaagataaaataatctaatatttgtgaagcaccttgaacatgtgtggcatatgataatgctctaagttttaatataattaatagcagcctagtgaatggtctatactgatacacgaagcctggttattattctgtacggccacaacttctggtttcaagaaagaaacagggtgaatgccaaattctgtagtattacatgttgtaaaatctgtctgagcctcagttttcccatatttaaaatgaggaaaagaatgccattgcttgctaaatgctgtttggattaaatataatatgtgttaagcacctaggactgtggttgcctaatatatagaaagtcataatacatgcttgtttctttcatttgtaataagtaggtcacattttggggaaatatttagctgatagatactgtacttcattttgggttctagttgtcccaaagaaatgttacatttacttggaggtcaggcttttggcaagctcagctgtccaatacagctgagattggataccaggaatacacttcaaatgcttcttaaaagaaataatcatcacaaatcttttgcagttgactcggtaggccagtccaagtcctttagagtctgtaaaataaggcaatttattagaattagggaggcaacttatagcgactaacatgtggcagggagtagagacagagatgtacaggttacagttatttcaagaaagaatagagttctgcaggtatccctgcagcacatcattagattttatcatattcaagcttatgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacacatctatcacctcacgtagttaccattttttttttgtggtgagaacagttaagatctattctctcagcaaatttcgatatacgaaatgaatagagtggtacatcaaaaattacaaaggattatacagattgatacaatgttattttatagatgttaataattgttttgttcattgttataatggtatattaatattctagacataagaatattcatctttttaatttgatgttacagttgtaattagcaagcattttgcagcaagttgtatgtatacatatgtatgtatgagatacatatatatatatatacagacacatatttatactgtaagactctcaaatgttaaatgctttaatatgcaaaaagaaaaagaaaaaaagccaaaagtataagttaaatcaaatgggttacttatactggggacaagggaaatgagttttaaatatgatgtcaattggaaatcacattgaaaggaaaatatactttattttccagagacagtaaacaaaattattacagaaacaggtggggcgtggttattcacgcctgcaatcccagcatgttgggaggcccaggcgggcggatcacttgaggtcaggagttcgagaccagcctgacaaacatggtgaaaccccgtctctaccaaaaaatacaaaaattagccaggtgtggtggtgagcgcctataatcccagccactagggaggctgaggaaggagaatctcttgaacccgggaggtggaggttgcagtaagccgagattaccccactgcactcaagcctgggtgacagagtgagattccgtctcaaaaatatatttatatacattacggaaatataagtatgacctacacttgaggagaccagggtaaaaaaatctgcggcctcctttagaaaatttcagaacattactttgaaaagggaaaaatagtgcctaaaatgctaatacttattttttagggaaaaaaagggtattaaagttcataaactatgctacccccaaacaataaaaacctcagacatttaggaatagttattgtgagtttttagtacatttattcctaatctcagtgagttagaaataaagttctttaaagctaatagtaacccttgagcatatatatgtgtatatatatgaaagaaagcgggatatatatatatatatatgttatatatataatgaatataaatacaatgtataaaaaccacccataagactatatatatatatagtttttattctagaaaccataaaagtagtttcatattttgatgctaaaacgaaaaccattgataattcctatgcattagctatttttaccttctcatgatgataatacttgaaacattgcaatatagatctcagtaataaaataactgataaatatggtcttttcattttagccacgtactaaatgaactgatacagactgagagagtttatgttcgagaactgtatactgttttgttggtaagcgactcaaattgtatttgccctatcttttcccgaatgatcccttgctacattcattagaaagtgtttaggggcaatcttctacttccgtctccttccttggttgtcatatggcagcagtgggcatttcttttattgtttgatgcagcatgtcggttaaacgtgcacattcaggctctccctcagtaatgggaatgattgattcagaatttattacagaagagaaaatgttctcttagggatacagccgattgttacaattattcccagggtgctatttagagatcgtgatgtaaaaaactgagaatgggataaaatattcttttgacaaaaatgtcatgatattaatttggtctgaaaaaacctaagcacgtattgccaatttaaggagaagctgatgacctgtagtctatgtttttatcttggtttctatcttgtttcctacactacaagctactctgaaggccaaagagctattactttattctgcctatttgattggaaaacttgacttcctttccttgccctgccttctaaaaaaaaaaaaaaaaaagtcatggataactttgggaagtaggagatttgaattgaattaaaattgaaataaaattcaaaaaacttcaccatcaaatcccttaatattctgctgtacctacaccattagtagcccaaccaaatgtgcatgtaattattttaaaatgcatgaatgtatttattttgggtagggttatagagcggagatggataatccagagatgtttgatcttatgccacctctcctgagaaataaaaaggacattctctttggaaacatggcagaaatatatgaattccataacgagtatgtaattgctgaattgaatatttattttttataaaactatttaaagtgctctctttaccagtttattatatttcacataaaatcatgcaattttttttctctgaaattttcacagcattttcttgagcagcctggaaaattgtgctcatgctccagaaagagtgggaccttgtttcctggaaagggttagttaaattattttttaaatatatataaatatgcaccaccaaaatagcaactcacttataagaacagatttggagacaagataggtactttatgtctttatgtttttggagaggacacattactccagcaagtatttaataccaaaccaagttttgctgcagaaatggatgcactgggatatccagagcataaaaataccccttccattctgtggtatcaaatgcttcagtggctcagctcttgaacactgactcctgggtaatcctagtaatccagggaccatcctgactatgaagatgtaagagttgggatcatgataacaaaaccatctggggcttggttaatttttttttttttgcctaaaaaacaccttattatttatattatttgtcttattaaaatacatgtaaagttttagaattggatctagtctgactttcagccatcaaggcatctatcacaggaacttcacagaaacagagagctgtcagttcttttcattcaacaaaagcatttagggaggcccattcctctgtgtcccaagtatggttaatacaattgacttcccaggttagtgatcatactctcctccattagttttcttttagaatattttttgtgtatgcttctctgcttatgcagtttctcttcttcctgaaagatcagttttgtcttgatttaagagttaattcaatagaggtgattgttgaaagcttcaaaatagatgtcttatcccagaaagtgtttatgaaatgagaagagaataaggataagaaagaactgtgtgtcaaccttgctcaacgtgttctaactttatttattttatttttttatttttatttttgagacagtctcactctgtcacccaggctggagttcagtggtgtgatctcggctcactgcaacctccacgtcccgggttcacaccattctcctgcctcagcctcccgagtagctgggactacaggtgcccaccaccacgcccagctaattttttgtatttttagtagagacggggtttcaccgtgttagcgaggatggtctcgatctcctgacctcgtgatctgcccacctcagcctcccaaagtgttgggattacaggcgtgagccaccgtgtccggctaagatgttctaactttaagcatatttaaattatgaccaaattctttcccaacctcatcaagcaatagcagtttatccttcctttagactccatagtatgtaatgtctatcctactcatgggagattttatatttactgtgcttgtgcacctttacatatatacgtgaattttctcccaaacttaatggacagcccttagaacgagagtccatatcctatatattgttgtatctctcattgggttagcagcgttcttagcaaccagttgtggtttaataaatgtttattgatgaattgtttatttattcaacaaccatttactggtcacctactatgcaccaagcattgtgccagataatgtggataccaagcccaaatctatttagatataaaaacagggaaattattaattgtgtagaagatgagttgcattagatttgaaatatacaaatggtcctgggaaaatccagaagaggggcgtcttgcatagaatgggggtataaacaatggttgtatagaagagataactcatgagataaatgttaaataatgagtaggaggtagcccattcatgagggtcagagaaagaggattccagggaaagagaattgcataagtgcctaaatggattatgctacagtgataaagtcccagtgatgaacctaggactgtaggctctaacttggaagtcagctacaagttcattcactagggaatcaagagactaataacagaatatatttcttggcagcctattagttcatcgttatgcaaaaagtaggtttttatagttcagacagagaagcctccatctaagcctcaagcttggcaagtggaagctctgatattacttagataattatgtgtcctcccaccagatgcaatgggcatgctgttcttggaatataaaaaaggcttttgaccagctgctagtacagtaggccctttaggccacatttcctaggatgcttggttacactcttgtttagcctttcttgatggcaaaagtcatattcacaaattagtaatacatttgaatttgttttttatcacagaaggatgattttcagatgtatgcaaaatattgtcagaataagcccagatcagaaacaatttggaggaagtattcagaatgcgcatttttccaggtacagtaattattcaagtattggatatattctttctggaagatattgcggtatttcttaattataaattcattttctactttaagtacgttacatgtgcatatacgtatatgagttaaagagcaaatccaccctcccccccaacacacacaaacacatttgtaacttcccagaggcaaacactttcagcacttttagctacatcctttggtatttacctccatagctccaaatgacatgcttatctttatcctttatactatggaagatgaagatttagctctctttcacgcccctccacccacccaactaccacatatacaaatatacttcttttctttcaaaatctccactatagtcatatcgtaattttggttagattgatatacagtattaaattaagactacgtaatttctttgctcagatgaatcatgtggtataatagggttgcttttcctacccttctgtttgtcttgcagtggtttttttactcagttttctagatacttatcgttattctaccccaacctctcccagatgtgggagttacaaaaatctcttcttattacatttaaacacattctattttctctgaatttcatattcttaaagaaatatctcctggggttttctgtcttgcttgtctagactcactaggcttgttgcgcagctgtcatctggggatcttggtgaacataatttttggaattctcctcacctgtctattgcataggctctcctcattcctaggtgccatgtctttatttttcttgtttacctcccttgtttggtggaacacatcctccagtagttttcccaagaaagtgtacacagtacataaaagtttttgagagtgtatgtgtctgcaaatatctttattctaccctaagacttcattgctagtttggctgtgtatagaattctaggtaagaaataattatactcagaattttgaaggtattgcttgattgtcttctagcttccagtgttgctattcagaaatctgatgccattttaattgttgttcctttgtaggtgacttagtttctgtcctctgaaagcttatgaaaacttattttcagtgttcaaatgttggcactatttttatccattatgctagtattagggtgataactttgaatttggaacctcctgtacaaatttacttggaggttttctttgatttcctccacccaattgtctccattttctctttttggaatttctgttgtacggatattggatatcctggactggtcctctaattatcttatcttttctattttccattctttgtcttattactctactttctagttcttccattgaggtttccatttctgccattgtgtttttaattttgaagagccctcatccttttactgttttttcaatgtttcttttaatagaattctattttcattttatgaattcagtatcttcattcatctatacaaagatgataatagatttttcttttaaaaatggctttcttctccctgcacatcttctgttgtcttcactttgctttttttcttctatttctctttgtttggttcctattacccatgtttgatgctctcctcaaatgtctggtgatacttgtctgtccacttacattaggagtaaacactaaaaagctcattggaagtttccagggcatatgtgggtttattgaccatgatcctcattgttgagttatttgtctcaagctatttgcttgaagggattcccaaatacctgtatctttagagcatttctattaggctggtcagattccttgaactgctaccttgtgtataatgatctggatgctagtgttgtggtagcagagttgggagaaaaggctgagggtcacttgtttgagatataacatggagagtacttgaatatttttcaatatggtactctgccctaagttgaaccttgtatcctttggtccatagggcctgtgttttactctttctagataaacatccatttttctgccaaaggaagggaagagaaggcacccagctgtgcaaagtggtgtggttatctgagagccttattgcttttgtttagattttcatgccatttattttcttcttgtaacagctttattgagctataactaaaatgccatcagttcgcccttttaaagtatacaattcagtggttttactagattcacaaggttgtacaaccatgtttttatcactaaaaagaaaccagtcttaccctcccttttttccccaatctaagcagccctaggcaatcactaatctgcatcctgtcttcaatagatttgcctattctggacatttcatataaatggaatcatacaatatgtggtcttttgtgtttgacttctttctttcatttagcataatagtttagtggttcgtccatgttgtagcatgtattagttttttattcctatttatggttgaataatattccattatatggatgtatagcattttatttatccattcattgattgatgcacatttggcttgtttctaccttttgattattatgaacaatgctgctgagaatgcttttgcataagtttttctgtagacatatattttcattcctcttggctatacacctgggagtgaaagtgctggatcatatagtaactctacatttaactttttgagaaactgctggactcttttccaaagttactgcaccgttttgcatttccaacagcagtgtatgagggtattaattgctccatatcctcaccaacacttgttattatctaattacttcttaaaaagactttcaacaagcatcctttcttgaaccgcacctttacctcccactttcagaggtacttggtgtctataatccctgagactttgtggagggcagggaagagatgtttataacataaattgagttgttccttggctttttcctccaccaacttgaaatccacttttctccagtgtgcttggttgttgaccacttctaagtttggtttccagtttccaaattttgcggaagttttccccttgcttatcttcttcataactttgtgattttgcctagtaaaataacttttccatcattttagttggttgtcatgagtgaggagatctaaacgcatgtatcaagttggtgcaaaagttactgtggtttttgccactgaaagtaatggcaaaaaccacaatcacttttgcaccaacctaatagcagtcccccatctttaagtctcatttgaattagattgtatgttggattttacccatattcagaggagagccatggttcttattcaggcgtatttttccccaatccctttgtgttctatactttctctatgcacatttcatcctaaatatctgcatcttgccctaactatgggcccctacaatgttcccggaacccaacatcatgacccttatatttatagtggcaatgggccaattactgaagtatagcaccagttgatgatggctttttcttgttatattaaaaattttgttctcatatccagtctgatttatattcagcacaaccaatttcttttctgagccttggcttgtagagcttggtctttcgtgaattttcttgaatatattaaagaacgttttaatcatgttaatctatagtcattccctgctttcacaccttttaagcattccacatcaatatgaatttatatttgaaaacttttaaatctttgaaatgttgaaattgtttacctctccaatccttgaaatagtgtttatggtagtttttcagatatattgtgtcttataatttctgtactataacagtgatttttccaataaatattctttgagatgtaagaaacattggggcattaggtttaatcaatgaacacttggcattttcacaggtacatgtcttaatttaattttattgatatttatcttttaatgacaggaatgtcaaagaaagttaaaacacagacttagactggattcctatttactcaaaccagtgcaacgaatcactaaatatcagttattgttgaaggtaattatatgaagcatttgtttgtttctttactttttgagtcagatatgacagagccattaaaaaggaaatagtttactaggaagcactagaaataggtaggctcaatgactgggaaggctggatttggcagaattttgcagtgtgctccatcaattcactgtggctacaaatgccataggcatagatatcaggctgagaatatctgggatcttagctatttaatttttcatacaagttgtgttgatttccgcacaatgttttactgaagaactttaaatattagtaagaagaactaaacaaagcaaatatttcttatagttttgaggctgcatttcataggggccttcctaatgaaaaatgcgaatggcactcccctagtataatgcgaaaggattgctagaatcttgtgttaagtataaatacaatatggcttgttttaaagtgaattttcataatattctatgctatatgcattatgagtgcatcatggctaaaacaaattactgtatgtagaggacaaaagaaccctacatgtaatggctttaaaaattgatctctgatgtgtcttaatagctattatacttcaactccagaagcattaaatgtcctttgttttatactattcagtcactattctacttcctctattttgacagccattaaaaatattactgcagcaaagggcatgtaaaaggaattactccaaaatgtgacattatatttggattccagcttgaaagcatgttagccaaaaacttattcatttcaaccagatattaatatctgcctaatattaattcctgatttctaattacaggagctattaaaatatagcaaagactgtgaaggatctgctctgttgaagaaggcactcgatgcaatgctggatttactgaagtcagttaatgattctatgcatcagattgcaataaatggctatattgtaagcacattttaataattgttggaattttagagggtcggcatctcaacatcccttttcccctcctggaaccaattgagaaataacgtataagaatcagataactggagatcaaaatgttgatgttactactgataatgctaagtggagaattggcttcagatcagcagccaaatggatttatgagatcccccttgtccccaacagtcttcccccaatcccagacctgggagatcctgcttaaggaatgtttgagtcagctaagaaaacgtattgctccataattgctgcttgcccctgtagataggaatagataggaaagaaaagaatcaaatctttagcacttgtgtagccttttaacaggttagctccacccagtgggaaaacttgaactggtatatatcatgcaccaatcaggattgaagaagagatggggagacttaccctagctgaaatacctccagatgatatgaagccagagaaaaggaagtttcttttgtcccccacccccacagtaattttgtacttatgtggtgcatgccatgttttaacatacaaagttaagtttttaaaaaaacataaattattcttcagggtttgagtagcttaagctgaaccctaacatgttggtgtcagagagctgaatgtagctttgctttctactaatgggttttgattttccattctagggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaagtaagacaatttgtatcgggtaatgtagtattgtttcgtgtgtgtgtgtctcccagtttgtacattttttttgtttcaaatgagtaggttttatactttcgctgcacatctttgttttttttaaaaaatcttaagtcttatgtagaagtcagatgaatcataacttctctgcttgaagtgaaggtgaggtaattcagagctttgattcctccctttcttctcactacgatcctaggtattccccaagggggctccctagcgtcctgaagagcacagtttgaaatgataaggagtgtcccagcctcctcataagcactctctttcgagtgacactgggtggagttcttggtcttgttagaaaggagccttatgctacaggagagacagggaggaaagagtttcctccttttcctcaatgcaatttaaaaatgggtaacttttgtgtttagcatgtccccaccttcctttctgtgttcctcctccactccctagctccaccctacctgggtgttcaaagccacctatagctgaatcctttccttatctgtcctgttccgtctttcaaaattactttattctctcctataaacaaaatccccattttgtcctaatattagtttgttattaaaaagagaacagtattgtttggggaagttattgacaacccaatgatacttacagctggtttctccaatagagaagaagaacttccaattcacatgagacccataattgacaaatttgaatttttttacatctaatgcatttcatcttttgaattttaaatttttttttattttttatttttttattttattattattatactttaagttttagggtacatgtgcacaatgtgcaggttagttacatatgtatacatgtgccacgctggtgtgctgcacccattaactcatcatttagcattaggtatatctcctaaagctatccctcccccctccccccaccccacaacagtccccggagtgtgatgttccccttcctgtgtccatgtgttctcattgttcaattcccacctatgagtgagaagatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttgattccaagtctttgctattgtgaatagtgctgcaataaatacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccactaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttgtcatgtgttttttggctgcataaatgtcttcttttgagaagtgtctgttcatgtccttcgcccactttttgatggggttatttgtttttttcttgtaaatttgtttgaattcattgtagattctggatattagccctttgtcaggtgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatagttttaggtctaacatttaagtcttcaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagtgctctgttctgttccattgatctatatctctgttttggcaccagtaccatgctgttttggttagtgtagccttgtagtatagtttgaagtcaggtagcgtgatgcctccagctttgttcttttggcttaggattgacttggcggtgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttatatcctcttttatttcattgagcagtggtttgtagttctccttgaagaggtccttcatgtcccttgtaagttggattcctaggtattttattctctttgtagcaattgtgaatgggagttcattcatgatttggctctctgtttgtctgttattggtgtataagaatgcttgtgatttttgtacattgattttgtatcctgagactttgctgaagttgcttatcagcttaaggagattttgggctgagacaatggggttttctagatataatatttctattgagataatcatgtggtttttgtgtttggttctgtttatatgctggattacatttatcgatttgcgtatattgaaccagccttgcatcccagggatgaagcccgcttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctgggctctttttggttggtaagctattgattattgccccaatttcagagcctgttattggtctattcagagattcaggagctggttttttgaaaggatcaacaaaattgataaactgctagcaagactaataaagaagaaaagagagaagaatcaaatagacgcaataaaaaatgataaaggggatatcactaccaatcccacagaaatacaaactaccatcagagaatactataaacacctctatgcaaataaactagaaaatctagaagaaatggataaattccttgaattttaaattctaaaaccaatataacatttgtcacaaaaaatttcaaaaatagagaaaacgattgtccttaattccccaaccactatcatgttagttacttttcatgagcatgttctttcatagttctcatcaccagtatatttgacaattgatgaaattttcagtagcagttataaagaggacaggcaatatgttttgagacaggcatgaggtatttgtattaggagactacctgtaagcaggccttgcttttgattcttcccataggatcagcagcccctagttgttcccaacaaggttcctgcccagggtcgggtcaaaaagaagtagttcttcctattgtgtattttccctgcttcactctgaacccacagcagcttctttaaaactcttggtttcgtcacaaagggccagttgctcctttgattttagcagtccacctctaagcccccaaatctcaaagggccttctaagtaattaataaacatagattgagaaccataaatttgtaatccatgtcagagagggttcaaatctcttgctgtctgtatacctattccttgggaaggtactttaccttcataggcatatttgacccaaatgcatttgatgtacattttatcatgaggtgacctaatttctacctaatatagtatttctatttcatattaattttctattttacctttaatttgttacaatgatggacatgccaacaaaatgtttcttgagtacattaaagtaagggggatattaggtgattaagtcatgaaaactgaaactgcaataggtaccatggaaacagagaaggtgggatagattcaagaaacatttcaatagaaggtagacagatgggcttgatgacttactagctacaaaaattaaataatacctgacattgaaggaagaaaatctttctgattcttctttggttccccagtaatgccaagtatccttaataaacaatattagccagtgatgcctacaaggctttagaccaggattacttggaaaatggtgataccactaaaaattaggatatttcttagggttcactacgctcacttctgcttgcctgcttatcatgagattccagcattaagcaattgctagcattcctagtcaatgtgttatttaagaatctgggttattagtttcacagtcttacccttggtagagaggatcattgcagatattccactgctgaaccttctctctcacttttttttttaacttttattttagattcagggggtacatctgcaggtttgttacctggctgtattgcatgatgtttaggtttggggcacaaatatcccatcacccaggtactgagcattgtccccaagagttagttttccaacccttgtccctctccctccgtccctcctctggtagtccccagtgtctgttgttgcctttgtctatgtctctcactttaaatgaactcttgttttgactgcaccatacaaagctgggatcccatggcctgaccatgtactttctaattatttatatgttatattttaagttggctgcttatatgcaaggaaaggccctatctaaagtcaaagttgaccagatggggagattcgagtccttcagattccttagttcatgtgtttattatcatcgatttttaaaaattttacaaattgcacatagtccttactatgtgcaacacataatggttagatttccagggcaacttagaaaagttcacttaattgataatgatgtactatatgtttgcaataaaaaaataacaaaacaattgcaacttaaataggggaaagagtagaaagcaaactcacactttagaaagctcattataggatctaagcatttactccatgctatttagtccttatatcaaccctatgaaataggtgttctttctattttatagttgaggaaactgaagtttagaaaagttaagcaacttgcaccaagacacatagctagtgaatggtagagatgtattccaatccagacctctctaacttcaaagcctgtgggccttccagcttatcatgttattaagacaaaaccatgtaatgaaacaaaattaatttttaaaaatattgaatatgagattactattcatcttaaattgtgatatttgagcagaagtaggttagttggaatgatggagtgagaatataaagatagtttgggacattgtgaaaataacttcttactacgttcagggtggatgttacaggttctttcattaatatgttatgttaaattacatttctaagcataagtgcttttcttctccttggtatggcgatctccctagcactatctttaatgcttattagctctaataagggccatttggggggctcataactagaacagagagtgagatactcctttagataattaggttaagaattgaaagaaaagaggaaggcagaaaggaactaaaagaatgtttgtgcaaaggagtgagattgcccaaaatgcaattagccaagctgttagcagaaaatgatgaaagaaaatggaagagtttatgacttgcacaatcacgctgaggaaaagaaaaaattgtggtaaggaataaggaagagatattgtgtacagaagtttcactgggtacaaaaagacaacaatgtcccattacatattattattattattttttttttagaaaggccaagggattggtggaaaatagagagatccttgtgtacctggctggttctctcctgtcccatgaattagatgtttataacttgtaggacttctatcaaaataaattataatttgtaggattaagtggtctgtcaaatgattattctaaataactatttaaattaattttcagtggcttttctttattgatgtttaatgacttctgtgtttgactcaataatttgttttaatagtgtactattaatttataacataattagatcttagatgggctacttggatgttcagatttataacatttgtgtcaaccactgaaatgaagcgtgcaatctgaactataaagtgcatagttcaatgaaaacatttaaatactctcgtctatgattgtaattactatttcatattcatttaatataacatgtatttttctgcccaagagaaattctgtttcacttagaatatgatagggtagatttaatgtaatttcatattcaaaataaaatgctcatgaaaattttgacttatttattatagatggatgaagttggaatcactgaatatgtaaaaggtgataaccgcaagtttgaaatctggtatggtgaaaaggaagaagtttatattgtccaggttggtcatttgaaaattcttctagaaacccaaacctgcattgaaatacaaaagcccgaatttataaacaaaaataattttggtcgcatttcaaaatttccacccctttcatgtaggtcagttaaatattatttgaatattctttgtgatgtatttaaatgttttctagtagttacattgagatatgcctgtggtgttctctagggcttcaagttttcacaactacataagagacttatcaactagagctgacagcttggcaggtacttctctgtccccatcaaatttccaagttatggaattataatagttctgagttcctcttatgctaagcattctaggggtacctgattatgagacatggggatgtgacagttcagacttgctttctgcttctaaagaacatggttaaagccctggccagttgtatagggtccaacatgtttcagggaagggaagaggaatcagaacatttcaagaggatgttgtcattgcaataaatatttgtatctggagttgtcaatgtgctgttatctgttaaaaatgctcagtgttttttgtttgttgtaattctttactaggtgactgcaatctataaaaatatgttttcttggcttgcttaagatataatatttggtatcatttaacaaacatcttgtaagtgatgggaggatatttaaggaggatttcatgttaccatcagtcaccaaggttattctgcaatagatggccttttcagaaatagtagagcttgttttattttactaaaattaaacatcaaaatgttatattttaaaaagaatcctcctgtaaagacaaaataagtgaaattatatttcacagtttcatccaagcattattttaccattatttaagggcaatttcaaaatggattttttttttttgagacagcgtctcaccctgttgctcaggctggagtgcagtggtgtgatctcggctcacttcaacctctgcctcccaggctcaagcgattctcccacctcaccctctcaagtagctgggactacaggcacatgccaccacacctggctaattattattattattattagtagtagtagtagtagtagagatggggtttccctatgttccccaggctggtctcaaactcctgggctcaagagatctgcccaccttggcctcccaaagtcctgggattacagcaaaaatggttctgactgtattatttcatctaatctgatagcaaattatttgcttcataaaaattttaacaatcaaacggttaagatttgagtatggtgttatagggagtagatcatattttatgtacacaattacatttgttttattatagtacatcctttttaaaaggaaatgtgtaccacctccctcccgctttttttttaatctttaggcttctaatgtagatgtgaagatgacgtggctaaaagaaataagaaatattttgttgaagcagcaggaacttttgacaggtaaattcaagcctgcattcttcagaacaagaagtatagtaacagcttattgactcagatttttaaattatttttccagagaatggggctgatatttactttatactattacaatgagaagatttgttaatttaattagtaggagattgagattcagaggattgtttaaactattttgaagaatgaactttacactagaaaatgaacccttgtgcttaagaagcagttgagaagcaacacagtgaactgattgtggtaatccccagtcctttccatgaggtgactctgcttaatatctcgagtaatcattgctctataatgatggaatgggagccagttctacttctaaacttgaacttcttgaataaaatattatatggtccagacctttccaaattcaaacttgagactggccttccctctgattatttcaagtctgtgaagcttaagtctaatggcaaggatgcgtgtgtgtgtgtgtgtgtgtgtgtgagagagagaaagtcattggccttcaaggaagtaagaagtgtgacttctgaatgataatatgctttgttttatttctcagttaaaaaaagaaagcaacaggatcaattaacagaacgggataagtttcagatttctcttcagcagaatgatgagtaagtgattattctttaagaaataccactcctgcaatcttttgttttctgtatgtaacatgaagcaatgtaattaaagtatctctgacaagaaccatccaccaatttagcaataactcatcaaattccataaacatcattttctgaggtccagccttatactggaggctgatagttcttaatagttatcccttgggttgatttctaaacatgattgaaaatgctttatttttaatatatcattggaagaattacatgtaggctgacaggaaaggaggctgtgctcataagctttttttttcaaagtatttttggtcacctttgatctgactggaaaaagagggttgtaagaatatgggaatagagcaaatgaaggactggctcacagttttacagtcccttgatggggacctcttgctggtgatttggcctctctctacatagagagaaggtatggatcctgggagggaactgagcctggacacaaccaggagtcattaaggaagcctctagaaattccaaaaggtggagttctcgctgaacatttgcatatatacagaaagaattctctcattgattctgaaggcctggcacagagattcaccacacagcatctgcttgctgtggtgatcattgaatgacttattagaaatactgttttttccttcgctgcatgtcatctttctgaggtagctaaaatcagatgaaacatatggtggttcacgtggagatttaggagaaccatttaaaagttgcagataaagtctttatctttcagagttcaaaaagctccatcttttatcgtacattataggagtaacatctttaggttttatgcagtaattgacttaatagtagctggtacatactcaacaatatgaatcagttgaaggtttcatcttcatttatatacaacaacttacctaattcattaatgttataagtccacagagcaacggggattgtatacaatacccttactttgggtctagaagggagtagtttttctccttacataatagagaacctgctggcttggatctgagatttaagcttttgtatattataacctattgccacacagatttaaatagggagtattggctgtttggatggattctcagcatgttcttaacacttggtatcaatggaagaaataccactttaaatttctttttacttgtaaactgtacaaaagctcacttagttttatacatcactatttcagaaagcaacagggagcttttataagtactgaggaaactgaattggaacacaccagcactgtggtggaggtctgtgaggcaattgcgtcagttcaggcagaagcaaatacaggtatgtgtcatggtcatcttaagacgagactcatgggtgtgcaaatttttacctcgtattattaatttggaaatctacccacttggtatttttgtataaacaaaatacagttaacccatttttataaggctctcatgtcttgcatatgcaggacactctgatgggcactagagagtattggttgtcaaagtgtggtccctggaccactagaatcaacatcacctggaaacttttacagaagacaaattctcttgctctattcagaccttctggatcagaaactctgggaacaaggcccagccacttgagttttaacaggctctctctgtgattttgatgcatggtcaagtttgggaacccctgctataaaggatatagtgatgaataaaacatatatactggcttcaaggaatgcgcatttcacttaccgttggtttaatgaatagagaagagtcattaacagccgaaatatttattcttcctctgtgaatggttttatttgaagtgattttaaatactttatttaattcaacaaatattgacatagcatgatctgcattccaggagttatgcaaagtgctaggcatatagtctaactaggatacactcagctgccatcctcatgaagctaggagaatagaaagatagttaaacaagcaattaaaagtaaatttggcgagtgttacagcagggaagtacgaagtgctgtagaagcatacatgaggatcacctaaacaactctaggatcaacagcatagacttctttggagaaatgcctaacagagtgcctgatactcaacactttaatatgatgatccttaatatggaagagttctctactggttgaggagaaaaaggtaatgatagccttgtagagtttccatttatccaattaaaggtcacttccctcaggtcatctatgctgtggcccccaaagaagtaaggagagagcatagtactaatgccttcatttgacaggtgaggaaaccaagttagaaaaagatgacaatgacttttcccaggttgcatgaatagtttaatgtggccaggatgagatctgttaatttgctgcttacattagattggttaatccatttttttaaattcaactttttaaaggattacagctagttttacttctcaccttgtggtaaattagcaccatgaagtaactgccacattccacacttttcttatagtttggactgaggcatcacaatctgcagaaatctctgaagaacctgcggaatggtcaagcaactatttctaccctacttatgatgaaaatgaagaagaaaataggcccctcatggttagtaataatatagtaaattaaaattattgaggcagttttactgatgaaatataggtggagcacataggggcaatcttttgtcagcatccttgaggccattaggagtaagccattgctaaaatagttgaaataaatcttattatgaacatcaggaagcacttctgtctttaagtagaacctgtttgacctatacatagagcttctgctgatgttgatgaaatagatagtcaatctttccaaatctctaaaatcccagttttatctttagtagagcttcaccactgtgttttccatccaggcatgtgaaataaaatcagagaacaaaggggcttcaaatacactttaaaaaccagtttggattccagattagaaaataaaggaaataagcattatacattaaaaacgatttaataacatctgggggatatattttagtgtgttctcaaaaatacactaatgatataaaatctcagcatattagagcaagggagcaccctgtaaaattaaaggaggttgctttaaggttaaagtgtttatagaaggaatagtttgcaagttggtaggataccagtgggctattaaagaggaggtaggactgtttgggagtaaatccctacttttctaaagtcaccagcttggaaggtaggagtgatgcttggaggtagagtgctccttggtgcccttcagaggaatcaattacatttggcagttctactgttagtataagagggtaaacctcgtctctactaaaaatacaaaattaggcggttgtggtggcgcatgcctgtaatcccagctattcaggaggctgaggcaggagaatcgcttgaacccaggaggtgcaggttgcagtgagctgagatagtgcccttgcactccagcctgggcaacaagagcgaaactctgtctcaaaaaaaaaaaaaaaaaaaaaaaaggataatggcatggataatcacaaagctgtacagcattgactctgaaatgcagtctttaaaaaagtagatattgtttctcctaatactatgatgaccataatacatatttgtgtgatagtttaccgtttcccaaatgatttctcaattaatattcacagtattagtatgaaaaagagcgggctttattaccttcaatttacagaggaggaaactgagacttagatctggtaagatatttgtccagagttaattgtctatacctgcagttcccaaactttttaatgaaagaagcctttacatccttgaaaattgaaaaccccaaagaactcttgtttatgtaggttatatcttttaaaaaatactttcaacttttattttagattcaggaggtacatgtgtaaggttttgttacatgggaatactgcgtgatgctgagatttggagtatgaatggtcctgtcacccaggtagtgagcatagtacccaacatgtagtttttcagcccttctgccaaccctctttcctccctctagtagtccccagtgttcattgtgcccatctttgtgtccacgtgtacccaatgcttagcccccacttataagtgagaacacgtggtatttggttttctgttcctgcgttaatttgcttaggataacggtttccagctgcatccaccttgctgcaaaggacatgattgcatttctttttatggctgcagagtattccatggtatataggttacatctattgatatttaccatgtgataaaactaagaaatacaaaattttgaatgtaataattgtttaaaaatattaataaacccattgtaagtttatatcaataagatttttgtttaaaaagttacatttttcaaaataaaaatcagtgagaagactgatttaaatacttaaatacttacaaaagaaatacttttgtaaatcactttaacttctggctcagtaaaaggtgaattctcatatccacttttgcattcaatttgttgtgctaccatacacctagtatcctctagaaaactccactgtgtacttgtgagaggatgagagtgaaaaaggcaaatagtgtcttaatgtaggttgaccttgcagaccccttgaaagggtctcaggaacccacaacagtctgtctcccacactttgggaatctcaggcttagactaataataaaaagaagtttaatttctttaattaatgttagctggggatggaatggatagtagtagttgttaaatgcgagcaaaaagtcagaggaagccagtttgtgtttaaccgtttgctgtagatgatctatgaaggcattgtaaagaactcagttttaagtaggcatttttttttctagctatggtatcagaagataaagtaaatatgcaaaattgaagaatgctttaatcacagaggatgggaatatagaaaaacctattagtttctctctctttgtccaataattctctgagatgtgctactaaggaaaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtt
